United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 85

SEQ ID NO: 165486 - DNA, 1605 bp, Artificial Sequence
  Description of Artificial Sequence: Synthetic coding sequence
atgatctggtacatcctgatcatcggcatcctgctgccccagagcctggcccaccctggcttcttcaccagcatcggccagatgacagacctgatccacacagagaaggacctggtgaccagcctgaaggactacatcaaggccgaggaggacaagctggagcagatcaagaagtgggccgagaagctggaccggctgaccagcacagccaccaaggaccctgagggctttgtgggccaccctgtgaatgccttcaagctgatgaagaggctgaacacagagtggagcgagctggagaacctggtgctgaaggacatgtctgatggcttcatcagcaacctgaccatccagaggcagtacttccccaatgatgaggaccaggtgggcgccgccaaggccctgctgcggctgcaggacacctacaacctggacacagacaccatcagcaagggcaacctgcccggggtgaagcacaagagcttcctgacagctgaggactgctttgagctgggcaaggtggcctacacagaggccgactactaccacacagagctgtggatggagcaggccctgcggcagctggatgaaggagagatcagcaccatcgacaaggtgtctgtgctggactacctgtcctatgctgtgtaccagcagggcgacctggacaaggccctgctgctgaccaagaagctgctggagctggaccctgagcaccagagggccaacggcaacctgaagtactttgagtacatcatggccaaggagaaggatgtgaacaagagcgccagtgatgaccagagcgaccagaagaccacccccaagaagaagggcgtggccgtggactacctgcctgagcggcagaagtatgagatgctgtgccgcggggagggcatcaagatgaccccccggcggcagaagaagctgttctgccgctaccatgatggcaacagaaaccccaagttcatcctggccccagccaagcaggaggatgagtgggacaagccccgcatcatccgcttccatgacatcatcagtgatgctgagattgaaattgtgaaggacctggccaagccccggctgagccgggccaccgtgcatgaccctgagaccgggaagctgaccacagcccagtacagagtgtccaagagcgcctggctgagcggctatgagaaccctgtggtgagccgcatcaacatgaggatccaggacctgaccggcctggatgtgtccacagctgaggagctgcaggtggccaactacggcgtgggcggccagtatgagccccactttgattttgccaggaaggatgagccagatgccttcaaggagctgggcaccggcaaccgcatcgccacctggctgttctacatgtctgatgtgtctgctgggggcgccaccgtcttccctgaggtgggcgcctctgtgtggcccaagaagggcacagctgtgttctggtacaacctgtttgccagcggggagggggactacagcaccaggcatgctgcctgccctgtgctggtgggcaacaagtgggtgagcaacaagtggctgcacgagcggggccaggagttcagaagaccctgcaccctgtctgagctggagtag

SEQ ID NO: 165487 - DNA, 1605 bp, Artificial Sequence
  Description of Artificial Sequence: Synthetic coding sequence
atgatctggtacatcctgatcatcggcatcctgctgccccagagcctggcccaccctggcttcttcaccagcatcggccagatgacagacctgatccacacagagaaggacctggtgaccagcctgaaggactacatcaaggccgaggaggacaagctggagcagatcaagaagtgggccgagaagctggaccggctgaccagcacagccaccaaggaccctgagggctttgtgggccaccctgtgaatgccttcaagctgatgaagaggctgaacacagagtggagcgagctggagaacctggtgctgaaggacatgtctgatggcttcatcagcaacctgaccatccagaggcagtacttccccaatgatgaggaccaggtgggcgccgccaaggccctgctgcggctgcaggacacctacaacctggacacagacaccatcagcaagggcaacctgcccggggtgaagcacaagagcttcctgacagctgaggactgctttgagctgggcaaggtggcctacacagaggccgactactaccacacagagctgtggatggagcaggccctgcggcagctggatgaaggagagatcagcaccatcgacaaggtgtctgtgctggactacctgtcctatgctgtgtaccagcagggcgacctggacaaggccctgctgctgaccaagaagctgctggagctggaccctgagcaccagagggccaacggcaacctgaagtactttgagtacatcatggccaaggagaaggatgtgaacaagagcgccagtgatgaccagagcgaccagaagaccacccccaagaagaagggcgtggccgtggactacctgcctgagcggcagaagtatgagatgctgtgccgcggggagggcatcaagatgaccccccggcggcagaagaagctgttctgccgctaccatgatggcaacagaaaccccaagttcatcctggccccagccaagcaggaggatgagtgggacaagccccgcatcatccgcttccatgacatcatcagtgatgctgagattgaaattgtgaaggacctggccaagccccggctgcggcgggccaccatcagcaaccccatcaccggggacctggagaccgtgcactaccgcatcagcaagagcgcctggctgagcggctatgagaaccctgtggtgagccgcatcaacatgaggatccaggacctgaccggcctggatgtgtccacagctgaggagctgcaggtggccaactacggcgtgggcggccagtatgagccccactttgattttgccaggaaggatgagccagatgccttcaaggagctgggcaccggcaaccgcatcgccacctggctgttctacatgtctgatgtgtctgctgggggcgccaccgtcttccctgaggtgggcgcctctgtgtggcccaagaagggcacagctgtgttctggtacaacctgtttgccagcggggagggggactacagcaccaggcatgctgcctgccctgtgctggtgggcaacaagtgggtgagcaacaagtggctgcacgagcggggccaggagttcagaagaccctgcaccctgtctgagctggagtag

SEQ ID NO: 165488 - DNA, 1605 bp, Artificial Sequence; identical to SEQ ID NO: 165486
  Description of Artificial Sequence: Synthetic coding sequence

SEQ ID NO: 165489 - DNA, 1605 bp, Artificial Sequence; identical to SEQ ID NO: 165487
  Description of Artificial Sequence: Synthetic coding sequence

SEQ ID NO: 165490 - DNA, 1605 bp, Artificial Sequence; identical to SEQ ID NO: 165487
  Description of Artificial Sequence: Synthetic coding sequence

SEQ ID NO: 165491 - DNA, 1551 bp, Artificial Sequence
  Description of Artificial Sequence: Synthetic coding sequence
atgatctggtacatcctgatcatcggcatcctgctgccccagagcctggcccaccctggcttcttcaccagcatcggccagatgacagacctgatccacacagagaaggacctggtgaccagcctgaaggactacatcaaggccgaggaggacaagctggagcagatcaagaagtgggccgagaagctggaccggctgaccagcacagccaccaaggaccctgagggctttgtgggccaccctgtgaatgccttcaagctgatgaagaggctgaacacagagtggagcgagctggagaacctggtgctgaaggacatgtctgatggcttcatcagcaacctgaccatccagaggcagtacttccccaatgatgaggaccaggtgggcgccgccaaggccctgctgcggctgcaggacacctacaacctggacacagacaccatcagcaagggcaacctgcccggggtgaagcacaagagcttcctgacagctgaggactgctttgagctgggcaaggtggcctacacagaggccgactactaccacacagagctgtggatggagcaggccctgcggcagctggatgaaggagagatcagcaccatcgacaaggtgtctgtgctggactacctgtcctatgctgtgtaccagcagggcgacctggacaaggccctgctgctgaccaagaagctgctggagctggaccctgagcaccagagggccaacggcaacctgaagtactttgagtacatcatggccaaggagaaggatgtgaacaagagcgccagtgatgaccagagcgaccagaagaccacccccaagaagaagggcgtggccgtggactacctgcctgagcggcagaagtatgagatgctgtgccgcggggagggcatcaagatgaccccccggcggcagaagaagctgttctgccgctaccatgatggcaacagaaaccccaagttcatcctggccccagccaagcaggaggatgagtgggacaagccccgcatcatccgcttccatgacatcatcagtgatgctgagattgaaattgtgaaggacctggccaagccccggctgagccgggccaccgtgcatgaccctgagaccgggaagctgaccacagcccagtacagagtgtccaagagcgcctggctgagcggctatgagaaccctgtggtgagccgcatcaacatgaggatccaggacctgaccggcctggatgtgtccacagctgaggagctgcagaaggatgagccagatgccttcaaggagctgggcaccggcaaccgcatcgccacctggctgttctacatgtctgatgtgtctgctgggggcgccaccgtcttccctgaggtgggcgcctctgtgtggcccaagaagggcacagctgtgttctggtacaacctgtttgccagcggggagggggactacagcaccaggcatgctgcctgccctgtgctggtgggcaacaagtgggtgagcaacaagtggctgcacgagcggggccaggagttcagaagaccctgcaccctgtctgagctggagtag

SEQ ID NO: 165492 - DNA, 1608 bp, Artificial Sequence
  Description of Artificial Sequence: Synthetic coding sequence
atgaagctgtgggtgtctgccctgctgatggcctggtttggagtgctgagctgtgtgcaggccgagttcttcaccagcatcggccacatgacagacctgatctatgcagagaaggagctggtgcagagcctgaaggagtacatcctggtggaggaggccaagctgagcaagatcaagtcctgggccaacaagatggaggccctgaccagcaagtctgctgctgatgctgagggctacctggcccaccctgtgaatgcctacaagctggtgaagaggctgaacacagactggccagccctggaggacctggtgctgcaggacagcgctgctggcttcatcgccaacctgtctgtgcagaggcagttcttccccacagatgaagatgagatcggggccgccaaggccctgatgaggctgcaggacacctaccgcctggaccccggcaccatcagcagaggagagctgcccggcaccaagtaccaggccatgctgtctgtggatgactgcttcggcatgggccgcagcgcctacaatgaaggagactactaccacacagtgctgtggatggagcaggtgctgaagcagctggatgctggggaggaggccaccaccaccaagagccaggtgctggactacctgtcctatgctgtgttccagctgggggacctgcaccgggccctggagctgacccggcggctgctgagcctggaccccagccatgaaagagctgggggcaacctgcgctactttgagcagctgctggaggaggagcgggagaagaccctgaccaaccagacagaggccgagctggccaccccagagggcatctatgaaagacctgtggactacctgcctgagagagatgtgtatgagagcctgtgccgcggggagggcgtgaagctgaccccccggcggcagaagaggctcttctgccgctaccaccacggcaacagagccccccagctgctgattgcccccttcaaggaggaggatgagtgggacagcccccacatcgtgcgctactatgatgtgatgtctgatgaggagattgaaagaatcaaggagatcgccaagcccaagctggcccgggccaccgtgcgggaccccaagacaggagtgctgactgtggccagctacagagtgtccaagagctcctggctggaggaggatgatgatcctgtggtggcccgggtgaacagaaggatgcagcacatcaccggcctgactgtgaagacagctgagctgctgcaggtggccaactatggagtgggcggccagtatgagccccactttgacttcagcagaaatgatgagcgggacaccttcaagcacctgggcactggaaacagagtggccaccttcctgaactacatgtctgatgtggaggccggcggggccaccgtcttcccagacctgggcgccgccatctggcccaagaagggcacagctgtgttctggtacaacctgctgcggagcggggagggggactaccgcaccaggcatgctgcctgccctgtgctggtgggctgcaagtgggtgagcaacaagtggttccacgagcggggccaggagttcctgcggccctgtggcagcacagaggtggactag

SEQ ID NO: 165493 - DNA, 1602 bp, Artificial Sequence
  Description of Artificial Sequence: Synthetic coding sequence
atgaagctgtgggtgtctgccctgctgatggcctggtttggagtgctgagctgtgtgcaggccgagttcttcaccagcatcggccacatgacagacctgatctatgcagagaaggagctggtgcagagcctgaaggagtacatcctggtggaggaggccaagctgagcaagatcaagtcctgggccaacaagatggaggccctgaccagcaagtctgctgctgatgctgagggctacctggcccaccctgtgaatgcctacaagctggtgaagaggctgaacacagactggccagccctggaggacctggtgctgcaggacagcgctgctggcttcatcgccaacctgtctgtgcagaggcagttcttccccacagatgaagatgagatcggggccgccaaggccctgatgaggctgcaggacacctaccgcctggaccccggcaccatcagcagaggagagctgcccggcaccaagtaccaggccatgctgtctgtggatgactgcttcggcatgggccgcagcgcctacaatgaaggagactactaccacacagtgctgtggatggagcaggtgctgaagcagctggatgctggggaggaggccaccaccaccaagagccaggtgctggactacctgtcctatgctgtgttccagctgggggacctgcaccgggccctggagctgacccggcggctgctgagcctggaccccagccatgaaagagctgggggcaacctgcgctactttgagcagctgctggaggaggagcgggagaagaccctgaccaaccagacagaggccgagctggccaccccagagggcatctatgaaagacctgtggactacctgcctgagagagatgtgtatgagagcctgtgccgcggggagggcgtgaagctgaccccccggcggcagaagaggctcttctgccgctaccaccacggcaacagagccccccagctgctgattgcccccttcaaggaggaggatgagtgggacagcccccacatcgtgcgctactatgatgtgatgtctgatgaggagattgaaagaatcaaggagatcgccaagcccaagctggcccgggccaccgtgcgggaccccaagacaggagtgctgactgtggccagctacagagtgtccaagagctcctggctggaggaggatgatgatcctgtggtggcccgggtgaacagaaggatgcagcacatcaccggcctgactgtgaagacagctgagctgctgcaggtggccaactatggagtgggcggccagtatgagccccactttgacttcagcagaagaccatttgacagcggcctgaagacagagggcaaccggctggccaccttcctgaactacatgtctgatgtggaggccggcggggccaccgtcttcccagacctgggcgccgccatctggcccaagaagggcacagctgtgttctggtacaacctgctgcggagcggggagggggactaccgcaccaggcatgctgcctgccctgtgctggtgggctgcaagtgggtgagcaacaagtggttccacgagcggggccaggagttcctgcggccctgtggcagcacagaggtggactag

SEQ ID NO: 165494 - DNA, 1602 bp, Artificial Sequence; identical to SEQ ID NO: 165493
  Description of Artificial Sequence: Synthetic coding sequence

SEQ ID NO: 165495 - DNA, 1602 bp, Artificial Sequence; identical to SEQ ID NO: 165493
  Description of Artificial Sequence: Synthetic coding sequence

SEQ ID NO: 165496 - DNA, 1608 bp, Artificial Sequence; identical to SEQ ID NO: 165492
  Description of Artificial Sequence: Synthetic coding sequence

SEQ ID NO: 165497 - DNA, 504 bp, Artificial Sequence
  Description of Artificial Sequence: Synthetic coding sequence
atgaagctgtgggtgtctgccctgctgatggcctggtttggagtgctgagctgtgtgcaggccgagttcttcaccagcatcggccacatgacagacctgatctatgcagagaaggagctggtgcagagcctgaaggagtacatcctggtggaggaggccaagctgagcaagatcaagtcctgggccaacaagatggaggccctgaccagcaagtctgctgctgatgctgagggctacctggcccaccctgtgaatgcctacaagctggtgaagaggctgaacacagactggccagccctggaggacctggtgctgcaggacagcgctgctggcttcatcgccaacctgtctgtgcagaggcagttcttccccacagatgaagatgagatcggggccgccaaggccctgatgaggctgcaggacacctaccgcctggaccccggcaccatcagcagaggagagctgcccggcaccaagtaccaggccatgctgtctgtggactag

SEQ ID NO: 165498 - DNA, 1608 bp, Artificial Sequence; identical to SEQ ID NO: 165492
  Description of Artificial Sequence: Synthetic coding sequence

SEQ ID NO: 165499 - DNA, 306 bp, Artificial Sequence
  Description of Artificial Sequence: Synthetic coding sequence
atgaagctgtgggtgtctgccctgctgatggcctggtttggagtgctgagctgtgtgcaggccgagttcttcaccagcatcggccacatgacagacctgatctatgcagagaaggagctggtgcagagcctgaaggagtacatcctggtggaggaggccaagctgagcaagatcaagtcctgggccaacaagatggaggccctgaccagcaagtctgctgctgatgctgagggctacctggcccaccctgtgaatgcctacaagctggtgaagaggctgaacacagactggccagccctggagtag

SEQ ID NO: 165500 - DNA, 615 bp, Artificial Sequence
  Description of Artificial Sequence: Synthetic coding sequence
atgaagctgtgggtgtctgccctgctgatggcctggtttggagtgctgagctgtgtgcaggccgagttcttcaccagcatcggccacatgacagacctgatctatgcagagaaggagctggtgcagagcctgaaggagtacatcctggtggaggaggccaagctgagcaagatcaagtcctgggccaacaagatggaggccctgaccagcaagtctgctgctgatgctgagggctacctggcccaccctgtgaatgcctacaagctggtgaagaggctgaacacagactggccagccctggaggacctggtgctgcaggacagcgctgctggcttcatcgccaacctgtctgtgcagaggcagttcttccccacagatgaagatgagatcggggccgccaaggccctgatgaggctgcaggacacctaccgcctggaccccggcaccatcagcagaggagagctgcccggcaccaagtaccaggccatgctgtctgtggatgactgcttcggcatgggccgcagcgcctacaatgaaggagactactaccacacagtgctgtggatggagcaggtgctgaagcagctggatgctggggaggaggccaccacctag

SEQ ID NO: 165501 - DNA, 345 bp, Artificial Sequence
  Description of Artificial Sequence: Synthetic coding sequence
atgaagctgtgggtgtctgccctgctgatggcctggtttggagtgctgagctgtgtgcaggccgagttcttcaccagcatcggccacatgacagacctgatctatgcagagaaggagctggtgcagagcctgaaggagtacatcctggtggaggaggccaagctgagcaagatcaagtcctgggccaacaagatggaggccctgaccagcaagtctgctgctgatgctgagggctacctggcccaccctgtgaatgcctacaagctggtgaagaggctgaacacagactggccagccctggaggacctggtgctgcaggacagcgctgctggcttcatcgcctag

SEQ ID NO: 165502 - DNA, 444 bp, Artificial Sequence
  Description of Artificial Sequence: Synthetic coding sequence
atgaagctgtgggtgtctgccctgctgatggcctggtttggagtgctgagctgtgtgcaggccgagttcttcaccagcatcggccacatgacagacctgatctatgcagagaaggagctggtgcagagcctgaaggagtacatcctggtggaggaggccaagctgagcaagatcaagtcctgggccaacaagatggaggccctgaccagcaagtctgctgctgatgctgagggctacctggcccaccctgtgaatgcctacaagctggtgaagaggctgaacacagactggccagccctggaggacctggtgctgcaggacagcgctgctggcttcatcgccaacctgtctgtgcagaggcagttcttccccacagatgaagatgagatcggggccgccaaggccctgatgaggctgcaggacacctaccgcctggacccctag

SEQ ID NO: 165503 - DNA, 153 bp, Artificial Sequence
  Description of Artificial Sequence: Synthetic coding sequence
atgaagctgtgggtgtctgccctgctgatggcctggtttggagtgctgagctgtgtgcaggccgagttcttcaccagcatcggccacatgacagacctgatctatgcagagaaggagctggtgcagagcctgaaggagtacatcctggtgtag

SEQ ID NO: 165504 - DNA, 555 bp, Artificial Sequence
  Description of Artificial Sequence: Synthetic coding sequence
atgaagctgtgggtgtctgccctgctgatggcctggtttggagtgctgagctgtgtgcaggccgagttcttcaccagcatcggccacatgacagacctgatctatgcagagaaggagctggtgcagagcctgaaggagtacatcctggtggaggaggccaagctgagcaagatcaagtcctgggccaacaagatggaggccctgaccagcaagtctgctgctgatgctgagggctacctggcccaccctgtgaatgcctacaagctggtgaagaggctgaacacagactggccagccctggaggacctggtgctgcaggacagcgctgctggcttcatcgccaacctgtctgtgcagaggcagttcttccccacagatgaagatgagatcggggccgccaaggccctgatgaggctgcaggacacctaccgcctggaccccggcaccatcagcagaggagagctgcccggcaccaagtaccaggccatgctgtctgtggatgactgcttcggcatgggccgcagcgcctacaatgaaggagactactaccactag

SEQ ID NO: 165505 - DNA, 462 bp, Artificial Sequence
  Description of Artificial Sequence: Synthetic coding sequence
atgaagctgtgggtgtctgccctgctgatggcctggtttggagtgctgagctgtgtgcaggccgagttcttcaccagcatcggccacatgacagacctgatctatgcagagaaggagctggtgcagagcctgaaggagtacatcctggtggaggaggccaagctgagcaagatcaagtcctgggccaacaagatggaggccctgaccagcaagtctgctgctgatgctgagggctacctggcccaccctgtgaatgcctacaagctggtgaagaggctgaacacagactggccagccctggaggacctggtgctgcaggacagcgctgctggcttcatcgccaacctgtctgtgcagaggcagttcttccccacagatgaagatgagatcggggccgccaaggccctgatgaggctgcaggacacctaccgcctggaccccggcaccatcagccggggctag

SEQ ID NO: 165506 - DNA, 1635 bp, Artificial Sequence
  Description of Artificial Sequence: Synthetic coding sequence
atgggccctggggcccggctggccgccctgctggccgtgctggccctgggcaccggggaccctgagagagctgctgcccggggggacaccttcagcgccctgacctctgtggcccgggccctggcccctgagcggcggctgctgggcctgctgcggcgctacctgcggggggaggaggcccggctgcgggacctgacccgcttctatgacaaggtgctgagcctgcacgaggacagcaccacccctgtggccaaccccctgctggccttcaccctcatcaagaggctgcagagcgactggagaaatgtggtgcacagcctggaggccagcgagaacatccgggccctgaaggatggctatgagaaggtggagcaggacctgcctgcctttgaggacctggagggcgccgcccgggccctgatgaggctgcaggatgtgtacatgctgaatgtgaagggcctggcccggggcgtcttccagagggtgactggaagtgccatcacagacctgtacagccccaagaggctcttcagcctgactggagatgactgcttccaggtgggcaaggtggcctatgacatgggagactactaccacgccatcccctggctggaggaggccgtgtccctcttccggggcagctatggagagtggaagacagaagatgaggccagcctggaggatgccctggaccacctggcctttgcctacttccgggctggaaatgtgtcctgtgccctgagcctgagccgggagttcctgctgtacagcccagacaacaagaggatggccagaaatgtgctgaagtatgaaaggctgctggccgagagccccaaccacgtggtggccgaggccgtcatccagaggcccaacatcccccacctgcagacccgggacacctatgagggcctgtgccagaccctgggcagccagcccaccctgtaccagatccccagcctgtactgcagctatgagaccaacagcaatgcctacctgctgctgcagcccatcaggaaggaggtgatccacctggagccctacatcgccctgtaccatgactttgtgtctgacagcgaggcccagaagatccgggagctggccgagccctggctgcagaggtctgtggtggccagcggggagaagcagctgcaggtggagtaccgcatcagcaagagcgcctggctgaaggacacagtggaccccaagctggtgaccctgaaccacagaattgctgccctgaccggcctggatgtgcggcccccctatgcagagtacctgcaggtggtgaactatggaattggaggccactatgagccccactttgaccacgccaccagccccagcagccccctgtacaggatgaagagcggcaacagagtggccaccttcatgatctacctgagctctgtggaggccggcggggccacagccttcatctatgccaacctgtctgtgcctgtggtgagaaatgctgccctcttctggtggaacctgcacaggtctggagagggggacagcgacaccctgcatgctggctgccctgtgctggtgggggacaagtgggtggccaacaagtggatccacgagtatggccaggagttcagaagaccctgcagcagcagcccagaagattag

SEQ ID NO: 165507 - DNA, 1815 bp, Artificial Sequence
  Description of Artificial Sequence: Synthetic coding sequence
atgggccctggggcccggctggccgccctgctggccgtgctggccctgggcaccggggaccctgagagagctgctgcccggggggacaccttcagcgccctgacctctgtggcccgggccctggcccctgagcggcggctgctgggcctgctgcggcgctacctgcggggggaggaggcccggctgcgggacctgacccgcttctatgacaaggtgctgagcctgcacgaggacagcaccacccctgtggccaaccccctgctggccttcaccctcatcaagaggctgcagagcgactggagaaatgtggtgcacagcctggaggccagcgagaacatccgggccctgaaggatggctatgagaaggtggagcaggacctgcctgcctttgaggacctggagggcgccgcccgggccctgatgaggctgcaggatgtgtacatgctgaatgtgaagggcctggcccggggcgtcttccagagggtgactggaagtgccatcacagacctgtacagccccaagaggctcttcagcctgactggagatgactgcttccaggtgggcaaggtggcctatgacatgggagactactaccacgccatcccctggctggaggaggccgtgtccctcttccggggcagctatggagagtggaagacagaagatgaggccagcctggaggatgccctggaccacctggcctttgcctacttccgggctggaaatgtgtcctgtgccctgagcctgagccgggagttcctgctgtacagcccagacaacaagaggatggccagaaatgtgctgaagtatgaaaggctgctggccgagagccccaaccacgtggtggccgaggccgtcatccagaggcccaacatcccccacctgcagacccgggacacctatgagggcctgtgccagaccctgggcagccagcccaccctgtaccagatccccagcctgtactgcagctatgagaccaacagcaatgcctacctgctgctgcagcccatcaggaaggaggtgatccacctggagccctacatcgccctgtaccatgactttgtgtctgacagcgaggcccagaagatccgggagctggccgagccctggctgcagaggtctgtggtggccagcggggagaagcagctgcaggtggagtaccgcatcagcaagagcgcctggctgaaggacacagtggaccccaagctggtgaccctgaaccacagaattgctgccctgaccggcctggatgtgcggcccccctatgcagagtacctgcaggtggtgaactatggaattggaggccactatgagccccactttgaccacgccaccagccccagcagccccctgtacaggatgaagagcggcaacagagtggccaccttcatgatctacctgagctctgtggaggccggcggggccacagccttcatctatgccaacctgtctgtgcctgtggtgcgccactgcttcggcggcacctgcacaggagtggtgaagggcaccgtgacccacttcatgctggccgtgctgtcctggtgggagatcagcggctggcccaccagcggctacatgtccatggacaggaacagcgctgaccctgctgccccagccctgaagacagagctgctggccgagaggtcctggtggagccctgtggccttccagaggagccaggagcccaaggccggcgtgggggaggagaaggccgagcagcccccaggaagaagaccctgccagctgtgcctgtgcctggccaaccagaggcagggccggggctgctaccagggcaccctgaggatgtacatctag

SEQ ID NO: 165508 - DNA, 1527 bp, Artificial Sequence
  Description of Artificial Sequence: Synthetic coding sequence
atgctgcggcgggccctgctgtgcctggccgtggccgccctggtgcgggcagatgcccctgaggaggaggaccacgtgctggtgctgaggaagagcaactttgctgaggccctggccgcccacaagtacctgctggtggagttctacgccccctggtgtggccactgcaaggccctggccccagaatatgccaaggctgctgggaagctgaaggccgagggcagcgagatccggctggccaaggtggatgccacagaggagagtgacctggcccagcagtatggagtgcggggctaccccaccatcaagttcttcagaaatggagacacagccagccccaaggagtacacagctggccgggaggctgatgacatcgtgaactggctgaagaagaggactggacctgctgccaccaccctgcctgatggagctgctgctgagagcctggtggagagcagcgaggtggccgtcatcggcttcttcaaggatgtggagagtgacagcgccaagcagttcctgcaggccgctgaggccattgatgacatccccttcggcatcaccagcaacagtgatgtgttcagcaagtaccagctggacaaggatggagtggtgctcttcaagaagtttgatgagggcaggaacaactttgaaggagaggtgaccaaggagaacctgctggacttcatcaagcacaaccagctgcccctggtgattgagttcacagagcagacagcccccaagatctttggaggagagatcaagacccacatcctgctcttcctgcccaagtctgtgtctgactatgatggcaagctgagcaacttcaagacagctgctgagagcttcaagggcaagatcctcttcatcttcatcgacagcgaccacacagacaaccagaggatcctggagttcttcggcctgaagaaggaggagtgcccagctgtgcggctcatcaccctggaggaggagatgaccaagtacaagccagagagcgaggagctgacagctgagcgcatcacagagttctgccaccgcttcctggagggcaagatcaagccccacctgatgagccaggagctgcctgaggactgggacaagcagcctgtgaaggtgctggtgggcaagaactttgaagatgtggcctttgatgagaagaagaatgtgtttgtggagttctacgccccctggtgtggccactgcaagcagctggcccccatctgggacaagctgggggagacctacaaggaccacgagaacatcgtcatcgccaagatggacagcacagccaatgaggtggaggccgtgaaggtgcacagcttccccaccctgaagttcttccctgccagcgctgacagaacagtgattgactacaacggggagaggaccctggatggcttcaagaagttcctggagagcggcggccaggatggagctggagatgatgatgacctggaggacctggaggaggccgaggagccagacatggaggaggatgatgaccagaaggctgtgaaggatgagctgtag

SEQ ID NO: 165509 - DNA, 1479 bp, Artificial Sequence
  Description of Artificial Sequence: Synthetic coding sequence
atgctgcggcgggccctgctgtgcctggccgtggccgccctggtgcgggcagatgcccctgaggaggaggaccacaagtacctgctggtggagttctacgccccctggtgtggccactgcaaggccctggccccagaatatgccaaggctgctgggaagctgaaggccgagggcagcgagatccggctggccaaggtggatgccacagaggagagtgacctggcccagcagtatggagtgcggggctaccccaccatcaagttcttcagaaatggagacacagccagccccaaggagtacacagctggccgggaggctgatgacatcgtgaactggctgaagaagaggactggacctgctgccaccaccctgcctgatggagctgctgctgagagcctggtggagagcagcgaggtggccgtcatcggcttcttcaaggatgtggagagtgacagcgccaagcagttcctgcaggccgctgaggccattgatgacatccccttcggcatcaccagcaacagtgatgtgttcagcaagtaccagctggacaaggatggagtggtgctcttcaagaagtttgatgagggcaggaacaactttgaaggagaggtgaccaaggagaacctgctggacttcatcaagcacaaccagctgcccctggtgattgagttcacagagcagacagcccccaagatctttggaggagagatcaagacccacatcctgctcttcctgcccaagtctgtgtctgactatgatggcaagctgagcaacttcaagacagctgctgagagcttcaagggcaagatcctcttcatcttcatcgacagcgaccacacagacaaccagaggatcctggagttcttcggcctgaagaaggaggagtgcccagctgtgcggctcatcaccctggaggaggagatgaccaagtacaagccagagagcgaggagctgacagctgagcgcatcacagagttctgccaccgcttcctggagggcaagatcaagccccacctgatgagccaggagctgcctgaggactgggacaagcagcctgtgaaggtgctggtgggcaagaactttgaagatgtggcctttgatgagaagaagaatgtgtttgtggagttctacgccccctggtgtggccactgcaagcagctggcccccatctgggacaagctgggggagacctacaaggaccacgagaacatcgtcatcgccaagatggacagcacagccaatgaggtggaggccgtgaaggtgcacagcttccccaccctgaagttcttccctgccagcgctgacagaacagtgattgactacaacggggagaggaccctggatggcttcaagaagttcctggagagcggcggccaggatggagctggagatgatgatgacctggaggacctggaggaggccgaggagccagacatggaggaggatgatgaccagaaggctgtgaaggatgagctgtag

SEQ ID NO: 165510 - DNA, 1356 bp, Artificial Sequence
  Description of Artificial Sequence: Synthetic coding sequence
atgctgcggcgggccctgctgtgcctggccgtggccgccctggtgcgggcagatgcccctgaggaggaggaccacgtgctggtgctgaggaagagcaactttgctgaggccctggccgcccacaagtacctgctggtggagttctacgccccctggtgtggccactgcaaggccctggccccagaatatgccaaggctgctgggaagctgaaggccgagggcagcgagatccggctggccaaggtggatgccacagaggagagtgacctggcccagcagtatggagtgcggggctaccccaccatcaagttcttcagaaatggagacacagccagccccaaggagtacacagctggccgggaggctgatgacatccccttcggcatcaccagcaacagtgatgtgttcagcaagtaccagctggacaaggatggagtggtgctcttcaagaagtttgatgagggcaggaacaactttgaaggagaggtgaccaaggagaacctgctggacttcatcaagcacaaccagctgcccctggtgattgagttcacagagcagacagcccccaagatctttggaggagagatcaagacccacatcctgctcttcctgcccaagtctgtgtctgactatgatggcaagctgagcaacttcaagacagctgctgagagcttcaagggcaagatcctcttcatcttcatcgacagcgaccacacagacaaccagaggatcctggagttcttcggcctgaagaaggaggagtgcccagctgtgcggctcatcaccctggaggaggagatgaccaagtacaagccagagagcgaggagctgacagctgagcgcatcacagagttctgccaccgcttcctggagggcaagatcaagccccacctgatgagccaggagctgcctgaggactgggacaagcagcctgtgaaggtgctggtgggcaagaactttgaagatgtggcctttgatgagaagaagaatgtgtttgtggagttctacgccccctggtgtggccactgcaagcagctggcccccatctgggacaagctgggggagacctacaaggaccatgaaaatattgtgattgccaagatggacagcacagccaatgaggtggaggccgtgaaggtgcacagcttccccaccctgaagttcttccctgccagcgctgacagaactgtcatcgactacaatggagagaggaccctggatggcttcaagaagttcctggagagcggcggccaggatggagctggagatgatgatgacctggaggacctggaggaggccgaggagccagacatggaggaggatgatgaccagaaggctgtgaaggatgagctgtag

SEQ ID NO: 165511 - DNA, 2133 bp, Artificial Sequence
  Description of Artificial Sequence: Synthetic coding sequence
atgctgagcctgcagtacccagatgtgtacagagatgaaacagctgtgcaggactaccacggccacaagatctgtgacccctatgcctggctggaggaccctgacagcgagcagaccaaggcctttgtggaggcccagaacaagatcaccgtgcccttcctggagcagtgccccatccggggcctgtacaaggagaggatgacagagctgtatgactaccccaagtacagctgccacttcaagaagggcaagcgctacttctacttctacaacacaggcctgcagaaccagagggtgctgtatgtgcaggacagcctggagggggaggcccgggtcttcctggaccccaacatcctgagtgatgatggcaccgtggccctgcggggctacgccttctctgaagatggagagtactttgcctacggcctgagcgccagcggcagtgactgggtgaccatcaagttcatgaaggtggatggagccaaggagctgcctgatgtgctggagcgggtgaagttcagctgcatggcctggacccatgatggcaagggcatgttctacaacagctacccccagcaggacggcaagagtgatggaacagagaccagcaccaacctgcaccagaagctgtactaccacgtgctgggcacagaccagagcgaggacatcctgtgtgccgagttcccagatgagcccaagtggatgggcggcgctgagctgagtgatgatggccgctacgtgctgctgagcatccgggagggctgtgaccctgtgaaccggctgtggtactgtgacctgcagcaggagagcagcggcattgctggcatcctgaagtgggtgaagctgattgacaactttgaaggagaatatgactatgtgaccaatgaaggcaccgtcttcaccttcaagaccaaccggcagagccccaactacagagtcatcaacatcgacttccgggaccctgaggagagcaagtggaaggtgctggtgcctgagcacgagaaggatgtgctggagtggatcgcctgtgtgcgcagcaacttcctggtgctgtgctacctgcatgatgtgaagaacatcctgcagctgcatgacctgaccaccggggccctgctgaagaccttccccctggatgtgggcagcatcgtgggctacagcggccagaagaaggacacagagatcttctaccagttcaccagcttcctgagccctggcatcatctaccactgtgacctgaccaaggaggagctggagcccagggtcttccgggaggtgacagtgaagggcattgatgccagtgactaccagacagtgcagatcttctaccccagcaaggatggcaccaagatccccatgttcatcgtgcacaagaagggcatcaagctggatggcagccacccagccttcctgtatggctatggaggcttcaacatcagcatcacccccaactacagcgtgagccgcctcatctttgtgcgccacatgggcggcatcctggccgtggccaacatccggggcggcggggagtatggagagacctggcacaagggcggcatcctggccaacaagcagaactgctttgatgacttccagtgtgccgctgagtacctgatcaaggagggctacaccagccccaagaggctgaccatcaatggaggcagcaatggaggcctgctggtggccgcctgtgccaaccagaggccagacctgtttggctgtgtgattgcccaggtgggcgtgatggacatgctgaagttccacaagtacaccatcggccacgcctggaccacagattatggctgcagcgacagcaagcagcactttgagtggctggtgaagtacagccccctgcacaacgtgaagctgcctgaggctgatgacatccagtaccccagcatgctgctgctgacagctgaccatgatgacagagtggtgcccctgcacagcctgaagttcatcgccaccctgcagtacatcgtgggccgcagcaggaagcagagcaaccccctgctgattcatgtggacaccaaggccggccacggggccggcaagcccacagccaaggtgattgaggaggtgtctgacatgtttgccttcatcgcccgctgcctgaatgtggactggatcccctag

SEQ ID NO: 165512 - DNA, 138 bp, Artificial Sequence
  Description of Artificial Sequence: Synthetic coding sequence
tgaatcatctaccactgtgacctgaccaaggaggagctggagcccagggtcttccgggaggtgacagtgaagggcattgatgccagtgactaccagacagtgcagctgcccaagggcacagagagcagcaggaactag

SEQ ID NO: 165513 - DNA, 135 bp, Artificial Sequence
  Description of Artificial Sequence: Synthetic coding sequence
atcatctaccactgtgacctgaccaaggaggagctggagcccagggtcttccgggaggtgacagtgaagggcattgatgccagtgactaccagacagtgcagctgcccaagggcacagagagcagcagaaattag

SEQ ID NO: 165514 - DNA, 2184 bp, Artificial Sequence
  Description of Artificial Sequence: Synthetic coding sequence
atgcagcagaagaccaagctgttcctgcaggccctgaagtacagcatcccccacctgggcaagtgcatgcagaagcagcacctgaaccactacaactttgctgaccactgctacaaccgcatcaagctgaagaagtaccacctgaccaagtgcctgcagaacaagcccaagatcagcgagctggccaggaacatccccagccgctccttcagctgcaaggacctgcagcctgtgaagcaggagaatgagaagcccctgcctgagaacatggatgcctttgagaaggtgaggaccaagctggagacccagccccaggaggagtatgagatcatcaacgtggaggtgaagcatggaggctttgtgtactaccaggagggctgctgcctggtgcgcagcaaggatgaggaggccgacaatgacaactatgaggtgctcttcaacctggaggagctgaagctggaccagcccttcatcgactgcatccgggtggccccagatgagaagtatgtggccgccaagatcagaacagaagattctgaggccagcacctgtgtgatcatcaagctgagtgaccagcctgtgatggaggccagcttccccaacgtgagcagctttgagtgggtgaaggatgaggaggatgaagatgtgctcttctacaccttccagaggaacctgcgctgccatgatgtgtaccgggccacctttggagacaacaagagaaatgaacgcttctacacagagaaggaccccagctactttgtgttcctgtacctgaccaaggacagccgcttcctgaccatcaacatcatgaacaagaccaccagcgaggtgtggctgattgatggcctgagcccctgggacccccctgtgctgatccagaagagaattcatggagtgctgtactacgtggagcacagagatgatgagctgtacatcctgaccaacgtgggggagcccacagagttcaagctgatgaggacagctgctgacaccccagccatcatgaactgggacctcttcttcaccatgaagaggaacaccaaggtgattgacctggacatgttcaaggaccactgtgtgctcttcctgaagcacagcaacctgctgtatgtgaatgtcatcggcctggctgatgacagcgtgcgcagcctgaagctgcccccctgggcctgtggcttcatcatggacaccaacagcgaccccaagaactgccccttccagctgtgcagccccatccggccccccaagtactacacctacaagtttgctgagggcaagctgtttgaggagactggacatgaggaccccatcaccaagaccagccgggtgctgcggctggaggccaagagcaaggatggcaagctggtgcccatgacagtgttccacaagacagacagcgaggacctgcagaagaagcccctgctggtgcacgtgtatggagcctacggcatggacctgaagatgaacttccggcctgagcggcgggtgctggtggatgatggctggatcctggcctactgccacgtgcggggcggcggggagctgggcctgcagtggcatgctgatggccgcctgaccaagaagctgaatggcctggccgacctggaggcctgcatcaagaccctgcacggccagggcttcagccagcccagcctgaccaccctgacagccttctctgctgggggcgtgctggccggggccctgtgcaacagcaaccctgagctggtgcgggctgtgaccctggaggcccccttcctggatgtgctgaacaccatgatggacaccaccctgcccctgaccctggaggagctggaggagtggggcaaccccagcagtgatgagaagcacaagaactacatcaagcgctactgcccctaccagaacatcaagccccagcactaccccagcatccacatcacagcctatgaaaatgatgagcgggtgcccctgaagggcatcgtgtcctacacagagaagctgaaggaggccatcgccgagcacgccaaggacacaggagagggctaccagacccccaacatcatcctggacatccagcccggcggcaaccacgtgattgaggacagccacaagaagatcacagcccagatcaagttcctgtatgaggagctgggcctggacagcacctctgtgtttgaggacctgaagaagtacctgaagttctag

SEQ ID NO: 165515 - DNA, 1998 bp, Artificial Sequence
  Description of Artificial Sequence: Synthetic coding sequence
atgcagcagaagaccaagctgttcctgcaggccctgaagtacagcatcccccacctgggcaagtgcatgcagaagcagcacctgaaccactacaactttgctgaccactgctacaaccgcatcaagctgaagaagtaccacctgaccaagtgcctgcagaacaagcccaagatcagcgagctggccaggaacatccccagccgctccttcagctgcaaggacctgcagcctgtgaagcaggagaatgagaagcccctgcctgagaacatggatgcctttgagaaggtgaggaccaagctggagacccagccccaggaggagtatgagatcatcaacgtggaggtgaagcatggaggctttgtgtactaccaggagggctgctgcctggtgcgcagcaaggatgaggaggccgacaatgacaactatgaggtgctcttcaacctggaggagctgaagctggaccagcccttcatcgactgcatccgggtggccccagatgagaagtatgtggccgccaagatcagaacagaagattctgaggccagcacctgtgtgatcatcaagctgagtgaccagcctgtgatggaggccagcttccccaacgtgagcagctttgagtgggtgaaggatgaggaggatgaagatgtgctcttctacaccttccagaggaacctgcgctgccatgatgtgtaccgggccacctttggagacaacaagagaaatgaacgcttctacacagagaaggaccccagctactttgtgttcctgtacctgaccaaggacagccgcttcctgaccatcaacatcatgaacaagaccaccagcgaggtgtggctgattgatggcctgagcccctgggacccccctgtgctgatccagaagagaattcatggagtgctgtactacgtggagcacagagatgatgagctgtacatcctgaccaacgtgggggagcccacagagttcaagctgcccccctgggcctgtggcttcatcatggacaccaacagcgaccccaagaactgccccttccagctgtgcagccccatccggccccccaagtactacacctacaagtttgctgagggcaagctgtttgaggagactggacatgaggaccccatcaccaagaccagccgggtgctgcggctggaggccaagagcaaggatggcaagctggtgcccatgacagtgttccacaagacagacagcgaggacctgcagaagaagcccctgctggtgcacgtgtatggagcctacggcatggacctgaagatgaacttccggcctgagcggcgggtgctggtggatgatggctggatcctggcctactgccacgtgcggggcggcggggagctgggcctgcagtggcatgctgatggccgcctgaccaagaagctgaatggcctggccgacctggaggcctgcatcaagaccctgcacggccagggcttcagccagcccagcctgaccaccctgacagccttctctgctgggggcgtgctggccggggccctgtgcaacagcaaccctgagctggtgcgggctgtgaccctggaggcccccttcctggatgtgctgaacaccatgatggacaccaccctgcccctgaccctggaggagctggaggagtggggcaaccccagcagtgatgagaagcacaagaactacatcaagcgctactgcccctaccagaacatcaagccccagcactaccccagcatccacatcacagcctatgaaaatgatgagcgggtgcccctgaagggcatcgtgtcctacacagagaagctgaaggaggccatcgccgagcacgccaaggacacaggagagggctaccagacccccaacatcatcctggacatccagcccggcggcaaccacgtgattgaggacagccacaagaagatcacagcccagatcaagttcctgtatgaggagctgggcctggacagcacctctgtgtttgaggacctgaagaagtacctgaagttctag

SEQ ID NO: 165516 - DNA, 1986 bp, Artificial Sequence
  Description of Artificial Sequence: Synthetic coding sequence
atgcagcagaagaccaagctgttcctgcaggccctgaagtacagcatcccccacctgggcaagtgcatgcagaagcagcacctgaaccactacaactttgctgaccactgctacaaccgcatcaagctgaagaagtaccacctgaccaagtgcctgcagaacaagcccaagatcagcgagctggccaggaacatccccagccgctccttcagctgcaaggacctgcagcctgtgaagcaggagaatgagaagcccctgcctgagaacatggatgcctttgagaaggtgaggaccaagctggagacccagccccaggaggagtatgagatcatcaacgtggaggtgaagcatggaggctttgtgtactaccaggagggctgctgcctggtgcgcagcaaggatgaggaggccgacaatgacaactatgaggtgctcttcaacctggaggagctgaagctggaccagcccttcatcgactgcatccgggtggccccagatgagaagtatgtggccgccaagatcagaacagaagattctgaggccagcacctgtgtgatcatcaagctgagtgaccagcctgtgatggaggccagcttccccaacgtgagcagctttgagtgggtgaaggatgaggaggatgaagatgtgctcttctacaccttccagaggaacctgcgctgccatgatgtgtaccgggccacctttggagacaacaagagaaatgaacgcttctacacagagaaggaccccagctactttgtgttcctgtacctgaccaaggacagccgcttcctgaccatcaacatcatgaacaagaccaccagcgaggtgtggctgattgatggcctgagcccctgggacccccctgtgctgatccagaagagaattcatggagtgctgtactacgtggagcacagagatgatgagctgtacatcctgaccaacgtgggggagcccacagagttcaagctgatgaggacagctgctgacaccccagccatcatgaactgggacctcttcttcaccatgaagaggaacaccaaggtgattgacctggacatgttcaaggaccactgtgtgctcttcctgaagcacagcaacctgctgtatgtgaatgtcatcggcctggctgatgacagcgtgcgcagcctgaaggatggcaagctggtgcccatgacagtgttccacaagacagacagcgaggacctgcagaagaagcccctgctggtgcacgtgtatggagcctacggcatggacctgaagatgaacttccggcctgagcggcgggtgctggtggatgatggctggatcctggcctactgccacgtgcggggcggcggggagctgggcctgcagtggcatgctgatggccgcctgaccaagaagctgaatggcctggccgacctggaggcctgcatcaagaccctgcacggccagggcttcagccagcccagcctgaccaccctgacagccttctctgctgggggcgtgctggccggggccctgtgcaacagcaaccctgagctggtgcgggctgtgaccctggaggcccccttcctggatgtgctgaacaccatgatggacaccaccctgcccctgaccctggaggagctggaggagtggggcaaccccagcagtgatgagaagcacaagaactacatcaagcgctactgcccctaccagaacatcaagccccagcactaccccagcatccacatcacagcctatgaaaatgatgagcgggtgcccctgaagggcatcgtgtcctacacagagaagctgaaggaggccatcgccgagcacgccaaggacacaggagagggctaccagacccccaacatcatcctggacatccagcccggcggcaaccacgtgattgaggacagccacaagaagatcacagcccagatcaagttcctgtatgaggagctgggcctggacagcacctctgtgtttgaggacctgaagaagtacctgaagttctag

SEQ ID NO: 165517 - DNA, 2184 bp, Artificial Sequence; identical to SEQ ID NO: 165514
  Description of Artificial Sequence: Synthetic coding sequence

SEQ ID NO: 165518 - DNA, 2184 bp, Artificial Sequence; identical to SEQ ID NO: 165514
  Description of Artificial Sequence: Synthetic coding sequence

SEQ ID NO: 165519 - DNA, 2184 bp, Artificial Sequence; identical to SEQ ID NO: 165514
  Description of Artificial Sequence: Synthetic coding sequence

SEQ ID NO: 165520 - DNA, 2184 bp, Artificial Sequence; identical to SEQ ID NO: 165514
  Description of Artificial Sequence: Synthetic coding sequence

SEQ ID NO: 165521 - DNA, 2184 bp, Artificial Sequence; identical to SEQ ID NO: 165514
  Description of Artificial Sequence: Synthetic coding sequence

SEQ ID NO: 165522 - DNA, 456 bp, Artificial Sequence
  Description of Artificial Sequence: Synthetic coding sequence
atgcagcagaagaccaagctgttcctgcaggccctgaagtacagcatcccccacctgggcaagtgcatgcagaagcagcacctgaaccactacaactttgctgaccactgctacaaccgcatcaagctgaagaagtaccacctgaccaagtgcctgcagaacaagcccaagatcagcgagctggccaggaacatccccagccgctccttcagctgcaaggacctgcagcctgtgaagcaggagaatgagaagcccctgcctgagaacatggatgcctttgagaaggtgaggaccaagctggagacccagccccaggaggagtatgagatcatcaacgtggaggtgaagcatggaggctttgtgtactaccaggagggctgctgcctggtgcgcagcaaggatgaggaggccgacaatgacaactatgaggtgctcttcaacctggaggagctgtag

SEQ ID NO: 165523 - DNA, 1917 bp, Artificial Sequence
  Description of Artificial Sequence: Synthetic coding sequence
atggatgcctttgagaaggtgaggaccaagctggagacccagccccaggaggagtatgagatcatcaacgtggaggtgaagcacggcggctttgtgtactaccaggagggctgctgcctggtgcgcagcaaggatgaggaggccgacaatgacaactatgaggtgctcttcaacctggaggagctgaagctggaccagcccttcatcgactgcatccgggtggccccagatgagaagtatgtggccgccaagatcagaacagaggacagcgaggccagcacctgtgtgatcatcaagctgagtgaccagcctgtgatggaggccagcttccccaacgtgtcctcctttgagtgggtgaaggatgaagaagatgaagatgtgctcttctacaccttccagaggaacctgcgctgccatgatgtgtaccgggccaccttcggggacaacaagagaaatgaacgcttctacacagagaaggaccccagctactttgtgttcctgtacctgaccaaggacagccgcttcctgaccatcaacatcatgaacaagaccaccagcgaggtgtggctgattgatggcctgagcccctgggacccccctgtgctgatccagaagaggatccacggcgtgctgtactacgtggagcacagagatgatgagctgtacatcctgaccaacgtgggggagcccacagagttcaagctgatgaggacagctgctgacaccccagccatcatgaactgggacctcttcttcaccatgaagaggaacaccaaggtgattgacctggacatgttcaaggaccactgtgtgctcttcctgaagcacagcaacctgctgtatgtgaatgtgattggcctggctgatgattctgtgcgcagcctgaagctgcccccctgggcctgtggcttcatcatggacaccaacagcgaccccaagaactgccccttccagctgtgcagccccatccggccccccaagtactacacctacaagtttgctgagggcaagctgtttgaggagaccggccacgaggaccccatcaccaagaccagccgggtgctgcggctggaggccaagagcaaggatggcaagctggtgcccatgaccgtcttccacaagacagattctgaggacctgcagaagaagcccctgctggtgcacgtgtatggagcctacggcatggacctgaagatgaacttccggcctgagaggagagtgctggtggatgatggctggatcctggcctactgccacgtgcggggcggcggggagctgggcctgcagtggcacgcagatggccgcctgaccaagaagctgaatggcctggccgacctggaggcctgcatcaagaccctgcacggccagggcttcagccagcccagcctgaccaccctgacagccttctctgctggaggagtgctggccggggccctgtgcaacagcaaccctgagctggtgcgggctgtgaccctggaggcccccttcctggatgtgctgaacaccatgatggacaccaccctgcccctgaccctggaggagctggaggagtggggcaaccccagcagtgatgagaagcacaagaactacatcaagcgctactgcccctaccagaacatcaagccccagcactaccccagcatccacatcacagcctatgaaaatgatgagcgggtgcccctgaagggcatcgtgtcctacacagagaagctgaaggaggccatcgccgagcacgccaaggacaccggggagggctaccagacccccaacatcatcctggacatccagcccggcggcaaccacgtgattgaggacagccacaagaagatcacagcccagatcaagttcctgtatgaggagctgggcctggacagcacctctgtgtttgaggacctgaagaagtacctgaagttctag

SEQ ID NO: 165524 - DNA, 1491 bp, Artificial Sequence
  Description of Artificial Sequence: Synthetic coding sequence
atgggcagaagagccctgctgctgctgctgctgtccttcctggccccctgggccaccatcgccctgcggcctgccctgcgggccctgggcagcctgcacctgcccaccaaccccaccagcctgcctgctgtggccaagaactacagcgtgctgtacttccagcagaaggtggaccacttcggcttcaacacagtgaagaccttcaaccagcgctacctggtggccgacaagtactggaagaagaatggaggcagcatcctcttctacacaggaaatgaaggagacatcatctggttctgcaacaacacaggcttcatgtgggatgtggccgaggagctgaaggccatgctggtgtttgctgagcaccgctactatggagagagcctgccctttggagacaacagcttcaaggacagccgccacctgaacttcctgaccagcgagcaggccctggccgactttgctgagctgatcaagcacctgaagaggaccatccctggagctgagaaccagcccgtcatcgccatcggcggcagctatggaggcatgctggccgcctggttcaggatgaagtacccccacatggtggtgggcgccctggccgccagcgcccccatctggcagtttgaggacctggtgccctgtggggtcttcatgaagatcgtgaccacagacttcaggaagagcggcccccactgcagcgagagcatccaccgctcctgggatgccatcaaccggctgagcaacacaggcagcggcctgcagtggctgaccggggccctgcacctgtgcagccccctgaccagccaggacatccagcacctgaaggactggatcagcgagacctgggtgaacctggccatggtggactacccctatgccagcaacttcctgcagcccctgcctgcctggcccatcaaggtggtgtgccagtacctgaagaaccccaacgtgtctgacagcctgctgctgcagaacatcttccaggccctgaatgtgtactacaactacagcggccaggtgaagtgcctgaacatcagcgagacagccaccagcagcctgggcaccctgggctggagctaccaggcctgcacagaggtggtgatgcccttctgcaccaacggggtggatgacatgtttgagccccacagctggaacctgaaggagctgagtgatgactgcttccagcagtggggcgtgcggccccggcccagctggatcaccaccatgtatggaggcaagaacatcagcagccacaccaacatcgtgttcagcaatggagagctggacccctggagcggcggcggcgtgaccaaggacatcacagacaccctggtggccgtgaccatcagcgagggcgcccaccacctggacctgcggaccaagaatgccctggaccccatgtctgtgctgctggcccggagcctggaggtgcgccacatgaagaactggatccgggacttctatgattctgctgggaagcagcactag

SEQ ID NO: 165525 - DNA, 1554 bp, Artificial Sequence
  Description of Artificial Sequence: Synthetic coding sequence
atgggcagaagagccctgctgctgctgctgctgtccttcctggccccctgggccaccatcgccctgcggcctgccctgcgggccctgggcagcctgcacctgcccaccaaccccaccagcctgcctgctgtggccaagaactacagcgtgctgtacttccagcagaaggccctggccgccggccagctgcacatctgcatcatccagctgaaccactacaagacccccctggtggaccacttcggcttcaacacagtgaagaccttcaaccagcgctacctggtggccgacaagtactggaagaagaatggaggcagcatcctcttctacacaggaaatgaaggagacatcatctggttctgcaacaacacaggcttcatgtgggatgtggccgaggagctgaaggccatgctggtgtttgctgagcaccgctactacggggagagcctgccctttggagacaacagcttcaaggacagccgccacctgaacttcctgaccagcgagcaggccctggccgactttgctgagctgatcaagcacctgaagaggaccatccctggagctgagaaccagcctgtgattgccatcggcggcagctatggaggcatgctggccgcctggttcaggatgaagtacccccacatggtggtgggcgccctggccgccagcgcccccatctggcagtttgaggacctggtgccctgtggggtcttcatgaagatcgtgaccacagacttcaggaagagcggcccccactgcagcgagagcatccaccgctcctgggatgccatcaaccggctgagcaacacaggcagcggcctgcagtggctgactggagccctgcacctgtgcagccccctgaccagccaggacatccagcacctgaaggactggatcagcgagacctgggtgaacctggccatggtggactacccctatgccagcaacttcctgcagcccctgcctgcctggcccatcaaggtggtgtgccagtacctgaagaaccccaacgtgtctgacagcctgctgctgcagaacatcttccaggccctgaatgtgtactacaactacagcggccaggtgaagtgcctgaacatcagcgagacagccaccagcagcctgggcaccctgggctggagctaccaggcctgcacagaggtggtgatgcccttctgcaccaatggagtggatgacatgtttgagccccacagctggaacctgaaggagctgagtgatgactgcttccagcagtggggcgtgcggccccggcccagctggatcaccaccatgtatggaggcaagaacatcagcagccacaccaacatcgtgttcagcaatggagagctggacccctggagcggcggcggcgtgaccaaggacatcacagacaccctggtggccgtgaccatcagcgagggcgcccaccacctggacctgcggaccaagaatgccctggaccccatgtctgtgctgctggcccggagcctggaggtgcgccacatgaagaactggatccgggacttctatgacagcgctgggaagcagcactag

SEQ ID NO: 165526 - DNA, 1176 bp, Artificial Sequence
  Description of Artificial Sequence: Synthetic coding sequence
atgtgggatgtggccgaggagctgaaggccatgctggtgtttgctgagcaccgctactacggggagagcctgccctttggagacaacagcttcaaggacagccgccacctgaacttcctgaccagcgagcaggccctggccgactttgctgagctgatcaagcacctgaagaggaccatccctggagctgagaaccagcctgtgattgccatcggcggcagctatggaggcatgctggccgcctggttcaggatgaagtacccccacatggtggtgggcgccctggccgccagcgcccccatctggcagtttgaggacctggtgccctgtggggtcttcatgaagatcgtgaccacagacttcaggaagagcggcccccactgcagcgagagcatccaccgctcctgggatgccatcaaccggctgagcaacacaggcagcggcctgcagtggctgactggagccctgcacctgtgcagccccctgaccagccaggacatccagcacctgaaggactggatcagcgagacctgggtgaacctggccatggtggactacccctatgccagcaacttcctgcagcccctgcctgcctggcccatcaaggtggtgtgccagtacctgaagaaccccaacgtgtctgacagcctgctgctgcagaacatcttccaggccctgaatgtgtactacaactacagcggccaggtgaagtgcctgaacatcagcgagacagccaccagcagcctgggcaccctgggctggagctaccaggcctgcacagaggtggtgatgcccttctgcaccaatggagtggatgacatgtttgagccccacagctggaacctgaaggagctgagtgatgactgcttccagcagtggggcgtgcggccccggcccagctggatcaccaccatgtatggaggcaagaacatcagcagccacaccaacatcgtgttcagcaatggagagctggacccctggagcggcggcggcgtgaccaaggacatcacagacaccctggtggccgtgaccatcagcgagggcgcccaccacctggacctgcggaccaagaatgccctggaccccatgtctgtgctgctggcccggagcctggaggtgcgccacatgaagaactggatccgggacttctatgacagcgctgggaagcagcactag

SEQ ID NO: 165527 - DNA, 1428 bp, Artificial Sequence
  Description of Artificial Sequence: Synthetic coding sequence
atggagggcctgctgacccgctgccgggccctgcctgccctggccacctgcagccggcagctgagcggctacgtgccctgccgcttccaccactgtgccccccggcggggccggcggctgctgctgagcagggtcttccagccccagaacctgagagaagatagagtgctgagcctgcaggacaagagtgatgacctgacctgcaagagccagaggctgatgctgcaggtgggcctcatctacccagccagccctggctgctaccacctgctgccctacacagtgcgggccatggagaagctggtgcgggtgattgaccaggagatgcaggccatcggcggccagaaggtgaacatgcccagcctgagccctgctgagctgtggcaggccaccaaccgctgggacctgatgggcaaggagctgctgcggctgcgggacagacatggcaaggagtactgcctgggccccacccatgaggaggccatcacagccctgattgccagccagaagaagctgagctacaagcagctgcccttcctgctgtaccaggtgaccaggaagttcagagatgagccccggccccgcttcggcctgctgcggggccgggagttctacatgaaggacatgtacacctttgacagcagccctgaggccgcccagcagacctacagcctggtgtgtgatgcctactgcagcctcttcaacaagctgggcctgccctttgtgaaggtgcaggctgatgtgggcaccatcggcggcaccgtgtcccatgagttccagctgcctgtggacattggagaagatcggctggccatctgcccccgctgcagcttcagcgccaacatggagaccctggacctgagccagatgaactgcccagcctgccagggccccctgaccaagaccaagggcatcgaggtgggccacaccttctacctgggcaccaagtacagcagcatcttcaatgcccagttcaccaacgtgtgtgggaagcccaccctggccgagatgggctgctacggcctgggcgtgacccgcatcctggccgccgccatcgaggtgctgagcacagaggactgtgtgcgctggcccagcctgctggccccctaccaggcctgcctgatcccccccaagaagggcagcaaggagcaggccgccagcgagctgattggccagctgtatgaccacatcacagaggccgtgccccagctgcatggagaggtgctgctggatgacaggacccacctgaccatcggcaaccggctgaaggatgccaacaagtttggctaccccttcgtcatcatcgccggcaagagggccctggaggaccctgcccactttgaggtgtggtgccagaacacaggagaggtggccttcctgaccaaggatggagtgatggacctgctgacccctgtgcagacagtgtag

SEQ ID NO: 165528 - DNA, 498 bp, Artificial Sequence
  Description of Artificial Sequence: Synthetic coding sequence
atggccaagatgaacctgagcagctacatcctgatcctgaccttcagcctcttcagccagggcatcctgctgagcgccagcaagagcatccggaacctggatgatgacatggtgttcaacaccttccggctgggcaagggcttccagaaggaggacacagctgagaagtctgtgattgcccccagcctggagcagtacaagaatgatgagagcagcttcatgaatgaggaggagaacaaggtgtccaagaacacaggcagcaagcacaacttcctgaaccacggcctgcccctgaacctggccatcaagccctacctggccctgaagggctctgtggccttcccagcagaaaatggagtgcagaacacagagagcacccaggagaagcgggagattggagatgaggagaacagcgccaagttccccatcggcagaagagactttgacatgctgcgctgcatgctgggccgggtgtaccggccctgctggcaggtgtag

SEQ ID NO: 165529 - DNA, 2598 bp, Artificial Sequence
  Description of Artificial Sequence: Synthetic coding sequence
atggccctggtgctgggcagcctgctgctgctgggcctgtgtggcaacagcttcagcggcggccagcccagcagcacagatgcccccaaggcctggaactatgagctgcctgccaccaactatgagacccaggacagccacaaggccggccccatcggcatcctgtttgagctggtgcacatcttcctgtatgtggtgcagccccgggacttccctgaggacaccctgaggaagttcctgcagaaggcctatgagagcaagattgattatgacaagccagagaccgtcatcctgggcctgaagatcgtgtactatgaagctggcatcatcctgtgctgcgtgctgggcctgctcttcatcatcctgatgcccctggtgggctacttcttctgcatgtgccgctgctgcaacaagtgtggcggggagatgcaccagaggcagaaggaaaatggccccttcctgaggaagtgctttgccatcagcctgctggtgatctgcatcatcatcagcatcggcatcttctacggctttgtggccaaccaccaggtgaggacccgcatcaagaggagcaggaagctggccgacagcaacttcaaggacctgcggaccctgctgaatgagaccccagagcagatcaagtacatcctggcccagtacaacaccaccaaggacaaggccttcacagacctgaacagcatcaacagcgtgctgggcggcggcatcctggaccggctgcggcccaacatcatccctgtgctggatgagatcaagtccatggccacagccatcaaggagaccaaggaggccctggagaacatgaacagcaccctgaagagcctgcaccagcagagcacccagctgagcagcagcctgacctctgtgaagaccagcctgcggagcagcctgaatgaccccctgtgcctggtgcaccccagcagcgagacctgcaacagcatccggctgagcctgagccagctgaacagcaaccctgagctgcggcagctgccccctgtggatgctgagctggacaacgtgaacaacgtgctgaggacagacctggatggcctggtgcagcagggctaccagagcctgaatgacatcccagacagagtgcagaggcagaccaccaccgtggtggccggcatcaagagggtgctgaacagcattggaagtgacatcgacaacgtgacccagaggctgcccatccaggacatcctgagcgccttctctgtgtatgtgaacaacacagagagctacatccacaggaacctgcccaccctggaggagtatgacagctactggtggctgggcggcctggtgatctgcagcctgctgaccctcatcgtcatcttctactacctgggcctgctgtgtggggtgtgtggctatgacagacatgccacccccaccacccggggctgtgtgagcaacacaggaggagtcttcctgatggtgggcgtgggcctgtccttcctgttctgctggatcctgatgatcatcgtggtgctgacctttgtgtttggagccaacgtggagaagctgatctgtgagccctacaccagcaaggagctgttccgggtgctggacaccccctacctgctgaatgaagactgggagtactacctgagcggcaagctgttcaacaagagcaagatgaagctgacctttgagcaggtgtacagcgactgcaagaagaacagaggcacctacggcaccctgcacctgcagaacagcttcaacatcagcgagcacctgaacatcaatgagcacacaggcagcatcagcagcgagctggagagcctgaaggtgaacctgaacatcttcctgctgggcgctgctggcaggaagaacctgcaggactttgctgcctgtggcatcgacaggatgaactatgacagctacctggcccagacaggcaagagccctgctggggtgaacctgctgagctttgcctatgacctggaggccaaggccaacagcctgcccccaggcaacctgaggaacagcctgaagagagatgcccagaccatcaagaccatccaccagcagagggtgctgcccatcgagcagagcctgagcaccctgtaccagagcgtgaagatcctgcagaggactggaaatggcctgctggagcgggtgacccgcatcctggccagcctggactttgcccagaacttcatcaccaacaacaccagcagcgtcatcatcgaggagaccaagaagtatggccgcaccatcatcggctactttgagcactacctgcagtggattgagttcagcatcagcgagaaggtggccagctgcaagcctgtggccacagccctggacacagctgtggatgtgttcctgtgcagctacatcatcgaccccctgaacctcttctggtttggcatcggcaaggccaccgtcttcctgctgcctgccctgatctttgctgtgaagctggccaagtactacagaaggatggacagtgaagatgtgtatgatgatgtggagaccatccccatgaagaacatggagaatggaaacaacggctaccacaaggaccacgtgtatggcatccacaaccctgtgatgaccagccccagccagcactag

SEQ ID NO: 165530 - DNA, 2571 bp, Artificial Sequence
  Description of Artificial Sequence: Synthetic coding sequence
atggccctggtgctgggcagcctgctgctgctgggcctgtgtggcaacagcttcagcggcggccagcccagcagcacagatgcccccaaggcctggaactatgagctgcctgccaccaactatgagacccaggacagccacaaggccggccccatcggcatcctgtttgagctggtgcacatcttcctgtatgtggtgcagccccgggacttccctgaggacaccctgaggaagttcctgcagaaggcctatgagagcaagattgattatgacaagatcgtgtactatgaggccggcatcatcctgtgctgcgtgctgggcctgctcttcatcatcctgatgcccctggtgggctacttcttctgcatgtgccgctgctgcaacaagtgtggcggggagatgcaccagaggcagaaggaaaatggccccttcctgaggaaatgttttgccatcagcctgctggtgatctgcatcatcatcagcatcggcatcttctacggctttgtggccaaccaccaggtgaggacccgcatcaagaggagcaggaagctggccgacagcaacttcaaggacctgcggaccctgctgaatgagaccccagagcagatcaagtacatcctggcccagtacaacaccaccaaggacaaggccttcacagacctgaacagcatcaacagcgtgctgggcggcggcatcctggaccggctgcggcccaacatcatccctgtgctggatgagatcaagtccatggccacagccatcaaggagaccaaggaggccctggagaacatgaacagcaccctgaagagcctgcaccagcagagcacccagctgagcagcagcctgacctctgtgaagaccagcctgcggagcagcctgaatgaccccctgtgcctggtgcaccccagcagcgagacctgcaacagcatccggctgagcctgagccagctgaacagcaaccctgagctgcggcagctgccccctgtggatgctgagctggacaacgtgaacaacgtgctgaggacagacctggatggcctggtgcagcagggctaccagagcctgaatgacatcccagacagagtgcagaggcagaccaccaccgtggtggccggcatcaagagggtgctgaacagcatcggcagtgacatcgacaacgtgacccagaggctgcccatccaggacatcctgagcgccttctctgtgtatgtgaacaacacagagagctacatccacaggaacctgcccaccctggaggagtatgacagctactggtggctgggcggcctggtgatctgcagcctgctgaccctgattgtcatcttctactacctgggcctgctgtgtggggtgtgtggctatgacagacatgccacccccaccacccggggctgtgtgagcaacacaggaggagtcttcctgatggtgggcgtgggcctgtccttcctgttctgctggatcctgatgatcatcgtggtgctgacctttgtgtttggagccaacgtggagaagctgatctgtgagccctacaccagcaaggagctgttccgggtgctggacaccccctacctgctgaatgaagactgggagtactacctgagcggcaagctgttcaacaagagcaagatgaagctgacctttgagcaggtgtacagcgactgcaagaagaacagaggcacctacggcaccctgcacctgcagaacagcttcaacatcagcgagcacctgaacatcaatgagcacacaggcagcatcagcagcgagctggagagcctgaaggtgaacctgaacatcttcctgctgggcgccgccggcaggaagaacctgcaggactttgctgcctgtggcatcgacaggatgaactatgacagctacctggcccagacaggcaagagccctgctggggtgaacctgctgagctttgcctatgacctggaggccaaggccaacagcctgcccccaggcaacctgaggaacagcctgaagagagatgcccagaccatcaagaccatccaccagcagagggtgctgcccatcgagcagagcctgagcaccctgtaccagagcgtgaagatcctgcagaggactggaaatggcctgctggagcgggtgacccgcatcctggccagcctggactttgcccagaacttcatcaccaacaacaccagcagcgtcatcatcgaggagaccaagaagtatggccgcaccatcatcggctactttgagcactacctgcagtggattgagttcagcatcagcgagaaggtggccagctgcaagcctgtggccacagccctggacacagctgtggatgtgttcctgtgcagctacatcatcgaccccctgaacctcttctggtttggaattggcaaggccaccgtcttcctgctgcctgccctgatctttgctgtgaagctggccaagtactacagaaggatggattctgaagatgtgtatgatgatgtggagaccatccccatgaagaacatggagaatggaaataatggctaccacaaggaccacgtgtatggcatccacaaccctgtgatgaccagccccagccagcactag

SEQ ID NO: 165531 - DNA, 2571 bp, Artificial Sequence; identical to SEQ ID NO: 165530
  Description of Artificial Sequence: Synthetic coding sequence

SEQ ID NO: 165532 - DNA, 177 bp, Artificial Sequence
  Description of Artificial Sequence: Synthetic coding sequence
atggccctggtgctgggcagcctgctgctgctgggcctgtgtggcaacagcttcagcggcggccagcccagcagcacagatgcccccaaggcctggaactatgagctgcctgccaccaactatgagacccaggacagccacaaggccggccccatcggcatcctgtttgagctgtag

SEQ ID NO: 165533 - DNA, 123 bp, Artificial Sequence
  Description of Artificial Sequence: Synthetic coding sequence
atggccctggtgctgggcagcctgctgctgctgggcctgtgtggcaacagcttcagcggcggccagcccagcagcacagatgcccccaaggcctggaactatgagctgcctgccaccaactag

SEQ ID NO: 165534 - DNA, 2598 bp, Artificial Sequence; identical to SEQ ID NO: 165529
  Description of Artificial Sequence: Synthetic coding sequence

SEQ ID NO: 165535 - DNA, 45 bp, Artificial Sequence; identical to SEQ ID NO: 94739
  Description of Artificial Sequence: Synthetic coding sequence

SEQ ID NO: 165536 - DNA, 2505 bp, Artificial Sequence
  Description of Artificial Sequence: Synthetic coding sequence
atggccctggtgctgggcagcctgctgctgctgggcctgtgtggcaacagcttcagcggcggccagcccagcagcacagatgcccccaaggcctggaactatgagctgcctgccaccaactatgagacccaggacagccacaaggccggccccatcggcatcctgtttgagctggtgcacatcttcctgtatgtggtgcagccccgggacttccctgaggacaccctgaggaagttcctgcagaaggcctatgagagcaagattgattatgacaagccagagaccgtcatcctgggcctgaagatcgtgtactatgaagctggcatcatcctgtgctgcgtgctgggcctgctcttcatcatcctgatgcccctggtgggctacttcttctgcatgtgccgctgctgcaacaagtgtggcggggagatgcaccagaggcagaaggaaaatggccccttcctgaggaagtgctttgccatcagcctgctggtgatctgcatcatcatcagcatcggcatcttctacggctttgtggccaaccaccaggtgaggacccgcatcaagaggagcaggaagctggccgacagcaacttcaaggacctgcggaccctgctgaatgagaccccagagcagatcaagtacatcctggcccagtacaacaccaccaaggacaaggccttcacagacctgaacagcatcaacagcgtgctgggcggcggcatcctggaccggctgcggcccaacatcatccctgtgctggatgagatcaagtccatggccacagccatcaaggagaccaaggaggccctggagaacatgaacagcaccctgaagagcctgcaccagcagagcacccagctgagcagcagcctgacctctgtgaagaccagcctgcggagcagcctgaatgaccccctgtgcctggtgcaccccagcagcgagacctgcaacagcatccggctgagcctgagccagctgaacagcaaccctgagctgcggcagctgccccctgtggatgctgagctggacaacgtgaacaacgtgctgaggacagacctggatggcctggtgcagcagggctaccagagcctgaatgacatcccagacagagtgcagaggcagaccaccaccgtggtggccggcatcaagagggtgctgaacagcattggaagtgacatcgacaacgtgacccagaggctgcccatccaggacatcctgagcgccttctctgtgtatgtgaacaacacagagagctacatccacaggaacctgcccaccctggaggagtatgacagctactggtggctgggcggcctggtgatctgcagcctgctgaccctcatcgtcatcttctactacctgggcctgctgtgtggggtgtgtggctatgacagacatgccacccccaccacccggggctgtgtgagcaacacaggaggagtcttcctgatggtgggcgtgggcctgtccttcctgttctgctggatcctgatgatcatcgtggtgctgacctttgtgtttggagccaacgtggagaagctgatctgtgagccctacaccagcaaggagctgttccgggtgctggacaccccctacctgctgaatgaagactgggagtactacctgagcggcaagctgttcaacaagagcaagatgaagctgacctttgagcaggtgtacagcgactgcaagaagaacagaggcacctacggcaccctgcacctgcagaacagcttcaacatcagcgagcacctgaacatcaatgagcacacaggcagcatcagcagcgagctggagagcctgaaggtgaacctgaacatcttcctgctgggcgctgctggcaggaagaacctgcaggactttgctgcctgtggcatcgacaggatgaactatgacagctacctggcccagacaggcaagagccctgctggggtgaacctgctgagctttgcctatgacctggaggccaaggccaacagcctgcccccaggcaacctgaggaacagcctgaagagagatgcccagaccatcaagaccatccaccagcagagggtgctgcccatcgagcagagcctgagcaccctgtaccagagcgtgaagatcctgcagaggactggaaatggcctgctggagcgggtgacccgcatcctggccagcctggactttgcccagaacttcatcaccaacaacaccagcagcgtcatcatcgaggagaccaagaagtatggccgcaccatcatcggctactttgagcactacctgcagtggattgagttcagcatcagcgagaaggtggccagctgcaagcctgtggccacagccctggacacagctgtggatgtgttcctgtgcagctacatcatcgaccccctgaacctcttctggtttggcatcggcaaggccaccgtcttcctgctgcctgccctgatctttgctgtgaagctggccaagtactacagaaggatggacagtgaagatgtgtatgatgaccccagccagcactag

SEQ ID NO: 165537 - DNA, 2529 bp, Artificial Sequence
  Description of Artificial Sequence: Synthetic coding sequence
atggccctggtgctgggcagcctgctgctgctgggcctgtgtggcaacagcttcagcggcggccagcccagcagcacagatgcccccaaggcctggaactatgagctgcctgccaccaactatgagacccaggacagccacaaggccggccccatcggcatcctgtttgagctggtgcacatcttcctgtatgtggtgcagccccgggacttccctgaggacaccctgaggaagttcctgcagaaggcctatgagagcaagattgattatgacaagccagagaccgtcatcctgggcctgaagatcgtgtactatgaagctggcatcatcctgtgctgcgtgctgggcctgctcttcatcatcctgatgcccctggtgggctacttcttctgcatgtgccgctgctgcaacaagtgtggcggggagatgcaccagaggcagaaggaaaatggccccttcctgaggaagtgctttgccatcagcctgctggtgatctgcatcatcatcagcatcggcatcttctacggctttgtggccaaccaccaggtgaggacccgcatcaagaggagcaggaagctggccgacagcaacttcaaggacctgcggaccctgctgaatgagaccccagagcagatcaagtacatcctggcccagtacaacaccaccaaggacaaggccttcacagacctgaacagcatcaacagcgtgctgggcggcggcatcctggaccggctgcggcccaacatcatccctgtgctggatgagatcaagtccatggccacagccatcaaggagaccaaggaggccctggagaacatgaacagcaccctgaagagcctgcaccagcagagcacccagctgagcagcagcctgacctctgtgaagaccagcctgcggagcagcctgaatgaccccctgtgcctggtgcaccccagcagcgagacctgcaacagcatccggctgagcctgagccagctgaacagcaaccctgagctgcggcagctgccccctgtggatgctgagctggacaacgtgaacaacgtgctgaggacagacctggatggcctggtgcagcagggctaccagagcctgaatgacatcccagacagagtgcagaggcagaccaccaccgtggtggccggcatcaagagggtgctgaacagcattggaagtgacatcgacaacgtgacccagaggctgcccatccaggacatcctgagcgccttctctgtgtatgtgaacaacacagagagctacatccacaggaacctgcccaccctggaggagtatgacagctactggtggctgggcggcctggtgatctgcagcctgctgaccctcatcgtcatcttctactacctgggcctgctgtgtggggtgtgtggctatgacagacatgccacccccaccacccggggctgtgtgagcaacacaggaggagtcttcctgatggtgggcgtgggcctgtccttcctgttctgctggatcctgatgatcatcgtggtgctgacctttgtgtttggagccaacgtggagaagctgatctgtgagccctacaccagcaaggagctgttccgggtgctggacaccccctacctgctgaatgaagactgggagtactacctgagcggcaagctgttcaacaagagcaagatgaagctgacctttgagcaggtgtacagcgactgcaagaagaacagaggcacctacggcaccctgcacctgcagaacagcttcaacatcagcgagcacctgaacatcaatgagcacacaggcagcatcagcagcgagctggagagcctgaaggtgaacctgaacatcttcctgctgggcgctgctggcaggaagaacctgcaggactttgctgcctgtggcatcgacaggatgaactatgacagctacctggcccagacaggcaagagccctgctggggtgaacctgctgagctttgcctatgacctggaggccaaggccaacagcctgcccccaggcaacctgaggaacagcctgaagagagatgcccagaccatcaagaccatccaccagcagagggtgctgcccatcgagcagagcctgagcaccctgtaccagagcgtgaagatcctgcagaggactggaaatggcctgctggagcgggtgacccgcatcctggccagcctggactttgcccagaacttcatcaccaacaacaccagcagcgtcatcatcgaggagaccaagaagtatggccgcaccatcatcggctactttgagcactacctgcagtggattgagttcagcatcagcgagaaggtggccagctgcaagcctgtggccacagccctggacacagctgtggatgtgttcctgtgcagctacatcatcgaccccctgaacctcttctggtttggcatcggcaaggccaccgtcttcctgctgcctgccctgatctttgctgtgaagctggccaagtactacagaaggatggacagtgaagatgtgtatgatgatgtggagaccatccccatgaagaaccccagccagcactag

SEQ ID NO: 165538 - DNA, 2493 bp, Artificial Sequence
  Description of Artificial Sequence: Synthetic coding sequence
atggccctggtgctgggcagcctgctgctgctgggcctgtgtggcaacagcttcagcggcggccagcccagcagcacagatgcccccaaggcctggaactatgagctgcctgccaccaactatgagacccaggacagccacaaggccggccccatcggcatcctgtttgagctggtgcacatcttcctgtatgtggtgcagccccgggacttccctgaggacaccctgaggaagttcctgcagaaggcctatgagagcaagattgattatgacaagatcgtgtactatgaggccggcatcatcctgtgctgcgtgctgggcctgctcttcatcatcctgatgcccctggtgggctacttcttctgcatgtgccgctgctgcaacaagtgtggcggggagatgcaccagaggcagaaggaaaatggccccttcctgaggaaatgttttgccatcagcctgctggtgatctgcatcatcatcagcatcggcatcttctacggctttgtggccaaccaccaggtgaggacccgcatcaagaggagcaggaagctggccgacagcaacttcaaggacctgcggaccctgctgaatgagaccccagagcagatcaagtacatcctggcccagtacaacaccaccaaggacaaggccttcacagacctgaacagcatcaacagcgtgctgggcggcggcatcctggaccggctgcggcccaacatcatccctgtgctggatgagatcaagtccatggccacagccatcaaggagaccaaggaggccctggagaacatgaacagcaccctgaagagcctgcaccagcagagcacccagctgagcagcagcctgacctctgtgaagaccagcctgcggagcagcctgaatgaccccctgtgcctggtgcaccccagcagcgagacctgcaacagcatccggctgagcctgagccagctgaacagcaaccctgagctgcggcagctgccccctgtggatgctgagctggacaacgtgaacaacgtgctgaggacagacctggatggcctggtgcagcagggctaccagagcctgaatgacatcccagacagagtgcagaggcagaccaccaccgtggtggccggcatcaagagggtgctgaacagcatcggcagtgacatcgacaacgtgacccagaggctgcccatccaggacatcctgagcgccttctctgtgtatgtgaacaacacagagagctacatccacaggaacctgcccaccctggaggagtatgacagctactggtggctgggcggcctggtgatctgcagcctgctgaccctgattgtcatcttctactacctgggcctgctgtgtggggtgtgtggctatgacagacatgccacccccaccacccggggctgtgtgagcaacacaggaggagtcttcctgatggtgggcgtgggcctgtccttcctgttctgctggatcctgatgatcatcgtggtgctgacctttgtgtttggagccaacgtggagaagctgatctgtgagccctacaccagcaaggagctgttccgggtgctggacaccccctacctgctgaatgaagactgggagtactacctgagcggcaagctgttcaacaagagcaagatgaagctgacctttgagcaggtgtacagcgactgcaagaagaacagaggcacctacggcaccctgcacctgcagaacagcttcaacatcagcgagcacctgaacatcaatgagcacacaggcagcatcagcagcgagctggagagcctgaaggtgaacctgaacatcttcctgctgggcgccgccggcaggaagaacctgcaggactttgctgcctgtggcatcgacaggatgaactatgacagctacctggcccagacaggcaagagccctgctggggtgaacctgctgagctttgcctatgacctggaggccaaggccaacagcctgcccccaggcaacctgaggaacagcctgaagagagatgcccagaccatcaagaccatccaccagcagagggtgctgcccatcgagcagagcctgagcaccctgtaccagagcgtgaagatcctgcagaggactggaaatggcctgctggagcgggtgacccgcatcctggccagcctggactttgcccagaacttcatcaccaacaacaccagcagcgtcatcatcgaggagaccaagaagtatggccgcaccatcatcggctactttgagcactacctgcagtggattgagttcagcatcagcgagaaggtggccagctgcaagcctgtggccacagccctggacacagctgtggatgtgttcctgtgcagctacatcatcgaccccctgaacctcttctggtttggaattggcaaggccaccgtcttcctgctgcctgccctgatctttgctgtgaagctggccaagtactacagaaggatggattctgaagatgtgtatgatgacagctcctgggtgacctctgtgcagtgctag

SEQ ID NO: 165539 - DNA, 681 bp, Artificial Sequence
  Description of Artificial Sequence: Synthetic coding sequence
atggaggccgagcggcggcggcaggccgagaagcccaagaagggccgggtgggcagcaacctgctgcctgagcggcacccagccaccggcacccccaccaccaccgtggacagcagcgccccaccctgccggcggctgcctggagctgggggcggccgcagccgcttcagcccccagggcggccagaggggccggccccacagcagaagaagacacaggaccaccttcagccctgtgcagctggagcagctggagagcgccttcggcaggaaccagtacccagacatctgggcccgggagagcctggcccgggacaccggcctgtctgaggcccgcatccaggtgtggttccagaacagaagagccaagcagaggaagcaggagaggagcctgctgcagcccctggcccacctgagccctgctgccttcagcagcttcctgcctgagagcacagcctgcccctacagctatgctgcccctcctcctcctgtgacctgcttcccccacccctacagccacgccctgcccagccagcccagcactggaggagcctttgccctgagccaccagagcgaggactggtaccccaccctgcacccagccccagctggccacctgccctgccccccacctccacccatgctgcccctgagcctggagcccagcaagtcctggaactag

SEQ ID NO: 165540 - DNA, 417 bp, Artificial Sequence
  Description of Artificial Sequence: Synthetic coding sequence
aacatcagcctgtgcccagagatctgcttccagaagattgagagccaggtgtactttgtgcgggtggacagcggcatccagcccggcagtgacatcagcatctactatgaccccatgatcagcaagctgatcacctacggcagtgacagaacagaggccctgaagaggatggctgatgccctggacaactacgtgatccggggcgtgacccacaacatcgccctgctgcgggaggtgatcatcaacagcagatttgtgaagggggacatcagcaccaagttcctgagtgatgtgtacccagatggcttcaagggccacatgctgaccaagtctgagaagaaccagctgctggccatcgccagcagcctgtttgtggccttccagctgcgggcccagcacttccaggagaacagctag

SEQ ID NO: 165541 - DNA, 363 bp, Artificial Sequence
  Description of Artificial Sequence: Synthetic coding sequence
atgagcatccagttcctgggcaccgtgtacaaggtgaacatcctgacccggctggccgctgagctgaacaagttcatgctggagaaggtgacagaggacaccagctctgtgctgcggagccccatgcctggggtggtggtggccgtgtctgtgaagccaggagatgctgccaccagcagcctgtctgtggagatctgcctcttctggaccttccaggtggccgagggccaggagatctgtgtgattgaggccatgaagatgcagaacagcatgacagctgggaagacaggcaccgtgaagtctgtgcactgccaggccggggacacagtgggggagggggacctgctggtggagctggagtag

SEQ ID NO: 165542 - DNA, 2046 bp, Artificial Sequence
  Description of Artificial Sequence: Synthetic coding sequence
atggccggcttctgggtgggcacagcccccctggtggccgccggccggcggggccgctggccaccccagcagctgatgctgtctgctgccctgcggaccctgaagcacgtgctgtactacagccggcagtgcctgatggtgtccaggaacctgggctctgtgggctatgaccccaatgagaagacctttgacaagatcctggtggccaacagaggagagatcgcctgcagggtcatccgcacctgcaagaagatgggcatcaagacagtggccatccacagtgatgtggatgccagctctgtgcacgtgaagatggctgatgaagctgtgtgtgtgggccctgcccccaccagcaagagctacctgaacatggatgccatcatggaggccatcaagaagacccgggcccaggccgtgcaccctggctacggcttcctgtctgagaacaaggagtttgcccgctgcctggccgcagaagatgtggtgttcatcggccctgacacccacgccatccaggccatgggagacaagattgagagcaagctgctggccaagaaggccgaggtgaacaccatccctggctttgatggagtggtgaaggatgctgaggaggccgtgcgcatcgcccgggagatcggctaccctgtgatgatcaaggccagcgctgggggcggcggcaagggcatgagaattgcctgggatgatgaggagaccagagatggcttccggctgagcagccaggaggccgccagcagctttggagatgaccggctgctgattgagaagttcatcgacaaccccaggcacatcgagatccaggtgctgggggacaagcatggaaatgccctgtggctgaatgaaagagaatgttccatccagaggaggaaccagaaggtggtggaggaggcccccagcatcttcctggatgctgagacccggcgggccatgggagagcaggccgtggccctggcccgggctgtgaagtacagcagcgctggcaccgtggagttcctggtggacagcaagaagaacttctacttcctggagatgaacacccggctgcaggtggagcaccctgtgacagagtgcatcaccggcctggacctggtgcaggagatgatccgggtggccaagggctaccccctgcggcacaagcaggccgacatccgcatcaatggctgggccgtggagtgccgggtgtatgcagaggacccctacaagagctttggcctgcccagcatcggccgcctgagccagtaccaggagcccctgcacctgcccggggtgcgggtggacagcggcatccagcccggcagtgacatcagcatctactatgaccccatgatcagcaagctgatcacctacggcagtgacagaacagaggccctgaagaggatggctgatgccctggacaactacgtgatccggggcgtgacccacaacatcgccctgctgcgggaggtgatcatcaacagcagatttgtgaagggggacatcagcaccaagttcctgagtgatgtgtacccagatggcttcaagggccacatgctgaccaagtctgagaagaaccagctgctggccatcgccagcagcctgtttgtggccttccagctgcgggcccagcacttccaggagaacagcaggatgcctgtgatcaagccagacatcgccaactgggagctgtctgtgaagctgcatgacaaggtgcacacagtggtggccagcaacaatggatctgtgttttctgtggaggtggatggcagcaagctgaatgtgaccagcacctggaacctggccagccccctgctgtctgtgtctgtggatggcacccagaggacagtgcagtgcctgagccgggaggccggcggcaacatgagcatccagttcctgggcaccgtggtggccgagggccaggagatctgtgtgattgaggccatgaagatgcagaacagcatgacagctgggaagacaggaacagtgaagtctgtgcactgccaggccggggacacagtgggggagggggacctgctggtggagctggagtag

SEQ ID NO: 165543 - DNA, 2187 bp, Artificial Sequence
  Description of Artificial Sequence: Synthetic coding sequence
atggccggcttctgggtgggcacagcccccctggtggccgccggccggcggggccgctggccaccccagcagctgatgctgtctgctgccctgcggaccctgaagcacgtgctgtactacagccggcagtgcctgatggtgtccaggaacctgggctctgtgggctatgaccccaatgagaagacctttgacaagatcctggtggccaacagaggagagatcgcctgcagggtcatccgcacctgcaagaagatgggcatcaagacagtggccatccacagtgatgtggatgccagctctgtgcacgtgaagatggctgatgaagctgtgtgtgtgggccctgcccccaccagcaagagctacctgaacatggatgccatcatggaggccatcaagaagacccgggcccaggccgtgcaccctggctacggcttcctgtctgagaacaaggagtttgcccgctgcctggccgcagaagatgtggtgttcatcggccctgacacccacgccatccaggccatgggagacaagattgagagcaagctgctggccaagaaggccgaggtgaacaccatccctggctttgatggagtggtgaaggatgctgaggaggccgtgcgcatcgcccgggagatcggctaccctgtgatgatcaaggccagcgctgggggcggcggcaagggcatgagaattgcctgggatgatgaggagaccagagatggcttccggctgagcagccaggaggccgccagcagctttggagatgaccggctgctgattgagaagttcatcgacaaccccaggcacatcgagatccaggtgctgggggacaagcatggaaatgccctgtggctgaatgaaagagaatgttccatccagaggaggaaccagaaggtggtggaggaggcccccagcatcttcctggatgctgagacccggcgggccatgggagagcaggccgtggccctggcccgggctgtgaagtacagcagcgctggcaccgtggagttcctggtggacagcaagaagaacttctacttcctggagatgaacacccggctgcaggtggagcaccctgtgacagagtgcatcaccggcctggacctggtgcaggagatgatccgggtggccaagggctaccccctgcggcacaagcaggccgacatccgcatcaatggctgggccgtggagtgccgggtgtatgcagaggacccctacaagagctttggcctgcccagcatcggccgcctgagccagtaccaggagcccctgcacctgcccggggtgcgggtggacagcggcatccagcccggcagtgacatcagcatctactatgaccccatgatcagcaagctgatcacctacggcagtgacagaacagaggccctgaagaggatggctgatgccctggacaactacgtgatccggggcgtgacccacaacatcgccctgctgcgggaggtgatcatcaacagcagatttgtgaagggggacatcagcaccaagttcctgagtgatgtgtacccagatggcttcaagggccacatgctgaccaagtctgagaagaaccagctgctggccatcgccagcagcctgtttgtggccttccagctgcgggcccagcacttccaggagaacagcaggatgcctgtgatcaagccagacatcgccaactgggagctgtctgtgaagctgcatgacaaggtgcacacagtggtggccagcaacaatggatctgtgttttctgtggaggtggatggcagcaagctgaatgtgaccagcacctggaacctggccagccccctgctgtctgtgtctgtggatggcacccagaggacagtgcagtgcctgagccgggaggccggcggcaacatgagcatccagttcctgggcaccgtgtacaaggtgaacatcctgacccggctggccgctgagctgaacaagttcatgctggagaaggtgacagaggacaccagctctgtgctgcggagccccatgcctggggtggtggtggccgtgtctgtgaagccaggagatgctgtggccgagggccaggagatctgtgtgattgaggccatgaagatgcagaacagcatgacagctgggaagacaggcaccgtgaagtctgtgcactgccaggccggggacacagtgggggagggggacctgctggtggagctggagtag

SEQ ID NO: 165544 - DNA, 2109 bp, Artificial Sequence
  Description of Artificial Sequence: Synthetic coding sequence
atggccggcttctgggtgggcacagcccccctggtggccgccggccggcggggccgctggccaccccagcagctgatgctgtctgctgccctgcggaccctgaagacctttgacaagatcctggtggccaacagaggagagatcgcctgcagggtcatccgcacctgcaagaagatgggcatcaagacagtggccatccacagtgatgtggatgccagctctgtgcacgtgaagatggctgatgaagctgtgtgtgtgggccctgcccccaccagcaagagctacctgaacatggatgccatcatggaggccatcaagaagacccgggcccaggccgtgcaccctggctacggcttcctgtctgagaacaaggagtttgcccgctgcctggccgcagaagatgtggtgttcatcggccctgacacccacgccatccaggccatgggagacaagattgagagcaagctgctggccaagaaggccgaggtgaacaccatccctggctttgatggagtggtgaaggatgctgaggaggccgtgcgcatcgcccgggagatcggctaccctgtgatgatcaaggccagcgctgggggcggcggcaagggcatgagaattgcctgggatgatgaggagaccagagatggcttccggctgagcagccaggaggccgccagcagctttggagatgaccggctgctgattgagaagttcatcgacaaccccaggcacatcgagatccaggtgctgggggacaagcatggaaatgccctgtggctgaatgaaagagaatgttccatccagaggaggaaccagaaggtggtggaggaggcccccagcatcttcctggatgctgagacccggcgggccatgggagagcaggccgtggccctggcccgggctgtgaagtacagcagcgctggcaccgtggagttcctggtggacagcaagaagaacttctacttcctggagatgaacacccggctgcaggtggagcaccctgtgacagagtgcatcaccggcctggacctggtgcaggagatgatccgggtggccaagggctaccccctgcggcacaagcaggccgacatccgcatcaatggctgggccgtggagtgccgggtgtatgcagaggacccctacaagagctttggcctgcccagcatcggccgcctgagccagtaccaggagcccctgcacctgcccggggtgcgggtggacagcggcatccagcccggcagtgacatcagcatctactatgaccccatgatcagcaagctgatcacctacggcagtgacagaacagaggccctgaagaggatggctgatgccctggacaactacgtgatccggggcgtgacccacaacatcgccctgctgcgggaggtgatcatcaacagcagatttgtgaagggggacatcagcaccaagttcctgagtgatgtgtacccagatggcttcaagggccacatgctgaccaagtctgagaagaaccagctgctggccatcgccagcagcctgtttgtggccttccagctgcgggcccagcacttccaggagaacagcaggatgcctgtgatcaagccagacatcgccaactgggagctgtctgtgaagctgcatgacaaggtgcacacagtggtggccagcaacaatggatctgtgttttctgtggaggtggatggcagcaagctgaatgtgaccagcacctggaacctggccagccccctgctgtctgtgtctgtggatggcacccagaggacagtgcagtgcctgagccgggaggccggcggcaacatgagcatccagttcctgggcaccgtgtacaaggtgaacatcctgacccggctggccgctgagctgaacaagttcatgctggagaaggtgacagaggacaccagctctgtgctgcggagccccatgcctggggtggtggtggccgtgtctgtgaagccaggagatgctgtggccgagggccaggagatctgtgtgattgaggccatgaagatgcagaacagcatgacagctgggaagacaggcaccgtgaagtctgtgcactgccaggccggggacacagtgggggagggggacctgctggtggagctggagtag

SEQ ID NO: 165545 - DNA, 255 bp, Artificial Sequence
  Description of Artificial Sequence: Synthetic coding sequence
tgaaactgggagctgtctgtgaagctgcatgacaaggtgcacacagtggtggccagcaacaatggatctgtgttttctgtggaggtggatggcagcaagctgaatgtgaccagcacctggaacctggccagccccctgctgtctgtgtctgtggatggcacccagaggacagtgcagtgcctgagccgggaggccggcggcaacatgagcatccagttcctgggcaccgtgccctggaggaagctgctggactag

SEQ ID NO: 165546 - DNA, 336 bp, Artificial Sequence
  Description of Artificial Sequence: Synthetic coding sequence
tacaaggtgaacatcctgacccggctggccgctgagctgaacaagttcatgctggagaaggtgacagaggacaccagctctgtgctgcggagccccatgcctggggtggtggtggccgtgtctgtgaagccaggagatgctgccaccagcagcctgtctgtggagatctgcctcttctggaccttccaggtggccgagggccaggagatctgtgtgattgaggccatgaagatgcagaacagcatgacagctgggaagacaggaacagtgaagtctgtgcactgccaggccggggacacagtgggggagggggacctgctggtggagctggagtag

SEQ ID NO: 165547 - DNA, 405 bp, Artificial Sequence
  Description of Artificial Sequence: Synthetic coding sequence
tgaatgcctgtgatcaagccagacatcgccaactgggagctgtctgtgaagctgcatgacaaggtgcacacagtggtggccagcaacaacggcagcgtcttctctgtggaggtggatggcagcaagctgaatgtgaccagcacctggaacctggccagccccctgctgtctgtgtctgtggatggcacccagaggacagtgcagtgcctgagccgggaggccggcggcaacatgagcatccagttcctgggcaccgtggtggccgagggccaggagatctgtgtgattgaggccatgaagatgcagaacagcatgacagctgggaagacaggcaccgtgaagtctgtgcactgccaggccggggacacagtgggggagggggacctgctggtggagctggagtag

SEQ ID NO: 165548 - DNA, 309 bp, Artificial Sequence
  Description of Artificial Sequence: Synthetic coding sequence
agtgatgtgtacccagatggcttcaagggccacatgctgaccaagtctgagaagaaccagctgctggccatcgccagcagcctgtttgtggccttccagctgcgggcccagcacttccaggagaacagcaggatgcctgtgatcaagccagacatcgccaactgggagctgtctgtgaagctgcatgacaaggtgcacacagtggtggccagcaacaatggatctgtgttttctgtggaggtggatggcagcaagctgaatgtgaccagcacctggaacctgtttgccctgattgtgtgccagaggtag

SEQ ID NO: 165549 - DNA, 1620 bp, Artificial Sequence
  Description of Artificial Sequence: Synthetic coding sequence
atggctgctgccctgcgggtggccgctgtgggcgcccggctgtctgtgctggccagcggcctgcgggctgctgtgcgcagcctgtgcagccaggccacctctgtgaatgaaagaattgagaacaagagaagaacagccctgctgggcggcggccagaggagaattgatgcccagcacaagaggggcaagctgacagcccgggagcgcatcagcctgctgctggaccccggcagctttgtggagagtgacatgtttgtggagcaccgctgtgccgactttggcatggctgctgacaagaacaagtttcctggggacagcgtggtgacaggccggggccgcatcaatggccgcctggtgtatgtgttcagccaggacttcaccgtgtttggaggcagcctgagcggggcccacgcccagaagatctgcaagatcatggaccaggccatcaccgtgggcgcccctgtgattggcctgaatgattctggaggagcccgcatccaggagggcgtggagagcctggccggctatgctgacatcttcctgagaaatgtgacagccagcggggtcatcccccagatcagcctcatcatgggcccctgtgccggcggcgctgtgtacagccctgccctgacagacttcaccttcatggtgaaggacaccagctacctgttcatcaccggcccagatgtggtgaagtctgtgaccaatgaagatgtgacccaggaggagctgggcggggccaagacccacaccaccatgtctggagtggcccaccgggcctttgaaaatgatgtggatgccctgtgcaacctgcgggacttcttcaactacctgcccctgagcagccaggaccctgcccctgtgcgggagtgccacgaccccagcgaccggctggtgcctgagctggacaccatcgtgcccctggagagcaccaaggcctacaacatggtggacatcatccacagcgtggtggatgagcgggagttctttgagatcatgcccaactatgccaagaacatcatcgtgggctttgccaggatgaatggccgcacagtgggcatcgtgggcaaccagcccaaggtggccagcggctgcctggacatcaacagctctgtgaagggggccaggtttgtgcgcttctgtgatgccttcaacatccccctcatcacctttgtggatgtgcccggcttcctgcctggaacagcccaggagtatggaggcatcatcagacatggagccaagctgctgtatgcctttgctgaggccaccgtgcccaaggtgaccgtcatcaccaggaaggcctatggaggagcctatgatgtgatgagcagcaagcacctgtgtggggacaccaactatgcctggcccacagctgagattgctgtgatgggcgccaagggagctgtggagatcatcttcaagggccatgaaaatgtggaggccgcccaggccgagtacatcgagaagtttgccaaccccttccctgctgctgtgcggggctttgtggatgacatcatccagcccagcagcacccgggcccgcatctgctgtgacctggatgtgctggccagcaagaaggtgcagaggccctggaggaagcacgccaacatccccctgtag

SEQ ID NO: 165550 - DNA, 1680 bp, Artificial Sequence
  Description of Artificial Sequence: Synthetic coding sequence
atggctgctgccctgcgggtggccgctgtgggcgcccggctgtctgtgctggccagcggcctgcgggctgctgtgcgcagcctgtgcagccaggccacctctgtgaatgaaagaattgagaacaagagaagaacagccctgctgggcggcggccagaggagaattgatgcccagcacaagaggggcaagctgacagcccgggagcgcatcagcctgctgctggaccccggcagctttgtggagagtgacatgtttgtggagcaccgctgtgccgactttggcatggctgctgacaagaacaagtttcctggggacagcgtggtgacaggccggggccgcatcaatggccgcctggtgtatgtgttcagccagcagatcatcggctgggcccagtggctgcccctggtgatcagcgccctgtgggaggccgaggacttcaccgtgtttggaggcagcctgagcggggcccacgcccagaagatctgcaagatcatggaccaggccatcaccgtgggcgcccctgtgattggcctgaatgattctggaggagcccgcatccaggagggcgtggagagcctggccggctatgctgacatcttcctgagaaatgtgacagccagcggggtcatcccccagatcagcctcatcatgggcccctgtgccggcggcgctgtgtacagccctgccctgacagacttcaccttcatggtgaaggacaccagctacctgttcatcaccggcccagatgtggtgaagtctgtgaccaatgaagatgtgacccaggaggagctgggcggggccaagacccacaccaccatgtctggagtggcccaccgggcctttgaaaatgatgtggatgccctgtgcaacctgcgggacttcttcaactacctgcccctgagcagccaggaccctgcccctgtgcgggagtgccacgaccccagcgaccggctggtgcctgagctggacaccatcgtgcccctggagagcaccaaggcctacaacatggtggacatcatccacagcgtggtggatgagcgggagttctttgagatcatgcccaactatgccaagaacatcatcgtgggctttgccaggatgaatggccgcacagtgggcatcgtgggcaaccagcccaaggtggccagcggctgcctggacatcaacagctctgtgaagggggccaggtttgtgcgcttctgtgatgccttcaacatccccctcatcacctttgtggatgtgcccggcttcctgcctggaacagcccaggagtatggaggcatcatcagacatggagccaagctgctgtatgcctttgctgaggccaccgtgcccaaggtgaccgtcatcaccaggaaggcctatggaggagcctatgatgtgatgagcagcaagcacctgtgtggggacaccaactatgcctggcccacagctgagattgctgtgatgggcgccaagggagctgtggagatcatcttcaagggccatgaaaatgtggaggccgcccaggccgagtacatcgagaagtttgccaaccccttccctgctgctgtgcggggctttgtggatgacatcatccagcccagcagcacccgggcccgcatctgctgtgacctggatgtgctggccagcaagaaggtgcagaggccctggaggaagcacgccaacatccccctgtag

SEQ ID NO: 165551 - DNA, 1653 bp, Artificial Sequence
  Description of Artificial Sequence: Synthetic coding sequence
atggctgctgccctgcgggtggccgctgtgggcgcccggctgtctgtgctggccagcggcctgcgggctgctgtgcgcagcctgtgcagccaggccacctctgtgaatgaaagaattgagaacaagagaagaacagccctgctgggcggcggccagaggagaattgatgcccagcacaagaggggcaagctgacagcccgggagcgcatcagcctgctgctggaccccggcagctttgtggagagtgacatgtttgtggagcaccgctgtgccgactttggcatggctgctgacaagaacaagtttcctggggacagcgtggtgacaggccggggccgcatcaatggccgcctggtgtatgtgttcagccaggacttcaccgtgtttggaggcagcctgagcggggcccacgcccagaagatctgcaagatcatggaccaggccatcaccgtgggcgcccctgtgattggcctgaatgattctggaggagcccgcatccaggagggcgtggagagcctggccggctatgctgacatcttcctgagaaatgtgacagccagcggggtcatcccccagatcagcctcatcatgggcccctgtgccggcggcgctgtgtacagccctgccctgacagacttcaccttcatggtgaaggacaccagctacctgttcatcaccggcccagatgtggtgaagtctgtgaccaatgaagatgtgacccaggaggagctgggcggggccaagacccacaccaccatgtctggagtggcccaccgggcctttgaaaatgatgtggatgccctgtgcaacctgcgggacttcttcaactacctgcccctgagcagccaggaccctgcccctgtgcgggagtgccacgaccccagcgaccggctggtgcctgagctggacaccatcgtgcccctggagagcaccaaggcctacaacatggtggacatcatccacagcgtggtggatgagcgggagttctttgagatcatgcccaactatgccaagaacatcatcgtgggctttgccaggatgaatggccgcacagtgggcatcgtgggcaaccagcccaaggtggccagcggctgcctggacatcaacagctctgtgaagggggccaggtttgtgcgcttctgtgatgccttcaacatccccctcatcacctttgtggatgtgcccggcttcctgcctggaacagcccaggagtatggaggcatcatcagacatggagccaagctgctgtatgcctttgctgaggccaccgtgcccaaggtgaccgtcatcaccaggaaggcctatggaggagcctatgatgtgatgagcagcaagcacctgtgtggggacaccaactatgcctggcccacagctgagattgctgtgatgggcgccaagggagctgtggagatcatcttcaagggccatgaaaatgtggaggccgcccaggccgagtacatcgagaagtttgccaaccccttccctgctgctgtgcggggctttgtggatgacatcatccagcccagcagcacccgggcccgcatctgctgtgacctggatgtgctggccagcaagaaggtgcgggtgcaggaggtgttccaccaggtggtgcagagcggccacagagatggaagaggagctgtgcgctggtag

SEQ ID NO: 165552 - DNA, 387 bp, Artificial Sequence
  Description of Artificial Sequence: Synthetic coding sequence
atgagcctgcggctggacaccacccccagctgcaacagcgcccggcccctgcacgccctgcaggtgctgctgctgctgagcctgctgctgacagccctggccagcagcaccaagggccagaccaagaggaacctggccaagggcaaggaggagagcctggacagcgacctgtatgcagagctgcgctgcatgtgcatcaagaccaccagcggcatccaccccaagaacatccagagcctggaggtgattggcaagggcacccactgcaaccaggtggaggtgattgccaccctgaaggatggcaggaagatctgcctggaccctgatgccccccgcatcaagaagatcgtgcagaagaagctggccggagatgagagcgctgactag

SEQ ID NO: 165553 - DNA, 2262 bp, Artificial Sequence
  Description of Artificial Sequence: Synthetic coding sequence
atggagcggcgggcctggagcctgcagtgcacagcctttgtgctcttctgtgcctggtgtgccctgaacagcgccaaggccaagaggcagtttgtgaatgagtgggccgctgagatccctgggggccctgaggccgccagcgccatcgccgaggagctgggctatgacctgctgggccagatcggcagcctggagaaccactacctgttcaagcacaagaaccaccccaggaggagccgccgcagcgccttccacatcaccaagaggctgagtgatgatgacagagtcatctgggccgagcagcagtatgagaaggagaggagcaagaggtctgccctgcgggacagcgccctgaacctcttcaatgaccccatgtggaaccagcagtggtacctgcaggacaccaggatgacagctgccctgcccaagctggacctgcacgtgattcctgtgtggcagaagggcatcactggaaaaggagtggtgatcaccgtgctggatgatggcctggagtggaaccacacagacatctatgccaactatgaccctgaggccagctatgacttcaatgacaatgaccatgaccccttccccaggtatgaccccaccaatgaaaacaagcacggcacccgctgtgccggggagatcgccatgcaggccaacaaccacaagtgtggggtgggcgtggcctacaacagcaaggtgggcggcatccgcatgctggatggcatcgtgacagatgccatcgaggccagcagcatcggcttcaaccctggccacgtggacatctacagcgcctcctggggccccaatgatgatggcaagacagtggagggccctggccgcctggcccagaaggcctttgaatatggagtgaagcagggccggcagggcaagggcagcatctttgtgtgggccagcggaaatggaggccggcagggcgacaactgtgactgtgatggctacacagacagcatctacaccatcagcatcagcagcgccagccagcagggcctgagcccctggtacgccgagaagtgcagcagcaccctggccaccagctacagcagcggggactacacagaccagaggatcaccagcgctgacctgcacaatgactgcacagagacccacacaggcaccagcgccagcgcccccctggccgccggcatctttgccctggccctggaggccaaccccaacctgacctggagggacatgcagcacctggtggtgtggaccagtgaatatgaccccctggccaacaaccctggctggaagaagaatggagctggcctgatggtgaacagcagatttggatttggcctgctgaatgccaaggccctggtggacctggccgaccccaggacctggaggtctgtgcctgagaagaaggaatgtgtggtgaaggacaatgactttgagccccgggccctgaaggccaacggggaggtgatcatcgagatccccacccgggcctgtgagggccaggagaatgccatcaagagcctggagcacgtgcagtttgaggccaccatcgagtacagcagaagaggagacctgcacgtgaccctgaccagcgctgctggcaccagcacagtgctgctggccgagcgggagcgggacaccagccccaacggcttcaagaactgggacttcatgtctgtgcacacctggggcgagaaccccatcggcacctggaccctgcgcatcacagacatgagcggccgcatccagaatgaaggccgcatcgtgaactggaagctgatcctgcacggcaccagcagccagcctgagcacatgaagcagccccgggtgtacaccagctacaacacagtgcagaatgacagaagaggagtggagaagatggtggaccccggggaggagcagcccacccaggagaaccccaaggagaacaccctggtgtccaagagccccagcagcagctctgtgggcggcagaagagatgagctggaggagggcgcccccagccaggccatgctgcggctgctgcagagcgccttcagcaagaacagcccccccaagcagagccccaagaagagccccagcgccaagctgaacatcccctatgagaacttctatgaggccctggagaagctgaacaagcccagccagctgaaggacagcgaggacagcctgtacaatgactatgtggatgtgttctacaacaccaagccctacaagcacagagatgaccggctgctgcaggccctggtggacatcctgaatgaggagaactag

SEQ ID NO: 165554 - DNA, 477 bp, Artificial Sequence
  Description of Artificial Sequence: Synthetic coding sequence
atggagcggcgggcctggagcctgcagtgcacagcctttgtgctcttctgtgcctggtgtgccctgaacagcgccaaggccaagaggcagtttgtgaatgagtgggccgctgagatccctgggggccctgaggccgccagcgccatcgccgaggagctgggctatgacctgctgggccagatcggcagcctggagaaccactacctgttcaagcacaagaaccaccccaggaggagccgccgcagcgccttccacatcaccaagaggctgagtgatgatgacagagtcatctgggccgagcagcagtatgagaaggagaggagcaagaggtctgccctgcgggacagcgccctgaacctcttcaatgaccccatgtggaaccagcagtggtacctgcaggacaccaggatgacagctgccctgcccaagctggacctgcacgtgattcctgtgtggcagaagggcatcactggatag

SEQ ID NO: 165555 - DNA, 2121 bp, Artificial Sequence
  Description of Artificial Sequence: Synthetic coding sequence
atgggcaagggcagcatctccttcctgttcttcagccagatcggcagcctggagaaccactacctgttcaagcacaagaaccacccccggcgcagcagaagaagtgccttccacatcaccaagaggctgagtgatgatgacagagtcatctgggccgagcagcagtatgagaaggagaggagcaagaggtctgccctgcgggacagcgccctgaacctcttcaatgaccccatgtggaaccagcagtggtacctgcaggacaccaggatgacagctgccctgcccaagctggacctgcacgtgattcctgtgtggcagaagggcatcaccgggaagggcgtggtgatcaccgtgctggatgatggcctggagtggaaccacacagacatctatgccaactatgaccctgaggccagctatgacttcaatgacaatgaccatgaccccttccccaggtatgaccccaccaatgaaaacaagcacggcacccgctgtgccggggagatcgccatgcaggccaacaaccacaagtgtggggtgggcgtggcctacaacagcaaggtgggcggcatccgcatgctggatggcatcgtgacagatgccatcgaggccagcagcatcggcttcaaccctggccacgtggacatctacagcgcctcctggggccccaatgatgatggcaagacagtggagggccctggccgcctggcccagaaggcctttgaatatggagtgaagcagggccggcagggcaagggcagcatctttgtgtgggccagcggaaatggaggccggcagggcgacaactgtgactgtgatggctacacagacagcatctacaccatcagcatcagcagcgccagccagcagggcctgagcccctggtatgcagagaagtgcagcagcaccctggccaccagctacagcagcggggactacacagaccagaggatcaccagcgctgacctgcacaatgactgcacagagacccacacaggcaccagcgccagcgcccccctggccgccggcatctttgccctggccctggaggccaaccccaacctgacctggagggacatgcagcacctggtggtgtggaccagtgaatatgaccccctggccaacaaccctggctggaagaagaatggagctggcctgatggtgaacagccgcttcggcttcggcctgctgaatgccaaggccctggtggacctggccgaccccaggacctggaggtctgtgcctgagaagaaggaatgtgtggtgaaggacaatgactttgagccccgggccctgaaggccaatggagaggtgatcatcgagatccccacccgggcctgtgagggccaggagaatgccatcaagagcctggagcacgtgcagtttgaggccaccatcgagtacagccggcggggggacctgcacgtgaccctgaccagcgctgctggcaccagcacagtgctgctggccgagcgggagcgggacaccagccccaacggcttcaagaactgggacttcatgtctgtgcacacctggggcgagaaccccatcggcacctggaccctgcgcatcacagacatgagcggccgcatccagaatgaaggaagaattgtgaactggaagctgatcctgcacggcaccagcagccagcctgagcacatgaagcagccccgggtgtacaccagctacaacacagtgcagaatgaccggcggggcgtggagaagatggtggaccctggagaggagcagcccacccaggagaaccccaaggagaacaccctggtgtccaagagccccagcagcagctctgtgggcggcagaagagatgagctggaggagggcgcccccagccaggccatgctgcggctgctgcagagcgccttcagcaagaacagcccccccaagcagagccccaagaagagccccagcgccaagctgaacatcccctatgagaacttctatgaggccctggagaagctgaacaagcccagccagctgaaggacagcgaggacagcctgtacaatgactatgtggatgtgttctacaacaccaagccctacaagcacagagatgaccggctgctgcaggccctggtggacatcctgaatgaagaaaattag

SEQ ID NO: 165556 - DNA, 798 bp, Artificial Sequence; identical to SEQ ID NO: 164612
  Description of Artificial Sequence: Synthetic coding sequence

SEQ ID NO: 165557 - DNA, 1917 bp, Artificial Sequence
  Description of Artificial Sequence: Synthetic coding sequence
atgaagggcggctgtgtgtcccagtggaaggctgctgctggcttcctgttctgtgtgatggtgtttgccagcgctgagaggcctgtgttcaccaaccacttcctggtggagctgcacaagggaggagaggacaaggcccggcaggtggccgctgagcacggctttggagtgaggaagctgccctttgctgagggcctgtaccacttctaccacaacggcctggccaaggccaagagaagaagaagcctgcaccacaagcagcagctggagcgggacccccgggtgaagatggccctgcagcaggagggctttgacaggaagaagaggggctacagagacatcaatgaaattgacatcaacatgaatgaccccctcttcaccaagcagtggtacctgatcaacacaggccaggctgatggcaccccaggcctggacctgaatgtggccgaggcctgggagctgggctacacaggaaaaggagtgaccatcggcatcatggatgatggcatcgactacctgcacccagacctggccagcaactacaatgctgaggccagctatgacttcagcagcaatgacccctacccctacccccgctacacagatgactggttcaacagccacggcacccgctgtgccggggaggtgtctgctgctgccaacaacaacatctgtggggtgggcgtggcctacaacagcaaggtggccggcatccgcatgctggaccagcccttcatgacagacatcatcgaggccagcagcatcagccacatgccccagctgattgacatctacagcgcctcctggggccccacagacaacgggaagacagtggatggcccccgggagctgaccctgcaggccatggctgatggagtgaacaagggccggggcggcaagggcagcatctacgtgtgggccagcggagatggcggcagctatgatgactgcaactgtgatggctacgccagctccatgtggaccatcagcatcaacagcgccatcaatgatggccgcacagccctgtatgatgagagctgcagcagcaccctggccagcaccttcagcaatggaaggaagagaaatcctgaggccggcgtggccaccacagacctgtatggcaactgcaccctgcggcacagcggcaccagcgctgctgcccctgaggccgccggcgtgtttgccctggccctggaggccaacctgggcctgacctggagggacatgcagcacctgactgtgctgaccagcaagaggaaccagctgcatgatgaggtgcaccagtggaggagaaatggagtgggcctggagttcaaccacctgtttggctacggcgtgctggatgctggggccatggtgaagatggccaaggactggaagacagtgcctgagcgcttccactgtgtgggcggctctgtgcaggaccctgagaagatccccagcacaggcaagctggtgctgaccctgaccacagatgcctgtgagggcaaggagaactttgtgcgctacctggagcacgtgcaggccgtcatcaccgtgaatgccaccaggagaggagacctgaacatcaacatgaccagccccatgggcaccaagagcatcctgctgagccggcggcccagagatgatgacagcaaggtgggctttgacaagtggcccttcatgaccacccacacctggggagaagatgcccggggcacctggaccctggagctgggctttgtgggcagcgccccccagaagggcgtgctgaaggagtggaccctgatgctgcacggcacccagagcgccccctacatcgaccaggtggtgcgggactaccagagcaagctggccatgagcaagaaggaggagctggaggaggagctggatgaggccgtggagaggagcctgaagagcatcctgaacaagaactag

SEQ ID NO: 165558 - DNA, 1860 bp, Artificial Sequence
  Description of Artificial Sequence: Synthetic coding sequence
atggtgtttgccagcgctgagaggcctgtgttcaccaaccacttcctggtggagctgcacaagggcggggaggacaaggcccggcaggtggccgctgagcacggcttcggcgtgaggaagctgccctttgctgagggcctgtaccacttctaccacaacggcctggccaaggccaagagaagaagaagcctgcaccacaagcagcagctggagcgggacccccgggtgaagatggccctgcagcaggagggctttgacaggaagaagaggggctacagagacatcaatgaaattgacatcaacatgaatgaccccctcttcaccaagcagtggtacctgatcaacacaggccaggctgatggcaccccaggcctggacctgaatgtggccgaggcctgggagctgggctacaccgggaagggcgtgaccatcggcatcatggatgatggcatcgactacctgcacccagacctggccagcaactacaatgctgaggccagctatgacttcagcagcaatgacccctacccctacccccgctacacagatgactggttcaacagccacggcacccgctgtgccggggaggtgtctgctgctgccaacaacaacatctgtggggtgggcgtggcctacaacagcaaggtggccggcatccgcatgctggaccagcccttcatgacagacatcatcgaggccagcagcatcagccacatgccccagctgattgacatctacagcgcctcctggggccccacagacaatggcaagacagtggatggcccccgggagctgaccctgcaggccatggctgatggagtgaacaagggccggggcggcaagggcagcatctacgtgtgggccagcggagatggcggcagctatgatgactgcaactgtgatggctacgccagctccatgtggaccatcagcatcaacagcgccatcaatgatggccgcacagccctgtatgatgagagctgcagcagcaccctggccagcaccttcagcaatggaaggaagaggaaccctgaggccggcgtggccaccacagacctgtatggcaactgcaccctgcggcacagcggcaccagcgctgctgcccctgaggccgccggcgtgtttgccctggccctggaggccaacctgggcctgacctggagggacatgcagcacctgactgtgctgaccagcaagaggaaccagctgcatgatgaggtgcaccagtggaggagaaatggagtgggcctggagttcaaccacctgtttggctatggagtgctggatgctggggccatggtgaagatggccaaggactggaagacagtgcctgagcgcttccactgtgtgggcggctctgtgcaggaccctgagaagatccccagcacaggcaagctggtgctgaccctgaccacagatgcctgtgagggcaaggaaaattttgtgcgctacctggagcacgtgcaggccgtcatcaccgtgaatgccacccggcggggggacctgaacatcaacatgaccagccccatgggcaccaagagcatcctgctgagcagaagaccaagagatgatgacagcaaggtgggctttgacaagtggcccttcatgaccacccacacctggggagaagatgcccggggcacctggaccctggagctgggctttgtgggcagcgccccccagaagggcgtgctgaaggagtggaccctgatgctgcacggcacccagagcgccccctacatcgaccaggtggtgcgggactaccagagcaagctggccatgagcaagaaggaggagctggaggaggagctggatgaagctgtggagaggagcctgaagagcatcctgaacaagaactag

SEQ ID NO: 165559 - DNA, 1812 bp, Artificial Sequence
  Description of Artificial Sequence: Synthetic coding sequence
atgaagggcggctgtgtgtcccagtggaaggctgctgctggcttcctgttctgtgtgatggtgtttgccagcgctgagaggcctgtgttcaccaaccacttcctggtggagctgcacaagggaggagaggacaaggcccggcaggtggccgctgagcacggctttggagtgaggaaggtgaagatggccctgcagcaggagggctttgacaggaagaagaggggctacagagacatcaatgaaattgacatcaacatgaatgaccccctcttcaccaagcagtggtacctgatcaacacaggccaggctgatggcaccccaggcctggacctgaatgtggccgaggcctgggagctgggctacaccgggaagggcgtgaccatcggcatcatggatgatggcatcgactacctgcacccagacctggccagcaactacaatgctgaggccagctatgacttcagcagcaatgacccctacccctacccccgctacacagatgactggttcaacagccacggcacccgctgtgccggggaggtgtctgctgctgccaacaacaacatctgtggggtgggcgtggcctacaacagcaaggtggccggcatccgcatgctggaccagcccttcatgacagacatcatcgaggccagcagcatcagccacatgccccagctgattgacatctacagcgcctcctggggccccacagacaatggcaagacagtggatggcccccgggagctgaccctgcaggccatggctgatggagtgaacaagggccggggcggcaagggcagcatctacgtgtgggccagcggagatggcggcagctatgatgactgcaactgtgatggctacgccagctccatgtggaccatcagcatcaacagcgccatcaatgatggccgcacagccctgtatgatgagagctgcagcagcaccctggccagcaccttcagcaatggaaggaagaggaaccctgaggccggcgtggccaccacagacctgtatggcaactgcaccctgcggcacagcggcaccagcgctgctgcccctgaggccgccggcgtgtttgccctggccctggaggccaacctgggcctgacctggagggacatgcagcacctgactgtgctgaccagcaagaggaaccagctgcatgatgaggtgcaccagtggaggagaaatggagtgggcctggagttcaaccacctgtttggctatggagtgctggatgctggggccatggtgaagatggccaaggactggaagacagtgcctgagcgcttccactgtgtgggcggctctgtgcaggaccctgagaagatccccagcacaggcaagctggtgctgaccctgaccacagatgcctgtgagggcaaggaaaattttgtgcgctacctggagcacgtgcaggccgtcatcaccgtgaatgccacccggcggggggacctgaacatcaacatgaccagccccatgggcaccaagagcatcctgctgagcagaagaccaagagatgatgacagcaaggtgggctttgacaagtggcccttcatgaccacccacacctggggagaagatgcccggggcacctggaccctggagctgggctttgtgggcagcgccccccagaagggcgtgctgaaggagtggaccctgatgctgcacggcacccagagcgccccctacatcgaccaggtggtgcgggactaccagagcaagctggccatgagcaagaaggaggagctggaggaggagctggatgaagctgtggagaggagcctgaagagcatcctgaacaagaactag

SEQ ID NO: 165560 - DNA, 2268 bp, Artificial Sequence
  Description of Artificial Sequence: Synthetic coding sequence
atgaggcctgcccccatcgccctgtggctgcggctggtgctggccctggccctggtgcggcccagggctgtgggctgggcccctgtgcgggcccccatctacgtgtcctcctgggccgtgcaggtgtcccagggcaaccgggaggtggagcggctggccaggaagtttggatttgtgaacctgggccccatcttcccagatggccagtacttccacctgcggcacagaggagtggtgcagcagagcctgaccccccactggggccaccggctgcacctgaagaagaaccccaaggtgcagtggttccagcagcagaccctgcagaggagagtgaagaggtctgtggtggtgcccacagacccctggttcagcaagcagtggtacatgaacagcgaggcccagcctgacctgagcatcctgcaggcctggagccagggcctgagcggccagggcatcgtggtgtctgtgctggatgatggcatcgagaaggaccacccagacctgtgggccaactatgaccccctggccagctatgacttcaatgactatgaccctgacccccagccccgctacacccccagcaaggagaacagacatggcacccgctgtgccggggaggtggccgccatggccaacaacggcttctgtggggtgggcgtggccttcaatgcccgcatcggcggcgtgaggatgctggatggcaccatcacagatgtgattgaggcccagagcctgagcctgcagccccagcacatccacatctacagcgcctcctggggcccagaagatgatggccgcacagtggatggccctggcatcctgacccgggaggccttccggcggggcgtgaccaagggccggggcggcctgggcaccctcttcatctgggccagcggaaatggaggcctgcactatgacaactgcaactgtgatggctacaccaacagcatccacaccctgtctgtgggcagcaccacccagcagggccgggtgccctggtacagcgaggcctgtgccagcaccctgaccaccacctacagcagcggcgtggccacagacccccagatcgtgaccacagacctgcaccacggctgcacagaccagcacacaggcaccagcgccagcgcccccctggccgccggcatgattgccctggccctggaggccaaccccttcctgacctggagggacatgcagcacctggtggtgcgggccagcaagccagcccacctgcaggccgaggactggaggaccaatggagtgggccggcaggtgagccaccactacggctacggcctgctggatgctggcctgctggtggacacagcccggacctggctgcccacccagccccagaggaaatgtgctgtgcgggtgcagagccggcccacccccatcctgcccctcatctacatccgggagaatgtgtctgcctgtgccggcctgcacaacagcatccgcagcctggagcacgtgcaggcccagctgaccctgagctacagccggcggggggacctggagatcagcctgaccagccccatgggcaccaggagcaccctggtggccatccggcccctggatgtgtccacagagggctacaacaactgggtgttcatgagcacccacttctgggatgagaacccccagggcgtgtggaccctgggcctggagaacaagggctactacttcaacacaggcaccctgtaccgctacaccctgctgctgtatggaacagctgaggacatgacagcccggcccaccggcccccaggtgaccagcagcgcctgtgtgcagagggacacagagggcctgtgccaggcctgtgatggccctgcctacatcctgggccagctgtgcctggcctactgccccccacgcttcttcaaccacacccggctggtgacagctggccctggccacacagctgccccagccctgcgggtgtgcagcagctgccacgccagctgctacacctgccggggcggcagcccccgggactgcaccagctgcccccccagcagcaccctggaccagcagcagggcagctgcatgggccccaccaccccagacagccggccccggctgcgggccgccgcctgcccccaccaccgctgcccagccagcgccatggtgctgagcctgctggccgtgaccctgggcggccctgtgctgtgtggcatgtccatggacctgcccctgtatgcctggctgagccgggcccgggccacccccaccaagccccaggtgtggctgcctgctggcacctag

SEQ ID NO: 165561 - DNA, 1137 bp, Artificial Sequence
  Description of Artificial Sequence: Synthetic coding sequence
atggccagcaggaggaccaccaggaccagcggccccaccaccaccccctggccagccatgacctccatgaccaccaccaggacccccagccctgccaccccaccagccaagaggactggagtgaggatgctggatggcaccatcacagatgtgattgaggcccagagcctgagcctgcagccccagcacatccacatctacagcgcctcctggggcccagaagatgatggccgcacagtggatggccctggcatcctgacccgggaggccttccggcggggcgtgaccaagggccggggcggcctgggcaccctcttcatctgggccagcggaaatggaggcctgcactatgacaactgcaactgtgatggctacaccaacagcatccacaccctgtctgtgggcagcaccacccagcagggccgggtgccctggtacagcgaggcctgtgccagcaccctgaccaccacctacagcagcggcgtggccacagacccccagatcgtgaccacagacctgcaccacggctgcacagaccagcacacaggcaccagcgccagcgcccccctggccgccggcatgattgccctggccctggaggccaaccccttcctgacctggagggacatgcagcacctggtggtgcgggccagcaagccagcccacctgcaggccgaggactggaggaccaatggagtgggccggcaggtgagccaccactacggctacggcctgctggatgctggcctgctggtggacacagcccggacctggctgcccacccagccccagaggaaatgtgctgtgcgggtgcagagccggcccacccccatcctgcccctcatctacatccgggagaatgtgtctgcctgtgccggcctgcacaacagcatccgcagcctggagcacgtgcaggcccagctgaccctgagctacagccggcggggggacctggagatcagcctgaccagccccatgggcaccaggagcaccctggtggccatcagagatgtggtgcccctgcatgctgctgccctgtgggatggccggggccatgacagcgctgcctacagacctcctggggaccagcagagggtgtgtgccgccggccacagaggagctgtgcctggggtgtag

SEQ ID NO: 165562 - DNA, 2742 bp, Artificial Sequence
  Description of Artificial Sequence: Synthetic coding sequence
atgggctggggcagccgctgctgctgccccggccgcctggacctgctgtgtgtgctggccctgctgggcggctgcctgctgcctgtgtgcaggaccagggtgtacaccaaccactgggccgtgaagattgctgggggcttccctgaggccaacagaattgccagcaaatatggcttcatcaacatcggccagattggagccctgaaggactactaccacttctaccacagcaggaccatcaagaggagcgtcatcagcagccggggcacccacagcttcatctccatggagcccaaggtggagtggatccagcagcaggtggtgaagaagaggaccaagagggactatgacttcagccgggcccagagcacctacttcaatgaccccaagtggcccagcatgtggtacatgcactgcagcgacaacacccacccctgccagagcgacatgaacatcgagggcgcctggaagaggggctacacaggcaagaacatcgtggtgaccatcctggatgatggcatcgagaggacccacccagacctgatgcagaactatgatgccctggccagctgtgatgtgaatggaaatgacctggaccccatgcccaggtatgatgccagcaatgaaaacaagcacggcacccgctgtgccggggaggtggccgctgctgccaacaacagccactgcaccgtgggcatcgccttcaatgccaagattggaggagtgaggatgctggatggagatgtgacagacatggtggaggccaagtctgtgtccttcaacccccagcacgtgcacatctacagcgcctcctggggcccagatgatgatggcaagacagtggatggccctgcccccctgacccggcaggcctttgaaaatggagtgaggatgggccggcggggcctgggctctgtgtttgtgtgggccagcggaaatggaggccgcagcaaggaccactgcagctgtgatggctacaccaacagcatctacaccatcagcatcagcagcacagctgagagcggcaagaagccctggtacctggaggagtgcagcagcaccctggccaccacctacagcagtggagagagctatgacaagaagatcatcaccacagacctgcggcagcgctgcacagacaaccacacaggcaccagcgccagcgcccccatggctgctggcatcatcgccctggccctggaggccaaccccttcctgacctggagagatgtgcagcacgtgattgtgaggaccagcagagctggccacctgaatgccaatgactggaagaccaatgctgctggcttcaaggtgagccacctgtatggcttcggcctgatggatgctgaggccatggtgatggaggccgagaagtggaccaccgtgccccggcagcacgtgtgtgtggagagcacagaccggcagatcaagaccatccggcccaacagcgctgtgcgcagcatctacaaggccagcggctgcagcgacaaccccaacagacatgtgaactacctggagcacgtggtggtgcgcatcaccatcacccacccccggcggggggacctggccatctacctgaccagccccagcggcaccaggagccagctgctggccaacagactctttgaccacagcatggagggcttcaagaactgggagttcatgaccatccactgctggggcgagagagctgctggggactgggtgctggaggtgtatgacacccccagccagctgaggaacttcaagaccccaggcaagctgaaggagtggagcctggtgctgtatggcacctctgtgcagccctacagccccaccaatgagttccccaaggtggagcgcttccgctacagccgggtggaggaccccacagatgattatggaacagaggactatgccggcccctgtgaccctgaatgttctgaggtgggctgtgatggccctggccctgaccactgcaatgactgcctgcactactactacaagctgaagaacaacacccgcatctgtgtgagcagctgccccccaggccactaccacgccgacaagaagcgctgcaggaaatgtgcccccaactgtgagagctgcttcggcagccacggggaccagtgcatgagctgcaagtatggctacttcctgaatgaggagaccaacagctgtgtgacccactgcccagatggcagctaccaggacaccaagaagaacctgtgcaggaaatgttctgagaactgcaagacctgcacagagttccacaactgcacagaatgtagagatggcctgagcctgcagggcagccgctgcagcgtgtcctgtgaagatggccgctacttcaacggccaggactgccagccctgccaccgcttctgtgccacctgtgccggggccggggctgatggctgcatcaactgcacagagggctacttcatggaggatggccgctgtgtgcagagctgcagcatctcctactactttgaccacagcagtgaaaatggctacaagagctgcaagaagtgtgacatcagctgcctgacctgcaatggacctggcttcaagaactgcaccagctgccccagcggctacctgctggacctgggcatgtgccagatgggcgccatctgcaaggatgccacagaggagagctgggccgagggcggcttctgcatgctggtgaagaagaacaacctgtgccagaggaaggtgctgcagcagctgtgctgcaagacctgcaccttccagggctag

SEQ ID NO: 165563 - DNA, 4773 bp, Artificial Sequence
  Description of Artificial Sequence: Synthetic coding sequence
atgggcagaagaggcctgggctctgtgtttgtgtgggccagcggaaatggaggccgcagcaaggaccactgcagctgtgatggctacaccaacagcatctacaccatcagcatcagcagcacagctgagagcggcaagaagccctggtacctggaggagtgcagcagcaccctggccaccacctacagcagcggggagagctatgacaagaagatcatcaccacagacctgcggcagcgctgcacagacaaccacacaggcaccagcgccagcgcccccatggccgccggcatcatcgccctggccctggaggccaaccccttcctgacctggagagatgtgcagcacgtgattgtgaggaccagccgggccggccacctgaatgccaatgactggaagaccaatgctgctggcttcaaggtgagccacctgtatggcttcggcctgatggatgctgaggccatggtgatggaggccgagaagtggaccaccgtgccccggcagcacgtgtgtgtggagagcacagaccggcagatcaagaccatccggcccaacagcgctgtgcgcagcatctacaaggccagcggctgcagcgacaaccccaacagacatgtgaactacctggagcacgtggtggtgcgcatcaccatcacccaccccaggagaggagacctggccatctacctgaccagccccagcggcaccaggagccagctgctggccaaccggctgtttgaccacagcatggagggcttcaagaactgggagttcatgaccatccactgctggggcgagagagctgctggggactgggtgctggaggtgtatgacacccccagccagctgaggaacttcaagacccctgggaagctgaaggagtggagcctggtgctgtatggcacctctgtgcagccctacagccccaccaatgagttccccaaggtggagcgcttccgctacagccgggtggaggaccccacagatgattatggaacagaagattatgccggcccctgtgaccctgagtgcagcgaggtgggctgtgatggccctggccctgaccactgcaatgactgcctgcactactactacaagctgaagaacaacacccgcatctgtgtgagcagctgccccccaggccactaccacgccgacaagaagcgctgcaggaaatgtgcccccaactgtgagagctgcttcggcagccatggagaccagtgcatgagctgcaagtatggctacttcctgaatgaggagaccaacagctgtgtgacccactgcccagatggcagctaccaggacaccaagaagaacctgtgcaggaagtgcagcgagaactgcaagacctgcacagagttccacaactgcacagagtgcagagatggcctgagcctgcagggcagccgctgcagcgtgtcctgtgaagatggccgctacttcaacggccaggactgccagccctgccaccgcttctgtgccacctgtgccggggccggggctgatggctgcatcaactgcacagagggctacttcatggaggatggccgctgtgtgcagagctgcagcatctcctactactttgaccacagcagtgaaaatggctacaagagctgcaagaagtgtgacatcagctgcctgacctgcaatggacctggcttcaagaactgcaccagctgccccagcggctacctgctggacctgggcatgtgccagatgggcgccatctgcaaggatggagaatatgtggatgaacatggccactgccagacctgtgaggccagctgtgccaagtgccagggccccacccaggaggactgcaccacctgccccatgacccgcatctttgatgatggccgctgtgtgagcaactgccccagctggaagtttgaatttgagaaccagtgccacccctgccaccacacctgccagcgctgccagggcagcggccccacccactgcaccagctgtggggctgacaactacggccgggagcacttcctgtaccagggagaatgtggggacagctgcccagagggccactacgccacagagggcaacacctgcctgccctgcccagacaactgtgagctgtgccacagcgtgcacgtgtgcacccgctgcatgaagggctacttcatcgcccccaccaaccacacctgccagaagctggagtgtggccagggcgaggtgcaggaccctgactatgaagaatgtgtgccctgtgaggagggctgcctgggctgcagcctggatgatcctggcacctgcaccagctgtgccatgggctactacagatttgaccaccactgctacaagacctgcccagagaagacctacagcgaggaggtggagtgcaaggcctgtgacagcaactgtggcagctgtgaccagaatggctgctactggtgtgaggagggcttcttcctgctgggcggcagctgtgtgaggaaatgtggccctggcttctatggagaccaggagatgggagaatgtgagagctgccaccgggcctgtgagacctgcaccggccctggccatgatgagtgcagcagctgccaggagggcctgcagctgctgcggggcatgtgtgtgcacgccaccaagacccaggaggagggcaagttctggaatgaagctgtgtccacagccaacctgtctgtggtgaagagcctgctgcaggagcggcggcgctggaaggtgcagatcaagagggacatcctgaggaagctgcagccctgccacagcagctgcaagacctgcaatggaagtgccaccctgtgcaccagctgccccaagggggcctacctgctggcccaggcctgtgtgagcagctgcccccagggcacctggcccagcgtgcgcagcggcagctgtgagaactgcacagaggcctgtgccatctgcagcggggctgacctgtgcaagaagtgccagatgcagcccggccaccccctcttcctgcacgagggccgctgctacagcaaatgtcctgagggcagctatgcagaagatggcatctgtgagcgctgcagcagcccctgcaggacctgtgagggcaatgccaccaactgccacagctgtgagggcggccacgtgctgcaccacggcgtgtgccaggagaactgcccagagcggcacgtggccgtgaagggcgtgtgcaagcactgcccagagatgtgccaggactgcatccacgagaagacctgcaaggaatgtaccccagagttcttcctgcatgatgacatgtgccaccagagctgcccccggggcttctatgctgacagccgccactgtgtgccctgccacaaggactgcctggagtgcagcggccccaaggcagatgactgtgagctgtgcctggagagctcctgggtgctgtatgatggcctgtgcctggaggagtgcccagctggcacctactatgagaaggagaccaaggaatgtcgggactgccacaagagctgcctgacctgcagcagcagcggcacctgcaccacctgccagaagggcctcatcatgaacccccggggcagctgcatggccaatgagaagtgcagccccagcgagtactgggatgaagatgcccctggctgcaagccctgccacgtgaagtgcttccactgcatgggccctgctgaggaccagtgccagacctgccccatgaacagcctgctgctgaacaccacctgtgtgaaggactgcccagagggctactatgcagatgaggacagcaacagatgtgcccactgccacagcagctgcaggacctgtgagggccgccacagccggcagtgccacagctgccggcccggctggttccagctgggcaaggagtgcctgctgcagtgccgggagggctactatgctgacaacagcacaggccgctgtgagcgctgcaacagaagctgcaagggctgccagggcccccggcccacagactgcctgagctgtgaccgcttcttcttcctgctgcggagcaaaggagagtgccacaggagctgcccagaccactactacgtggagcagagcacccagacctgtgagcgctgccaccccacctgtgaccagtgcaagggcaagggggccctgaactgcctgagctgtgtgtggagctaccacctgatgggcggcatctgcaccagtgactgcctggtgggggagtacagagtgggggagggggagaagttcaactgtgagaagtgccacgagagctgcatggagtgcaagggccctggggccaagaactgcaccctgtgcccagccaacctggtgctgcacatggatgacagccactgcctgcactgctgcaacaccagtgaccccccatctgcccaggagtgctgtgactgccaggacaccacagatgagtgcatcctgcggaccagcaaggtgcggcctgccacagagcacttcaagacagccctcttcatcaccagctccatgatgctggtgctgctgctgggcgctgctgtggtggtgtggaagaagagccggggccgggtgcagcctgctgccaaggccggctatgagaagctggccgaccccaacaagagctacagcagctacaagagcagctaccgggagagcaccagctttgaggaggaccaggtgattgagtacagagaccgggactatgatgaagatgatgatgatgacatcgtgtacatgggccaggacggcaccgtgtacaggaagttcaagtatggcctgctggatgatgatgacattgatgagctggagtatgatgatgagagctacagctactaccagtag

SEQ ID NO: 165564 - DNA, 2073 bp, Artificial Sequence
  Description of Artificial Sequence: Synthetic coding sequence
atgggctggggcagccgctgctgctgccccggccgcctggacctgctgtgtgtgctggccctgctgggcggctgcctgctgcctgtgtgcaggaccagggtgtacaccaaccactgggccgtgaagattgctgggggcttccctgaggccaacagaattgccagcaaatatggcttcatcaacatcggccagattggagccctgaaggactactaccacttctaccacagcaggaccatcaagaggagcgtcatcagcagccggggcacccacagcttcatctccatggagcccaaggtggagtggatccagcagcaggtggtgaagaagaggaccaagagggactatgacttcagccgggcccagagcacctacttcaatgaccccaagtggcccagcatgtggtacatgcactgcagcgacaacacccacccctgccagagcgacatgaacatcgagggcgcctggaagaggggctacacaggcaagaacatcgtggtgaccatcctggatgatggcatcgagaggacccacccagacctgatgcagaactatgatgccctggccagctgtgatgtgaatggaaatgacctggaccccatgcccaggtatgatgccagcaatgaaaacaagcacggcacccgctgtgccggggaggtggccgctgctgccaacaacagccactgcaccgtgggcatcgccttcaatgccaagattggaggagtgaggatgctggatggagatgtgacagacatggtggaggccaagtctgtgtccttcaacccccagcacgtgcacatctacagcgcctcctggggcccagatgatgatggcaagacagtggatggccctgcccccctgacccggcaggcctttgaaaatggagtgaggatgggccggcggggcctgggctctgtgtttgtgtgggccagcggaaatggaggccgcagcaaggaccactgcagctgtgatggctacaccaacagcatctacaccatcagcatcagcagcacagctgagagcggcaagaagccctggtacctggaggagtgcagcagcaccctggccaccacctacagcagtggagagagctatgacaagaagatcatcaccacagacctgcggcagcgctgcacagacaaccacacaggcaccagcgccagcgcccccatggctgctggcatcatcgccctggccctggaggccaaccccttcctgacctggagagatgtgcagcacgtgattgtgaggaccagcagagctggccacctgaatgccaatgactggaagaccaatgctgctggcttcaaggtgagccacctgtatggcttcggcctgatggatgctgaggccatggtgatggaggccgagaagtggaccaccgtgccccggcagcacgtgtgtgtggagagcacagaccggcagatcaagaccatccggcccaacagcgctgtgcgcagcatctacaaggccagcggctgcagcgacaaccccaacagacatgtgaactacctggagcacgtggtggtgcgcatcaccatcacccacccccggcggggggacctggccatctacctgaccagccccagcggcaccaggagccagctgctggccaacagactctttgaccacagcatggagggcttcaagaactgggagttcatgaccatccactgctggggcgagagagctgctggggactgggtgctggaggtgtatgacacccccagccagctgaggaacttcaagaccccaggcaagctgaaggagtggagcctggtgctgtatggcacctctgtgcagccctacagccccaccaatgagttccccaaggtggagcgcttccgctacagccgggtggaggaccccacagatgattatggaacagaggactatgctggggagctggccagcagcggcacccaggccaagaagaggcagctgatgcaccaccccaccacctgggagaacaggatggagtggaatggcatgaagtggaatggcatgaagtggaatggcatggagtggaatggcatggagtggaaccgcatcgagagcaacagaattgaatag

SEQ ID NO: 165565 - DNA, 2073 bp, Artificial Sequence
  Description of Artificial Sequence: Synthetic coding sequence
atgggctggggcagccgctgctgctgccccggccgcctggacctgctgtgtgtgctggccctgctgggcggctgcctgctgcctgtgtgcaggaccagggtgtacaccaaccactgggccgtgaagattgctgggggcttccctgaggccaacagaattgccagcaaatatggcttcatcaacatcggccagattggagccctgaaggactactaccacttctaccacagcaggaccatcaagaggagcgtcatcagcagccggggcacccacagcttcatctccatggagcccaaggtggagtggatccagcagcaggtggtgaagaagaggaccaagagggactatgacttcagccgggcccagagcacctacttcaatgaccccaagtggcccagcatgtggtacatgcactgcagcgacaacacccacccctgccagagcgacatgaacatcgagggcgcctggaagaggggctacacaggcaagaacatcgtggtgaccatcctggatgatggcatcgagaggacccacccagacctgatgcagaactatgatgccctggccagctgtgatgtgaatggaaatgacctggaccccatgcccaggtatgatgccagcaatgaaaacaagcacggcacccgctgtgccggggaggtggccgctgctgccaacaacagccactgcaccgtgggcatcgccttcaatgccaagattggaggagtgaggatgctggatggagatgtgacagacatggtggaggccaagtctgtgtccttcaacccccagcacgtgcacatctacagcgcctcctggggcccagatgatgatggcaagacagtggatggccctgcccccctgacccggcaggcctttgaaaatggagtgaggatgggccggcggggcctgggctctgtgtttgtgtgggccagcggaaatggaggccgcagcaaggaccactgcagctgtgatggctacaccaacagcatctacaccatcagcatcagcagcacagctgagagcggcaagaagccctggtacctggaggagtgcagcagcaccctggccaccacctacagcagtggagagagctatgacaagaagatcatcaccacagacctgcggcagcgctgcacagacaaccacacaggcaccagcgccagcgcccccatggctgctggcatcatcgccctggccctggaggccaaccccttcctgacctggagagatgtgcagcacgtgattgtgaggaccagcagagctggccacctgaatgccaatgactggaagaccaatgctgctggcttcaaggtgagccacctgtatggcttcggcctgatggatgctgaggccatggtgatggaggccgagaagtggaccaccgtgccccggcagcacgtgtgtgtggagagcacagaccggcagatcaagaccatccggcccaacagcgctgtgcgcagcatctacaaggccagcggctgcagcgacaaccccaacagacatgtgaactacctggagcacgtggtggtgcgcatcaccatcacccacccccggcggggggacctggccatctacctgaccagccccagcggcaccaggagccagctgctggccaacagactctttgaccacagcatggagggcttcaagaactgggagttcatgaccatccactgctggggcgagagagctgctggggactgggtgctggaggtgtatgacacccccagccagctgaggaacttcaagaccccaggcaagctgaaggagtggagcctggtgctgtatggcacctctgtgcagccctacagccccaccaatgagttccccaaggtggagcgcttccgctacagccgggtggaggaccccacagatgattatggaacagaggactatgctggggagctggccagcagcggcacccaggccaagaagaggcagctgatgcaccaccccaccacctgggagaacaggatggagtggaatggcatgaagtggaatggcatggagtggaatggcatggagtggaatggcatggagagcaaccgcatcgagagcaacagaattgaatag

SEQ ID NO: 165566 - DNA, 4683 bp, Artificial Sequence
  Description of Artificial Sequence: Synthetic coding sequence
aacagcatctacaccatcagcatcagcagcacagctgagagcggcaagaagccctggtacctggaggagtgcagcagcaccctggccaccacctacagcagcggggagagctatgacaagaagatcatcaccacagacctgcggcagcgctgcacagacaaccacacaggcaccagcgccagcgcccccatggccgccggcatcatcgccctggccctggaggccaaccccttcctgacctggagagatgtgcagcacgtgattgtgaggaccagccgggccggccacctgaatgccaatgactggaagaccaatgctgctggcttcaaggtgagccacctgtatggcttcggcctgatggatgctgaggccatggtgatggaggccgagaagtggaccaccgtgccccggcagcacgtgtgtgtggagagcacagaccggcagatcaagaccatccggcccaacagcgctgtgcgcagcatctacaaggccagcggctgcagcgacaaccccaacagacatgtgaactacctggagcacgtggtggtgcgcatcaccatcacccaccccaggagaggagacctggccatctacctgaccagccccagcggcaccaggagccagctgctggccaaccggctgtttgaccacagcatggagggcttcaagaactgggagttcatgaccatccactgctggggcgagagagctgctggggactgggtgctggaggtgtatgacacccccagccagctgaggaacttcaagacccctgggaagctgaaggagtggagcctggtgctgtatggcacctctgtgcagccctacagccccaccaatgagttccccaaggtggagcgcttccgctacagccgggtggaggaccccacagatgattatggaacagaagattatgccggcccctgtgaccctgagtgcagcgaggtgggctgtgatggccctggccctgaccactgcaatgactgcctgcactactactacaagctgaagaacaacacccgcatctgtgtgagcagctgccccccaggccactaccacgccgacaagaagcgctgcaggaaatgtgcccccaactgtgagagctgcttcggcagccatggagaccagtgcatgagctgcaagtatggctacttcctgaatgaggagaccaacagctgtgtgacccactgcccagatggcagctaccaggacaccaagaagaacctgtgcaggaagtgcagcgagaactgcaagacctgcacagagttccacaactgcacagagtgcagagatggcctgagcctgcagggcagccgctgcagcgtgtcctgtgaagatggccgctacttcaacggccaggactgccagccctgccaccgcttctgtgccacctgtgccggggccggggctgatggctgcatcaactgcacagagggctacttcatggaggatggccgctgtgtgcagagctgcagcatctcctactactttgaccacagcagtgaaaatggctacaagagctgcaagaagtgtgacatcagctgcctgacctgcaatggacctggcttcaagaactgcaccagctgccccagcggctacctgctggacctgggcatgtgccagatgggcgccatctgcaaggatggagaatatgtggatgaacatggccactgccagacctgtgaggccagctgtgccaagtgccagggccccacccaggaggactgcaccacctgccccatgacccgcatctttgatgatggccgctgtgtgagcaactgccccagctggaagtttgaatttgagaaccagtgccacccctgccaccacacctgccagcgctgccagggcagcggccccacccactgcaccagctgtggggctgacaactacggccgggagcacttcctgtaccagggagaatgtggggacagctgcccagagggccactacgccacagagggcaacacctgcctgccctgcccagacaactgtgagctgtgccacagcgtgcacgtgtgcacccgctgcatgaagggctacttcatcgcccccaccaaccacacctgccagaagctggagtgtggccagggcgaggtgcaggaccctgactatgaagaatgtgtgccctgtgaggagggctgcctgggctgcagcctggatgatcctggcacctgcaccagctgtgccatgggctactacagatttgaccaccactgctacaagacctgcccagagaagacctacagcgaggaggtggagtgcaaggcctgtgacagcaactgtggcagctgtgaccagaatggctgctactggtgtgaggagggcttcttcctgctgggcggcagctgtgtgaggaaatgtggccctggcttctatggagaccaggagatgggagaatgtgagagctgccaccgggcctgtgagacctgcaccggccctggccatgatgagtgcagcagctgccaggagggcctgcagctgctgcggggcatgtgtgtgcacgccaccaagacccaggaggagggcaagttctggaatgaagctgtgtccacagccaacctgtctgtggtgaagagcctgctgcaggagcggcggcgctggaaggtgcagatcaagagggacatcctgaggaagctgcagccctgccacagcagctgcaagacctgcaatggaagtgccaccctgtgcaccagctgccccaagggggcctacctgctggcccaggcctgtgtgagcagctgcccccagggcacctggcccagcgtgcgcagcggcagctgtgagaactgcacagaggcctgtgccatctgcagcggggctgacctgtgcaagaagtgccagatgcagcccggccaccccctcttcctgcacgagggccgctgctacagcaaatgtcctgagggcagctatgcagaagatggcatctgtgagcgctgcagcagcccctgcaggacctgtgagggcaatgccaccaactgccacagctgtgagggcggccacgtgctgcaccacggcgtgtgccaggagaactgcccagagcggcacgtggccgtgaagggcgtgtgcaagcactgcccagagatgtgccaggactgcatccacgagaagacctgcaaggaatgtaccccagagttcttcctgcatgatgacatgtgccaccagagctgcccccggggcttctatgctgacagccgccactgtgtgccctgccacaaggactgcctggagtgcagcggccccaaggcagatgactgtgagctgtgcctggagagctcctgggtgctgtatgatggcctgtgcctggaggagtgcccagctggcacctactatgagaaggagaccaaggaatgtcgggactgccacaagagctgcctgacctgcagcagcagcggcacctgcaccacctgccagaagggcctcatcatgaacccccggggcagctgcatggccaatgagaagtgcagccccagcgagtactgggatgaagatgcccctggctgcaagccctgccacgtgaagtgcttccactgcatgggccctgctgaggaccagtgccagacctgccccatgaacagcctgctgctgaacaccacctgtgtgaaggactgcccagagggctactatgcagatgaggacagcaacagatgtgcccactgccacagcagctgcaggacctgtgagggccgccacagccggcagtgccacagctgccggcccggctggttccagctgggcaaggagtgcctgctgcagtgccgggagggctactatgctgacaacagcacaggccgctgtgagcgctgcaacagaagctgcaagggctgccagggcccccggcccacagactgcctgagctgtgaccgcttcttcttcctgctgcggagcaaaggagagtgccacaggagctgcccagaccactactacgtggagcagagcacccagacctgtgagcgctgccaccccacctgtgaccagtgcaagggcaagggggccctgaactgcctgagctgtgtgtggagctaccacctgatgggcggcatctgcaccagtgactgcctggtgggggagtacagagtgggggagggggagaagttcaactgtgagaagtgccacgagagctgcatggagtgcaagggccctggggccaagaactgcaccctgtgcccagccaacctggtgctgcacatggatgacagccactgcctgcactgctgcaacaccagtgaccccccatctgcccaggagtgctgtgactgccaggacaccacagatgagtgcatcctgcggaccagcaaggtgcggcctgccacagagcacttcaagacagccctcttcatcaccagctccatgatgctggtgctgctgctgggcgctgctgtggtggtgtggaagaagagccggggccgggtgcagcctgctgccaaggccggctatgagaagctggccgaccccaacaagagctacagcagctacaagagcagctaccgggagagcaccagctttgaggaggaccaggtgattgagtacagagaccgggactatgatgaagatgatgatgatgacatcgtgtacatgggccaggacggcaccgtgtacaggaagttcaagtatggcctgctggatgatgatgacattgatgagctggagtatgatgatgagagctacagctactaccagtag

SEQ ID NO: 165567 - DNA, 306 bp, Artificial Sequence
  Description of Artificial Sequence: Synthetic coding sequence
tgccagccctgccaccgcttctgtgccacctgtgccggggccggggctgatggctgcatcaactgcacagagggctacttcatggaggatggccgctgtgtgcagagctgcagcatctcctactactttgaccacagcagtgaaaatggctacaagagctgcaagaagtgtgacatcagctgcctgacctgcaatggacctggcttcaagaactgcaccagctgccccagcggctacctgctggacctgggcatgtgccagatgggcgccatctgcaaggatgtgtccctcttccggggggcctag

SEQ ID NO: 165568 - DNA, 5583 bp, Artificial Sequence
  Description of Artificial Sequence: Synthetic coding sequence
atgggctggggcagccgctgctgctgccccggccgcctggacctgctgtgtgtgctggccctgctgggcggctgcctgctgcctgtgtgcaggaccagggtgtacaccaaccactgggccgtgaagattgctgggggcttccctgaggccaacagaattgccagcaaatatggcttcatcaacatcggccagattggagccctgaaggactactaccacttctaccacagcaggaccatcaagaggagcgtcatcagcagccggggcacccacagcttcatctccatggagcccaaggtggagtggatccagcagcaggtggtgaagaagaggaccaagagggactatgacttcagccgggcccagagcacctacttcaatgaccccaagtggcccagcatgtggtacatgcactgcagcgacaacacccacccctgccagagcgacatgaacatcgagggcgcctggaagaggggctacacaggcaagaacatcgtggtgaccatcctggatgatggcatcgagaggacccacccagacctgatgcagaactatgatgccctggccagctgtgatgtgaatggaaatgacctggaccccatgcccaggtatgatgccagcaatgaaaacaagcacggcacccgctgtgccggggaggtggccgctgctgccaacaacagccactgcaccgtgggcatcgccttcaatgccaagattggaggagtgaggatgctggatggagatgtgacagacatggtggaggccaagtctgtgtccttcaacccccagcacgtgcacatctacagcgcctcctggggcccagatgatgatggcaagacagtggatggccctgcccccctgacccggcaggcctttgaaaatggagtgaggatgggccggcggggcctgggctctgtgtttgtgtgggccagcggaaatggaggccgcagcaaggaccactgcagctgtgatggctacaccaacagcatctacaccatcagcatcagcagcacagctgagagcggcaagaagccctggtacctggaggagtgcagcagcaccctggccaccacctacagcagtggagagagctatgacaagaagatcatcaccacagacctgcggcagcgctgcacagacaaccacacaggcaccagcgccagcgcccccatggctgctggcatcatcgccctggccctggaggccaaccccttcctgacctggagagatgtgcagcacgtgattgtgaggaccagcagagctggccacctgaatgccaatgactggaagaccaatgctgctggcttcaaggtgagccacctgtatggcttcggcctgatggatgctgaggccatggtgatggaggccgagaagtggaccaccgtgccccggcagcacgtgtgtgtggagagcacagaccggcagatcaagaccatccggcccaacagcgctgtgcgcagcatctacaaggccagcggctgcagcgacaaccccaacagacatgtgaactacctggagcacgtggtggtgcgcatcaccatcacccacccccggcggggggacctggccatctacctgaccagccccagcggcaccaggagccagctgctggccaacagactctttgaccacagcatggagggcttcaagaactgggagttcatgaccatccactgctggggcgagagagctgctggggactgggtgctggaggtgtatgacacccccagccagctgaggaacttcaagaccccaggcaagctgaaggagtggagcctggtgctgtatggcacctctgtgcagccctacagccccaccaatgagttccccaaggtggagcgcttccgctacagccgggtggaggaccccacagatgattatggaacagaggactatgccggcccctgtgaccctgaatgttctgaggtgggctgtgatggccctggccctgaccactgcaatgactgcctgcactactactacaagctgaagaacaacacccgcatctgtgtgagcagctgccccccaggccactaccacgccgacaagaagcgctgcaggaaatgtgcccccaactgtgagagctgcttcggcagccacggggaccagtgcatgagctgcaagtatggctacttcctgaatgaggagaccaacagctgtgtgacccactgcccagatggcagctaccaggacaccaagaagaacctgtgcaggaaatgttctgagaactgcaagacctgcacagagttccacaactgcacagaatgtagagatggcctgagcctgcagggcagccgctgcagcgtgtcctgtgaagatggccgctacttcaacggccaggactgccagccctgccaccgcttctgtgccacctgtgccggggccggggctgatggctgcatcaactgcacagagggctacttcatggaggatggccgctgtgtgcagagctgcagcatctcctactactttgaccacagcagtgaaaatggctacaagagctgcaagaagtgtgacatcagctgcctgacctgcaatggacctggcttcaagaactgcaccagctgccccagcggctacctgctggacctgggcatgtgccagatgggcgccatctgcaaggatggagaatatgtggatgagcacggccactgccagacctgtgaggccagctgtgccaagtgccagggccccacccaggaggactgcaccacctgccccatgacccgcatctttgatgatggccgctgtgtgagcaactgccccagctggaagtttgaatttgagaaccagtgccacccctgccaccacacctgccagcgctgccagggcagcggccccacccactgcaccagctgtggggctgacaactacggccgggagcacttcctgtaccagggagaatgtggggacagctgcccagagggccactacgccacagagggcaacacctgcctgccctgcccagacaactgtgagctgtgccacagcgtgcacgtgtgcacccgctgcatgaagggctacttcatcgcccccaccaaccacacctgccagaagctggagtgtggccagggcgaggtgcaggaccctgactatgaggagtgtgtgccctgtgaggagggctgcctgggctgcagcctggatgaccccggcacctgcaccagctgtgccatgggctactacagatttgaccaccactgctacaagacctgcccagagaagacctacagcgaggaggtggagtgcaaggcctgtgacagcaactgtggcagctgtgaccagaatggctgctactggtgtgaggagggcttcttcctgctgggcggcagctgtgtgaggaaatgtggccctggcttctacggggaccaggagatgggagaatgtgagagctgccaccgggcctgtgagacctgcaccggccctggccatgatgaatgtagcagctgccaggagggcctgcagctgctgcggggcatgtgtgtgcacgccaccaagacccaggaggagggcaagttctggaatgacatcctgaggaagctgcagccctgccacagcagctgcaagacctgcaatggaagtgccaccctgtgcaccagctgccccaagggggcctacctgctggcccaggcctgtgtgagcagctgcccccagggcacctggcccagcgtgcgcagcggcagctgtgagaactgcacagaggcctgtgccatctgcagcggggctgacctgtgcaagaagtgccagatgcagcccggccaccccctcttcctgcacgagggccgctgctacagcaaatgtcctgagggcagctatgcagaagatggcatctgtgagcgctgcagcagcccctgcaggacctgtgagggcaatgccaccaactgccacagctgtgagggcggccacgtgctgcaccacggcgtgtgccaggagaactgcccagagcggcacgtggccgtgaagggcgtgtgcaagcactgcccagagatgtgccaggactgcatccacgagaagacctgcaaggaatgtaccccagagttcttcctgcatgatgacatgtgccaccagagctgcccccggggcttctatgctgacagccgccactgtgtgccctgccacaaggactgcctggagtgcagcggccccaaggcagatgactgtgagctgtgcctggagagctcctgggtgctgtatgatggcctgtgcctggaggagtgcccagctggcacctactatgagaaggagaccaaggaatgtcgggactgccacaagagctgcctgacctgcagcagcagcggcacctgcaccacctgccagaagggcctcatcatgaacccccggggcagctgcatggccaatgagaagtgcagccccagcgagtactgggatgaagatgcccctggctgcaagccctgccacgtgaagtgcttccactgcatgggccctgctgaggaccagtgccagacctgccccatgaacagcctgctgctgaacaccacctgtgtgaaggactgcccagagggctactatgcagatgaggacagcaacagatgtgcccactgccacagcagctgcaggacctgtgagggccgccacagccggcagtgccacagctgccggcccggctggttccagctgggcaaggagtgcctgctgcagtgccgggagggctactatgctgacaacagcacaggccgctgtgagcgctgcaacagaagctgcaagggctgccagggcccccggcccacagactgcctgagctgtgaccgcttcttcttcctgctgcggagcaaaggagagtgccacaggagctgcccagaccactactacgtggagcagagcacccagacctgtgagcgctgccaccccacctgtgaccagtgcaagggcaagggggccctgaactgcctgagctgtgtgtggagctaccacctgatgggcggcatctgcaccagtgactgcctggtgggggagtacagagtgggggagggggagaagttcaactgtgagaagtgccacgagagctgcatggagtgcaagggccctggggccaagaactgcaccctgtgcccagccaacctggtgctgcacatggatgacagccactgcctgcactgctgcaacaccagtgaccccccatctgcccaggagtgctgtgactgccaggacaccacagatgagtgcatcctgcggaccagcaaggtgcggcctgccacagagcacttcaagacagccctcttcatcaccagctccatgatgctggtgctgctgctgggcgctgctgtggtggtgtggaagaagagccggggccgggtgcagcctgctgccaaggccggctatgagaagctggccgaccccaacaagagctacagcagctacaagagcagctaccgggagagcaccagctttgaggaggaccaggtgattgagtacagagaccgggactatgatgaagatgatgatgatgacatcgtgtacatgggccaggacggcaccgtgtacaggaagttcaagtatggcctgctggatgatgatgacattgatgagctggagtatgatgatgagagctacagctactaccagtag

SEQ ID NO: 165569 - DNA, 1497 bp, Artificial Sequence
  Description of Artificial Sequence: Synthetic coding sequence
atctggaatgtgcaccactgtggggacaagaacagccgctgccgctctgagatgaatgtgcaggccgcctggaagaggggctacacaggcaagaatgtggtggtgaccatcctggatgatggcatcgagaggaaccacccagacctggcccccaactatgacagctatgccagctatgatgtgaatggaaatgactatgaccccagccccaggtatgatgccagcaatgaaaacaagcacggcacccgctgtgccggggaggtggccgccagcgccaacaacagctactgcatcgtgggcatcgcctacaatgccaagattggaggcatccgcatgctggatggagatgtgacagatgtggtggaggccaagagcctgggcatccggcccaactacatcgacatctacagcgcctcctggggcccagatgatgatggcaagacagtggatggccctggccgcctggccaagcaggcctttgaatatggcatcaagaagggccggcagggcctgggcagcatctttgtgtgggccagcggaaatggaggccgggagggggactactgcagctgtgatggctacaccaacagcatctacaccatctctgtgtcctctgccacagaaaatggctacaagccctggtacctggaggagtgtgccagcaccctggccaccacctacagcagcggggccttctatgaaaggaagatcgtgaccacagacctgcggcagcgctgcacagatggccacacaggcacctctgtgtctgcccccatggtggccggcatcatcgccctggccctggaggccaacagccagctgacctggagagatgtgcagcacctgctggtgaagaccagcaggcctgcccacctgaaggccagtgactggaaggtgaatggagctggccacaaggtgagccacttctacggcttcggcctggtggatgctgaggccctggtggtggaggccaagaagtggacagctgtgcccagccagcacatgtgtgtggccgccagtgacaagaggcccaggagcatccccctggtgcaggtgctgcggaccacagccctgaccagcgcctgtgccgagcacagcgaccagagggtggtgtacctggagcacgtggtggtgaggaccagcatcagccacccccggcggggggacctgcagatctacctggtgagccccagcggcaccaagagccagctgctggccaagaggctgctggacctgagcaatgaaggcttcaccaactgggagttcatgacagtgcactgctggggcgagaaggccgagggccagtggaccctggagatccaggacctgcccagccaggtgaggaaccctgagaagcagggcgacctggagacccctgtggccaaccagctgaccacagaggagagatttgtgtccaccctgagcatcctcttccactggagcgtgtacctgtcctggagccagtaccacatcgtgctgatcaccgtggccctgtag

SEQ ID NO: 165570 - DNA, 1956 bp, Artificial Sequence
  Description of Artificial Sequence: Synthetic coding sequence
atgccaccccgggcccccccagcccctggcccccggcccccacccagggctgctgctgccacagacacagctgctggagctggaggagctgggggcgccggcggggccggcggccctggcttccggcccctggccccccggccctggcgctggctgctgctgctggccctgcctgctgcctgcagccccccacccaggcctgtgtacaccaaccactgggccgtgcaggtgctgggcggccctgctgaggccgacagagtggccgccgcccacggctacctgaacctgggccagatcggcaacctggaggactactaccacttctaccacagcaagaccttcaagaggagcaccctgagcagccggggcccccacaccttcctgaggatggacccccaggtgaagtggctgcagcagcaggaggtgaagagaagagtgaagaggcaggtgcggagtgacccccaggccctgtacttcaatgaccccatctggagcaacatgtggtacctgcactgtggggacaagaacagccgctgccgctctgagatgaatgtgcaggccgcctggaagaggggctacaccgggaagaatgtggtggtgaccatcctggatgatggcattgaaagaaaccacccagacctggcccccaactatgacagctatgccagctatgatgtgaatggaaatgactatgaccccagccccaggtatgatgccagcaatgaaaacaagcacggcacccgctgtgccggggaggtggccgccagcgccaacaacagctactgcatcgtgggcatcgcctacaatgccaagattggaggcatccgcatgctggatggagatgtgacagatgtggtggaggccaagagcctgggcatccggcccaactacatcgacatctacagcgcctcctggggcccagatgatgatggcaagacagtggatggccctggccgcctggccaagcaggcctttgaatatggcatcaagaagggccggcagggcctgggcagcatctttgtgtgggccagcggaaatggaggccgggagggggactactgcagctgtgatggctacaccaacagcatctacaccatctctgtgagcagcgccacagaaaatggctacaagccctggtacctggaggagtgtgccagcaccctggccaccacctacagcagcggggccttctatgaaaggaagatcgtgaccacagacctgcggcagcgctgcacagatggccacacaggcacctctgtgtctgcccccatggtggccggcatcatcgccctggccctggaggccaacagccagctgacctggagagatgtgcagcacctgctggtgaagaccagcaggcctgcccacctgaaggccagtgactggaaggtgaatggagctggccacaaggtgagccacttctacggcttcggcctggtggatgctgaggccctggtggtggaggccaagaagtggacagctgtgcccagccagcacatgtgtgtggccgccagtgacaagaggcccaggagcatccccctggtgcaggtgctgcggaccacagccctgaccagcgcctgtgccgagcacagcgaccagagggtggtgtacctggagcacgtggtggtgaggaccagcatcagccaccccaggagaggagacctgcagatctacctggtgagccccagcggcaccaagagccagctgctggccaagaggctgctggacctgagcaatgaaggcttcaccaactgggagttcatgacagtgcactgctggggcgagaaggccgagggccagtggaccctggagatccaggacctgcccagccaggtgagaaatcctgagaagcagggcgacctggagacccctgtggccaaccagctgaccacagaggagcgggagcccggcctgaagcacgtgttccgctggcagatcgagcaggagctgtggtag

SEQ ID NO: 165571 - DNA, 2907 bp, Artificial Sequence
  Description of Artificial Sequence: Synthetic coding sequence
atgccaccccgggcccccccagcccctggcccccggcccccacccagggctgctgctgccacagacacagctgctggagctggaggagctgggggcgccggcggggccggcggccctggcttccggcccctggccccccggccctggcgctggctgctgctgctggccctgcctgctgcctgcagccccccacccaggcctgtgtacaccaaccactgggccgtgcaggtgctgggcggccctgctgaggccgacagagtggccgccgcccacggctacctgaacctgggccagatcggcaacctggaggactactaccacttctaccacagcaagaccttcaagaggagcaccctgagcagccggggcccccacaccttcctgaggatggacccccaggtgaagtggctgcagcagcaggaggtgaagagaagagtgaagaggcaggtgcggagtgacccccaggccctgtacttcaatgaccccatctggagcaacatgtggtacctgcactgtggggacaagaacagccgctgccgctctgagatgaatgtgcaggccgcctggaagaggggctacaccgggaagaatgtggtggtgaccatcctggatgatggcattgaaagaaaccacccagacctggcccccaactatgacagctatgccagctatgatgtgaatggaaatgactatgaccccagccccaggtatgatgccagcaatgaaaacaagcacggcacccgctgtgccggggaggtggccgccagcgccaacaacagctactgcatcgtgggcatcgcctacaatgccaagattggaggcatccgcatgctggatggagatgtgacagatgtggtggaggccaagagcctgggcatccggcccaactacatcgacatctacagcgcctcctggggcccagatgatgatggcaagacagtggatggccctggccgcctggccaagcaggcctttgaatatggcatcaagaagggccggcagggcctgggcagcatctttgtgtgggccagcggaaatggaggccgggagggggactactgcagctgtgatggctacaccaacagcatctacaccatctctgtgagcagcgccacagaaaatggctacaagccctggtacctggaggagtgtgccagcaccctggccaccacctacagcagcggggccttctatgaaaggaagatcgtgaccacagacctgcggcagcgctgcacagatggccacacaggcacctctgtgtctgcccccatggtggccggcatcatcgccctggccctggaggccaacagccagctgacctggagagatgtgcagcacctgctggtgaagaccagcaggcctgcccacctgaaggccagtgactggaaggtgaatggagctggccacaaggtgagccacttctacggcttcggcctggtggatgctgaggccctggtggtggaggccaagaagtggacagctgtgcccagccagcacatgtgtgtggccgccagtgacaagaggcccaggagcatccccctggtgcaggtgctgcggaccacagccctgaccagcgcctgtgccgagcacagcgaccagagggtggtgtacctggagcacgtggtggtgaggaccagcatcagccaccccaggagaggagacctgcagatctacctggtgagccccagcggcaccaagagccagctgctggccaagaggctgctggacctgagcaatgaaggcttcaccaactgggagttcatgacagtgcactgctggggcgagaaggccgagggccagtggaccctggagatccaggacctgcccagccaggtgagaaatcctgagaagcagggcaagctgaaggagtggagcctcatcctgtatggaacagctgagcacccctaccacaccttcagcgcccaccagagccgcagcaggatgctggagctgagcgcccctgagctggagccccccaaggccgccctgagccccagccaggtggaggtgcctgaagatgaggaggactacacagcccagagcaccccaggcagcgccaacatcctgcagacctctgtgtgccacccagaatgtggggacaagggctgtgatggccccaatgctgaccagtgcctgaactgtgtgcacttcagcctgggctctgtgaagaccagcaggaaatgtgtgtctgtgtgccccctgggctactttggagacacagctgcccggcgctgccgccgctgccacaagggctgtgagacctgcagcagcagagctgccacccagtgcctgagctgcagaagaggcttctaccaccaccaggagatgaacacctgtgtgaccctgtgcccagctggcttctatgcagatgagagccagaagaactgcctgaagtgccaccccagctgcaagaagtgtgtggatgagcctgagaagtgcaccgtgtgcaaggagggcttcagcctggcccggggcagctgcatcccagactgtgagcccggcacctactttgattctgagctgatccgctgtggggagtgccaccacacctgtggcacctgtgtgggccctggccgggaggagtgcatccactgtgccaagaacttccacttccatgactggaagtgtgtgcctgcctgtggggagggcttctacccagaggagatgcctggcctgccccacaaggtgtgccgccgctgtgatgagaactgcctgagctgtgccggcagcagcaggaactgcagccgctgcaagacaggcttcacccagctgggcaccagctgcatcaccaaccacacctgcagcaatgctgatgagaccttctgtgagatggtgaagagcaaccggctgtgtgagaggaagctgttcatccagttctgctgcaggacctgcctgctggccggctag

SEQ ID NO: 165572 - DNA, 2868 bp, Artificial Sequence
  Description of Artificial Sequence: Synthetic coding sequence
atgccaccccgggcccccccagcccctggcccccggcccccacccagggctgctgctgccacagacacagctgctggagctggaggagctgggggcgccggcggggccggcggccctggcttccggcccctggccccccggccctggcgctggctgctgctgctggccctgcctgctgcctgcagccccccacccaggcctgtgtacaccaaccactgggccgtgcaggtgctgggcggccctgctgaggccgacagagtggccgccgcccacggctacctgaacctgggccagatcggcaacctggaggactactaccacttctaccacagcaagaccttcaagaggagcaccctgagcagccggggcccccacaccttcctgaggatggacccccaggtgaagtggctgcagcagcaggaggtgaagagaagagtgaagaggcaggtgcggagtgacccccaggccctgtacttcaatgaccccatctggagcaacatgtggtacctgcactgtggggacaagaacagccgctgccgctctgagatgaatgtgcaggccgcctggaagaggggctacaccgggaagaatgtggtggtgaccatcctggatgatggcattgaaagaaaccacccagacctggcccccaactatgacagctatgccagctatgatgtgaatggaaatgactatgaccccagccccaggtatgatgccagcaatgaaaacaagcacggcacccgctgtgccggggaggtggccgccagcgccaacaacagctactgcatcgtgggcatcgcctacaatgccaagattggaggcatccgcatgctggatggagatgtgacagatgtggtggaggccaagagcctgggcatccggcccaactacatcgacatctacagcgcctcctggggcccagatgatgatggcaagacagtggatggccctggccgcctggccaagcaggcctttgaatatggcatcaagaagggccggcagggcctgggcagcatctttgtgtgggccagcggaaatggaggccgggagggggactactgcagctgtgatggctacaccaacagcatctacaccatctctgtgagcagcgccacagaaaatggctacaagccctggtacctggaggagtgtgccagcaccctggccaccacctacagcagcggggccttctatgaaaggaagatcgtgaccacagacctgcggcagcgctgcacagatggccacacaggcacctctgtgtctgcccccatggtggccggcatcatcgccctggccctggaggccaacagccagctgacctggagagatgtgcagcacctgctggtgaagaccagcaggcctgcccacctgaaggccagtgactggaaggtgaatggagctggccacaaggtgagccacttctacggcttcggcctggtggatgctgaggccctggtggtggaggccaagaagtggacagctgtgcccagccagcacatgtgtgtggccgccagtgacaagaggcccaggagcatccccctggtgcaggtgctgcggaccacagccctgaccagcgcctgtgccgagcacagcgaccagagggtggtgtacctggagcacgtggtggtgaggaccagcatcagccaccccaggagaggagacctgcagatctacctggtgagccccagcggcaccaagagccagctgctggccaagaggctgctggacctgagcaatgaaggcttcaccaactgggagttcatgacagtgcactgctggggcgagaaggccgagggccagtggaccctggagatccaggacctgcccagccaggtgagaaatcctgagaagcagggcaagctgaaggagtggagcctcatcctgtatggaacagctgagcacccctaccacaccttcagcgcccaccagagccgcagcaggatgctggagctgagcgcccctgagctggagccccccaaggccgccctgagccccagccaggtggaggtgcctgaagatgaggaggactacacaggagtgtgccacccagaatgtggggacaagggctgtgatggccccaatgctgaccagtgcctgaactgtgtgcacttcagcctgggctctgtgaagaccagcaggaaatgtgtgtctgtgtgccccctgggctactttggagacacagctgcccggcgctgccgccgctgccacaagggctgtgagacctgcagcagccgggccgccacccagtgcctgagctgccggcggggcttctaccaccaccaggagatgaacacctgtgtgaccctgtgcccagctggcttctatgcagatgagagccagaagaactgcctgaagtgccaccccagctgcaagaagtgtgtggatgagcctgagaagtgcaccgtgtgcaaggagggcttcagcctggcccggggcagctgcatcccagactgtgagcccggcacctactttgacagcgagctgatccgctgtggggagtgccaccacacctgtggcacctgtgtgggccctggccgggaggagtgcatccactgtgccaagaacttccacttccatgactggaagtgtgtgcctgcctgtggggagggcttctacccagaggagatgcctggcctgccccacaaggtgtgcagaagatgtgatgagaactgcctgagctgtgccggcagcagcaggaactgcagccgctgcaagacaggcttcacccagctgggcaccagctgcatcaccaaccacacctgcagcaatgctgatgagaccttctgtgagatggtgaagagcaaccggctgtgtgagaggaagctgttcatccagttctgctgcaggacctgcctgctggccggctag

SEQ ID NO: 165573 - DNA, 1869 bp, Artificial Sequence
  Description of Artificial Sequence: Synthetic coding sequence
atgccaccccgggcccccccagcccctggcccccggcccccacccagggctgctgctgccacagacacagctgctggagctggaggagctgggggcgccggcggggccggcggccctggcttccggcccctggccccccggccctggcgctggctgctgctgctggccctgcctgctgcctgcagcgccccacccaggcctgtgtacaccaaccactgggccgtgcaggtgctgggcggccctgctgaggccgacagagtggccgccgcccacggctacctgaacctgggccagatcggcaacctggaggactactaccacttctaccacagcaagaccttcaagaggagcaccctgagcagccggggcccccacaccttcctgaggatggacccccaggtgaagtggctgcagcagcaggaggtgaagagaagagtgaagaggcaggtgcggagtgacccccaggccctgtacttcaatgaccccatctggagcaacatgtggtacctgcactgtggggacaagaacagccgctgccgctctgagatgaatgtgcaggccgcctggaagaggggctacaccgggaagaatgtggtggtgaccatcctggatgatggcattgaaagaaaccacccagacctggcccccaactatgacagctatgccagctatgatgtgaatggaaatgactatgaccccagccccaggtatgatgccagcaatgaaaacaagcacggcacccgctgtgccggggaggtggccgccagcgccaacaacagctactgcatcgtgggcatcgcctacaatgccaagattggaggcatccgcatgctggatggagatgtgacagatgtggtggaggccaagagcctgggcatccggcccaactacatcgacatctacagcgcctcctggggcccagatgatgatggcaagacagtggatggccctggccgcctggccaagcaggcctttgaatatggcatcaagaagggccggcagggcctgggcagcatctttgtgtgggccagcggaaatggaggccgggagggggactactgcagctgtgatggctacaccaacagcatctacaccatctctgtgagcagcgccacagaaaatggctacaagccctggtacctggaggagtgtgccagcaccctggccaccacctacagcagcggggccttctatgaaaggaagatcgtgaccacagacctgcggcagcgctgcacagatggccacacaggcacctctgtgtctgcccccatggtggccggcatcatcgccctggccctggaggccaacagccagctgacctggagagatgtgcagcacctgctggtgaagaccagcaggcctgcccacctgaaggccagtgactggaaggtgaatggagctggccacaaggtgagccacttctacggcttcggcctggtggatgctgaggccctggtggtggaggccaagaagtggacagctgtgcccagccagcacatgtgtgtggccgccagtgacaagaggcccaggagcatccccctggtgcaggtgctgcggaccacagccctgaccagcgcctgtgccgagcacagcgaccagagggtggtgtacctggagcacgtggtggtgaggaccagcatcagccaccccaggagaggagacctgcagatctacctggtgagccccagcggcaccaagagccagctgctggccaagaggctgctggacctgagcaatgaaggcttcaccaactgggagttcatgacagtgcactgctggggcgagaaggccgagggccagtggaccctggagatccaggacctgcccagccaggtgagaaatcctgagaagcagggcaacctggactag

SEQ ID NO: 165574 - DNA, 1584 bp, Artificial Sequence
  Description of Artificial Sequence: Synthetic coding sequence
atgtatgccctcttcctgctggccagcctgctgggcgccgccctggccggccctgtgctgggcctgaaggagtgcacccggggcagcgctgtgtggtgccagaatgtgaagacagccagtgactgtggggctgtgaagcactgcctgcagacagtgtggaacaagcccaccgtgaagagcctgccctgtgacatctgcaaggatgtggtgacagctgctggggacatgctgaaggacaatgccacagaggaggagatcctggtgtacctggagaagacctgtgactggctgcccaagcccaacatgtctgccagctgcaaggagatcgtggacagctacctgcctgtgatcctggacatcatcaagggggagatgagcaggcctggagaggtgtgcagcgccctgaacctgtgtgagagcctgcagaagcacctggccgagctgaaccaccagaagcagctggagagcaacaagatccctgagctggacatgacagaggtggtggcccccttcatggccaacatccccctgctgctgtacccccaggacggccccaggagcaagccccagcccaaggacaatggagatgtgtgccaggactgcatccagatggtgacagacatccagacagctgtgaggaccaacagcacctttgtgcaggccctggtggagcacgtgaaggaggagtgtgaccggctgggccctggcatggctgacatctgcaagaactacatcagccagtacagcgagatcgccatccagatgatgatgcacatgtctgctgagcagcccaaggagatctgtgccctggtgggcttctgtgatgaggtgaaggagatgcccatgcagaccctggtgcctgccaaggtggccagcaagaatgtcatcccagccctggagctggtggagcccatcaagaagcatgaggtgcctgccaagagtgatgtgtactgtgaggtgtgtgagttcctggtgaaggaggtgaccaagctgattgacaacaacaagacagagaaggagatcctggatgcctttgacaagatgtgcagcaagctgcccaagagcctgtctgaggagtgccaggaggtggtggacacctacggcagcagcatcctgagcatcctgctggaggaggtgtccccagagctggtgtgcagcatgctgcacctgtgcagcggcacccggctgcctgccctgactgtgcacgtgacccagcccaaggatggcggcttctgtgaggtgtgcaagaagctggtgggctacctggacaggaacctggagaagaacagcaccaagcaggagatcctggccgccctggagaagggctgcagcttcctgcctgacccctaccagaagcagtgtgaccagtttgtggccgagtatgagcctgtgctgattgagatcctggtggaggtgatggaccccagctttgtgtgcctgaagatcggggcctgccccagcgcccacaagcccctgctgggcacagagaagtgcatctggggccccagctactggtgccagaacacagaaacagctgcccagtgcaatgctgtggagcactgcaagagacatgtgtggaactag

SEQ ID NO: 165575 - DNA, 1680 bp, Artificial Sequence
  Description of Artificial Sequence: Synthetic coding sequence
atgtatgccctcttcctgctggccagcctgctgggcgccgccctggccggccctgtgctgggcctgaaggagtgcacccggggcagcgctgtgtggtgccagaatgtgaagacagccagtgactgtggggctgtgaagcactgcctgcagacagtgtggaacaagcccaccgtgaagagcctgccctgtgacatctgcaaggatgtggtgacagctgctggggacatgctgaaggacaatgccacagaggaggagatcctggtgtacctggagaagacctgtgactggctgcccaagcccaacatgtctgccagctgcaaggagatcgtggacagctacctgcctgtgatcctggacatcatcaagggggagatgagcaggcctggagaggtgtgcagcgccctgaacctgtgtgagagcctgcagaagcacctggccgagctgaaccaccagaagcagctggagagcaacaagatccctgagctggacatgacagaggtggtggcccccttcatggccaacatccccctgctgctgtacccccaggacggccccaggagcaagccccagcccaaggacaatggagatgtgtgccaggactgcatccagatggtgacagacatccagacagctgtgaggaccaacagcacctttgtgcaggccctggtggagcacgtgaaggaggagtgtgaccggctgggccctggcatggctgacatctgcaagaactacatcagccagtacagcgagatcgccatccagatgatgatgcacatgcagcccaaggagatctgtgccctggtgggcttctgtgatgaggtgaaggagatgcccatgcagaccctggtgcctgccaaggtggccagcaagaatgtcatcccagccctggagctggtggagcccatcaagaagcatgaggtgcctgccaagagtgatgtgtactgtgaggtgtgtgagttcctggtgaaggaggtgaccaagctgattgacaacaacaagacagagaaggagatcctggatgcctttgacaagatgtgcagcaagctgcccaagagcctgtctgaggagtgccaggaggtggtggacacctacggcagcagcatcctgagcatcctgctggaggaggtgtccccagagctggtgtgcagcatgctgcacctgtgcagcggcacccggctgcctgccctgactgtgcacgtgacccagcccaaggatggcggcttctgtgaggtgtgcaagaagctggtgggctacctggacaggaacctggagaagaacagcaccaagcaggagatcctggccgccctggagaagggctgcagcttcctgcctgacccctaccagaagcagtgtgaccagtttgtggccgagtatgagcctgtgctgattgagatcctggtggaggtgatggaccccagctttgtgtgcctgaagattggagcctgccccagcgcccacaagcccctgctgggcacagagaagtgcatctggggccccagctactggtgccagaacacagaaacagctgcccagtgcaatgctgtggagcactgcaagagacatgtgtggattggctgctggggcgtgggcgtgggcagctgcctgtggcccacctgggcccccaccctgctgagcaccagcggctgccaggagacagccagcaaggccagcaggacatag

SEQ ID NO: 165576 - DNA, 723 bp, Artificial Sequence
  Description of Artificial Sequence: Synthetic coding sequence
atgtatgccctcttcctgctggccagcctgctgggcgccgccctggccggccctgtgctgggcctgaaggagtgcacccggggcagcgctgtgtggtgccagaatgtgaagacagccagtgactgtggggctgtgaagcactgcctgcagacagtgtggaacaagcccaccgtgaagagcctgccctgtgacatctgcaaggatgtggtgacagctgctggggacatgctgaaggacaatgccacagaggaggagatcctggtgtacctggaggtgtccccagagctggtgtgcagcatgctgcacctgtgcagcggcacccggctgcctgccctgactgtgcacgtgacccagcccaaggatggcggcttctgtgaggtgtgcaagaagctggtgggctacctggacaggaacctggagaagaacagcaccaagcaggagatcctggccgccctggagaagggctgcagcttcctgcctgacccctaccagaagcagtgtgaccagtttgtggccgagtatgagcctgtgctgattgagatcctggtggaggtgatggaccccagctttgtgtgcctgaagattggagcctgccccagcgcccacaagcccctgctgggcacagagaagtgcatctggggccccagctactggtgccagaacacagaaacagctgcccagtgcaatgctgtggagcactgcaagagacatgtgtggaactag

SEQ ID NO: 165577 - DNA, 1581 bp, Artificial Sequence
  Description of Artificial Sequence: Synthetic coding sequence
atgtatgccctcttcctgctggccagcctgctgggcgccgccctggccggccctgtgctgggcctgaaggagtgcacccggggcagcgctgtgtggtgccagaatgtgaagacagccagtgactgtggggctgtgaagcactgcctgcagacagtgtggaacaagcccaccgtgaagagcctgccctgtgacatctgcaaggatgtggtgacagctgctggggacatgctgaaggacaatgccacagaggaggagatcctggtgtacctggagaagacctgtgactggctgcccaagcccaacatgtctgccagctgcaaggagatcgtggacagctacctgcctgtgatcctggacatcatcaagggggagatgagcaggcctggagaggtgtgcagcgccctgaacctgtgtgagagcctgcagaagcacctggccgagctgaaccaccagaagcagctggagagcaacaagatccctgagctggacatgacagaggtggtggcccccttcatggccaacatccccctgctgctgtacccccaggacggccccaggagcaagccccagcccaaggacaatggagatgtgtgccaggactgcatccagatggtgacagacatccagacagctgtgaggaccaacagcacctttgtgcaggccctggtggagcacgtgaaggaggagtgtgaccggctgggccctggcatggctgacatctgcaagaactacatcagccagtacagcgagatcgccatccagatgatgatgcacatgctgcagcagcccaaggagatctgtgccctggtgggcttctgtgatgaggtgaaggagatgcccatgcagaccctggtgcctgccaaggtggccagcaagaatgtcatcccagccctggagctggtggagcccatcaagaagcatgaggtgcctgccaagagtgatgtgtactgtgaggtgtgtgagttcctggtgaaggaggtgaccaagctgattgacaacaacaagacagagaaggagatcctggatgcctttgacaagatgtgcagcaagctgcccaagagcctgtctgaggagtgccaggaggtggtggacacctacggcagcagcatcctgagcatcctgctggaggaggtgtccccagagctggtgtgcagcatgctgcacctgtgcagcggcacccggctgcctgccctgactgtgcacgtgacccagcccaaggatggcggcttctgtgaggtgtgcaagaagctggtgggctacctggacaggaacctggagaagaacagcaccaagcaggagatcctggccgccctggagaagggctgcagcttcctgcctgacccctaccagaagcagtgtgaccagtttgtggccgagtatgagcctgtgctgattgagatcctggtggaggtgatggaccccagctttgtgtgcctgaagattggagcctgccccagcgcccacaagcccctgctgggcacagagaagtgcatctggggccccagctactggtgccagaacacagaaacagctgcccagtgcaatgctgtggagcactgcaagagacatgtgtggaactag

SEQ ID NO: 165578 - DNA, 1575 bp, Artificial Sequence
  Description of Artificial Sequence: Synthetic coding sequence
atgtatgccctcttcctgctggccagcctgctgggcgccgccctggccggccctgtgctgggcctgaaggagtgcacccggggcagcgctgtgtggtgccagaatgtgaagacagccagtgactgtggggctgtgaagcactgcctgcagacagtgtggaacaagcccaccgtgaagagcctgccctgtgacatctgcaaggatgtggtgacagctgctggggacatgctgaaggacaatgccacagaggaggagatcctggtgtacctggagaagacctgtgactggctgcccaagcccaacatgtctgccagctgcaaggagatcgtggacagctacctgcctgtgatcctggacatcatcaagggggagatgagcaggcctggagaggtgtgcagcgccctgaacctgtgtgagagcctgcagaagcacctggccgagctgaaccaccagaagcagctggagagcaacaagatccctgagctggacatgacagaggtggtggcccccttcatggccaacatccccctgctgctgtacccccaggacggccccaggagcaagccccagcccaaggacaatggagatgtgtgccaggactgcatccagatggtgacagacatccagacagctgtgaggaccaacagcacctttgtgcaggccctggtggagcacgtgaaggaggagtgtgaccggctgggccctggcatggctgacatctgcaagaactacatcagccagtacagcgagatcgccatccagatgatgatgcacatgcagcccaaggagatctgtgccctggtgggcttctgtgatgaggtgaaggagatgcccatgcagaccctggtgcctgccaaggtggccagcaagaatgtcatcccagccctggagctggtggagcccatcaagaagcatgaggtgcctgccaagagtgatgtgtactgtgaggtgtgtgagttcctggtgaaggaggtgaccaagctgattgacaacaacaagacagagaaggagatcctggatgcctttgacaagatgtgcagcaagctgcccaagagcctgtctgaggagtgccaggaggtggtggacacctacggcagcagcatcctgagcatcctgctggaggaggtgtccccagagctggtgtgcagcatgctgcacctgtgcagcggcacccggctgcctgccctgactgtgcacgtgacccagcccaaggatggcggcttctgtgaggtgtgcaagaagctggtgggctacctggacaggaacctggagaagaacagcaccaagcaggagatcctggccgccctggagaagggctgcagcttcctgcctgacccctaccagaagcagtgtgaccagtttgtggccgagtatgagcctgtgctgattgagatcctggtggaggtgatggaccccagctttgtgtgcctgaagattggagcctgccccagcgcccacaagcccctgctgggcacagagaagtgcatctggggccccagctactggtgccagaacacagaaacagctgcccagtgcaatgctgtggagcactgcaagagacatgtgtggaactag

SEQ ID NO: 165579 - DNA, 1353 bp, Artificial Sequence
  Description of Artificial Sequence: Synthetic coding sequence
atgctgaaggacaatgccacagaggaggagatcctggtgtacctggagaagacctgtgactggctgcccaagcccaacatgtctgccagctgcaaggagatcgtggacagctacctgcccgtcatcctggacatcatcaagggggagatgagcaggcctggagaggtgtgcagcgccctgaacctgtgtgagagcctgcagaagcacctggccgagctgaaccaccagaagcagctggagagcaacaagatccctgagctggacatgacagaggtggtggcccccttcatggccaacatccccctgctgctgtacccccaggacggccccaggagcaagccccagcccaaggacaatggagatgtgtgccaggactgcatccagatggtgacagacatccagacagctgtgaggaccaacagcacctttgtgcaggccctggtggagcacgtgaaggaggagtgtgaccggctgggccctggcatggctgacatctgcaagaactacatcagccagtacagcgagatcgccatccagatgatgatgcacatgcagcagcccaaggagatctgtgccctggtgggcttctgtgatgaggtgaaggagatgcccatgcagaccctggtgcctgccaaggtggccagcaagaatgtcatcccagccctggagctggtggagcccatcaagaagcatgaggtgcctgccaagagtgatgtgtactgtgaggtgtgtgagttcctggtgaaggaggtgaccaagctgattgacaacaacaagacagagaaggagatcctggatgcctttgacaagatgtgcagcaagctgcccaagagcctgtctgaggagtgccaggaggtggtggacacctacggcagcagcatcctgagcatcctgctggaggaggtgtccccagagctggtgtgcagcatgctgcacctgtgcagcggcacccggctgcctgccctgactgtgcacgtgacccagcccaaggatggcggcttctgtgaggtgtgcaagaagctggtgggctacctggacaggaacctggagaagaacagcaccaagcaggagatcctggccgccctggagaagggctgcagcttcctgcctgacccctaccagaagcagtgtgaccagtttgtggccgagtatgagcctgtgctgattgagatcctggtggaggtgatggaccccagctttgtgtgcctgaagattggagcctgccccagcgcccacaagcccctgctgggcacagagaagtgcatctggggccccagctactggtgccagaacacagaaacagctgcccagtgcaatgctgtggagcactgcaagagacatgtgtggaactag

SEQ ID NO: 165580 - DNA, 1593 bp, Artificial Sequence
  Description of Artificial Sequence: Synthetic coding sequence
gatggagccatgtatgccctcttcctgctggccagcctgctgggcgccgccctggccggccctgtgctgggcctgaaggaatgtacccggggcagcgctgtgtggtgccagaatgtgaagacagccagtgactgtggggctgtgaagcactgcctgcagacagtgtggaacaagcccaccgtgaagagcctgccctgtgacatctgcaaggatgtggtgacagctgctggggacatgctgaaggacaatgccacagaggaggagatcctggtgtacctggagaagacctgtgactggctgcccaagcccaacatgtctgccagctgcaaggagatcgtggacagctacctgcccgtcatcctggacatcatcaagggggagatgagcaggcctggagaggtgtgcagcgccctgaacctgtgtgagagcctgcagaagcacctggccgagctgaaccaccagaagcagctggagagcaacaagatccctgagctggacatgacagaggtggtggcccccttcatggccaacatccccctgctgctgtacccccaggacggccccaggagcaagccccagcccaaggacaatggagatgtgtgccaggactgcatccagatggtgacagacatccagacagctgtgaggaccaacagcacctttgtgcaggccctggtggagcacgtgaaggaggagtgtgaccggctgggccctggcatggctgacatctgcaagaactacatcagccagtacagcgagatcgccatccagatgatgatgcacatgtctgctgagcagcccaaggagatctgtgccctggtgggcttctgtgatgaggtgaaggagatgcccatgcagaccctggtgcctgccaaggtggccagcaagaatgtcatcccagccctggagctggtggagcccatcaagaagcatgaggtgcctgccaagagtgatgtgtactgtgaggtgtgtgagttcctggtgaaggaggtgaccaagctgattgacaacaacaagacagagaaggagatcctggatgcctttgacaagatgtgcagcaagctgcccaagagcctgtctgaggagtgccaggaggtggtggacacctacggcagcagcatcctgagcatcctgctggaggaggtgtccccagagctggtgtgcagcatgctgcacctgtgcagcggcacccggctgcctgccctgactgtgcacgtgacccagcccaaggatggcggcttctgtgaggtgtgcaagaagctggtgggctacctggacaggaacctggagaagaacagcaccaagcaggagatcctggccgccctggagaagggctgcagcttcctgcctgacccctaccagaagcagtgtgaccagtttgtggccgagtatgagcctgtgctgattgagatcctggtggaggtgatggaccccagctttgtgtgcctgaagattggagcctgccccagcgcccacaagcccctgctgggcacagagaagtgcatctggggccccagctactggtgccagaacacagaaacagctgcccagtgcaatgctgtggagcactgcaagagacatgtgtggaactag

SEQ ID NO: 165581 - DNA, 2214 bp, Artificial Sequence
  Description of Artificial Sequence: Synthetic coding sequence
atgccagaccatgacagcacagccctgctgagccggcagaccaagagaagaagagtggacattggagtgaagaggacagtgggcacagccagcgccttctttgccaaggcccgggccaccttcttcagcgccatgaacccccagggcagcgagcaggatgtggagtacagcgtggtgcagcacgcagatggagagaagagcaatgtgctgaggaagctgctgaagagggccaacagctatgaagatgccatgatgcccttccctggggccaccatcatcagccagctgctgaagaacaacatgaacaagaatggaggaacagagcccagcttccaggccagcggcctgagcagcactggaagtgaggtgcaccaggaggacatctgcagcaacagcagccgggacagccccccagaatgtctgagccccttcggccggcccaccatgagccagtttgacatggaccggctgtgtgatgagcacctgcgggccaagagggcccgggtggagaacatcatccggggcatgagccacagccccagcgtggccctgcggggaaatgaaaatgaaagagagatggccccccagagcgtgagcccccgggagagctaccgggagaacaagaggaagcagaagctgccccagcagcagcagcagagcttccagcagctggtgtctgccaggaaggagcagaagcgggaggagcggcggcagctgaagcagcagctggaggacatgcagaagcagctgcggcagctgcaggagaagttctaccagatctatgacagcacagacagtgaaaatgatgaagatggcaacctgtctgaggacagcatgaggtctgagatcctggatgcccgggcccaggacagcgtgggccgcagtgacaatgagatgtgtgagctggaccccggccagttcatcgaccgggcccgggccctgatccgggagcaggagatggccgagaacaagcccaagcgggagggcaacaacaaggagcgggaccacggccccaacagcctgcagcctgagggcaagcacctggccgagaccctgaagcaggagctgaacacagccatgagccaggtggtggacacagtggtgaaggtgttcagcgccaagcccagccggcaggtgccccaggtgttcccccccctgcagatcccccaggccaggtttgctgtgaatggagagaaccacaacttccacacagccaaccagaggctgcagtgctttggagatgtgatcatccccaaccccctggacacctttggaaatgtgcagatggccagcagcacagaccagacagaggccctgcccctggtggtgaggaagaacagcagtgaccagagcgccagcggccctgctgctgggggccaccaccagcccctgcaccagagccccctgagcgccaccaccggcttcaccaccagcaccttccgccaccccttccccctgcccctgatggcctaccccttccagagccccctgggcgcccccagcggcagcttcagcggcaaggaccgggccagccctgagagcctggacctgacccgggacaccaccagcctgcggaccaagatgagcagccaccacctgagccaccacccctgcagccctgcccacccccccagcacagctgagggcctgagcctgagcctcatcaagtcagaatgtggggacctgcaggacatgtctgagatcagcccctacagcggcagcgccatgcaggagggcctgagccccaaccacctgaagaaggccaagctgatgttcttctacacccgctaccccagcagcaacatgctgaagacctacttcagtgatgtgaagttcaaccgctgcatcaccagccagctgatcaagtggttcagcaacttccgggagttctactacatccagatggagaagtatgcccggcaggccatcaatgatggagtgaccagcacagaggagctgagcatcacccgggactgtgagctgtaccgggccctgaacatgcactacaacaaggccaatgactttgaggtgcctgagcgcttcctggaggtggcccagatcaccctgcgggagttcttcaatgccatcatcgccggcaaggatgtggaccccagctggaagaaggccatctacaaggtgatctgcaagctggacagcgaggtgcctgagatcttcaagagccccaactgcctgcaggagctgctgcacgagtag

SEQ ID NO: 165582 - DNA, 2031 bp, Artificial Sequence
  Description of Artificial Sequence: Synthetic coding sequence
atgccagaccatgacagcacagccctgctgagccggcagaccaagagaagaagagtggacattggagtgaagaggacagtgggcacagccagcgccttctttgccaaggcccgggccaccttcttcagcgccatgaacccccagggcagcgagcaggatgtggagtacagcgtggtgcagcacgcagatggagagaagagcaatgtgctgaggaagctgctgaagagggccaacagctatgaagatgccatgatgcccttccctggggccaccatcatcagccagctgctgaagaacaacatgaacaagaatggaggaacagagcccagcttccaggccagcggcctgagcagcactggaagtgaggtgcaccaggaggacatctgcagcaacagcagccgggacagccccccagaatgtctgagccccttcggccggcccaccatgagccagtttgacatggaccggctgtgtgatgagcacctgcgggccaagagggcccgggtggagaacatcatccggggcatgagccacagccccagcgtggccctgcggggaaatgaaaatgaaagagagatggccccccagagcgtgagcccccgggagagctaccgggagaacaagaggaagcagaagctgccccagcagcagcagcagagcttccagcagctggtgtctgccaggaaggagcagaagcgggaggagcggcggcagctgaagcagcagctggaggacatgcagaagcagctgcggcagctgcaggagaagttctaccagatctatgacagcacagacagtgaaaatgatgaagatggcaacctgtctgaggacagcatgaggtctgagatcctggatgcccgggcccaggacagcgtgggccgcagtgacaatgagatgtgtgagctggaccccggccagttcatcgaccgggcccgggccctgatccgggagcaggagatggccgagaacaagcccaagcgggagggcaacaacaaggagcgggaccacggccccaacagcctgcagcctgagggcaagcacctggccgagaccctgaagcaggagctgaacacagccatgagccaggtggtggacacagtggtgaaggtgttcagcgccaagcccagccggcaggtgccccaggtgttcccccccctgcagatcccccaggccaggtttgctgtgaatggagagaaccacaacttccacacagccaaccagaggctgcagtgctttggagatgtgatcatccccaaccccctggacacctttggaaatgtgcagatggccagcagcacagaccagacagaggccctgcccctggtggtgaggaagaacagcagtgaccagagcgccagcggccctgctgctgggggccaccaccagcccctgcaccagagccccctgagcgccaccaccggcttcaccaccagcaccttccgccaccccttccccctgcccctgatggcctaccccttccagagccccctgggcgcccccagcggcagcttcagcggcaaggaccgggccagccctgagagcctggacctgacccgggacaccaccagcctgcggaccaagatgagcagccaccacctgagccaccacccctgcagccctgcccacccccccagcacagctgagggcctgagcctgagcctcatcaagtcagaatgtggggacctgcaggacatgtctgagatcagcccctacagcggcagcgccatgcaggagggcctgagccccaaccacctgaagaaggccaagctgatgttcttctacacccgctaccccagcagcaacatgctgaagacctacttcagtgatgtgaagttcaaccgctgcatcaccagccagctgatcaagtggttcagcaacttccgggagttctactacatccagatggagaagtatgcccggcaggccatcaatgatggagtgaccagcacagaggagctgagcatcacccgggactgtgagctgtaccgggccctgaacatgcactacaacaaggccaatgactttgaatag

SEQ ID NO: 165583 - DNA, 2214 bp, Artificial Sequence; identical to SEQ ID NO: 165581
  Description of Artificial Sequence: Synthetic coding sequence

SEQ ID NO: 165584 - DNA, 693 bp, Artificial Sequence
  Description of Artificial Sequence: Synthetic coding sequence
atgccagaccatgacagcacagccctgctgagccggcagaccaagagaagaagagtggacattggagtgaagaggacagtgggcacagccagcgccttctttgccaaggcccgggccaccttcttcagcgccatgaacccccagggcagcgagcaggatgtggagtacagcgtggtgcagcacgcagatggagagaagagcaatgtgctgaggaagctgctgaagagggccaacagctatgaagatgccatgatgcccttccctggggccaccatcatcagccagctgctgaagaacaacatgaacaagaatggaggaacagagcccagcttccaggccagcggcctgagcagcactggaagtgaggtgcaccaggaggacatctgcagcaacagcagccgggacagccccccagaatgtctgagccccttcggccggcccaccatgagccagtttgacatggaccggctgtgtgatgagcacctgcgggccaagagggcccgggtggagaacatcatccggggcatgagccacagccccagcgtggccctgcggggaaatgaaaatgaaagagagatggccccccagagcgtgagcccccgggagagctaccgggagaacaagaggaagcagaagctgccccagcagcagcagcagagcttccagcagctggtgtctgccaggaaggagtag

SEQ ID NO: 165585 - DNA, 2214 bp, Artificial Sequence; identical to SEQ ID NO: 165581
  Description of Artificial Sequence: Synthetic coding sequence

SEQ ID NO: 165586 - DNA, 930 bp, Artificial Sequence
  Description of Artificial Sequence: Synthetic coding sequence
atggccagcagcacagaccagacagaggccctgcccctggtggtgaggaagaacagcagtgaccagagcgccagcggccctgctgctgggggccaccaccagcccctgcaccagagccccctgagcgccaccaccggcttcaccaccagcaccttccgccaccccttccccctgcccctgatggcctaccccttccagagccccctgggcgcccccagcggcagcttcagcggcaaggaccgggccagccctgagagcctggacctgacccgggacaccaccagcctgcggaccaagatgagcagccaccacctgagccaccacccctgcagccctgcccacccccccagcacagctgagggcctgagcctgagcctcatcaagtcagaatgtggggacctgcaggacatgtctgagatcagcccctacagcggcagcgccatgcaggagggcctgagccccaaccacctgaagaaggccaagctgatgttcttctacacccgctaccccagcagcaacatgctgaagacctacttcagtgatgtgaagttcaaccgctgcatcaccagccagctgatcaagtggttcagcaacttccgggagttctactacatccagatggagaagtatgcccggcaggccatcaatgatggagtgaccagcacagaggagctgagcatcacccgggactgtgagctgtaccgggccctgaacatgcactacaacaaggccaatgactttgaggtgcctgagcgcttcctggaggtggcccagatcaccctgcgggagttcttcaatgccatcatcgccggcaaggatgtggaccccagctggaagaaggccatctacaaggtgatctgcaagctggacagcgaggtgcctgagatcttcaagagccccaactgcctgcaggagctgctgcacgagtag

SEQ ID NO: 165587 - DNA, 1080 bp, Artificial Sequence
  Description of Artificial Sequence: Synthetic coding sequence
atgaagagccccttctaccgctgccagaacaccacctctgtggagaagggcaacagcgctgtgatgggcggcgtgctcttcagcacaggcctgctgggcaacctgctggccctgggcctgctggcccggagcggcctgggctggtgcagcagaagacccctgcggcccctgcccagcgtcttctacatgctggtgtgtggcctgactgtgacagacctgctgggcaagtgcctgctgagccctgtggtgctggccgcctatgcccagaacagaagcctgcgggtgctggccccagccctggacaacagcctgtgccaggcctttgccttcttcatgtccttcttcggcctgagcagcaccctgcagctgctggccatggccctggagtgctggctgagcctgggccaccccttcttctacagaagacacatcaccctgcggctgggcgccctggtggcccctgtggtgtctgccttcagcctggccttctgtgccctgcccttcatgggctttgggaagtttgtgcagtactgccccggcacctggtgcttcatccagatggtgcatgaggagggcagcctgtctgtgctgggctacagcgtgctgtacagcagcctgatggccctgctggtgctggccaccgtgctgtgcaacctgggcgccatgaggaacctgtatgccatgcaccggcggctgcagaggcaccccaggagctgcacccgggactgtgccgagcccagggcagatggccgggaggccagcccccagcccctggaggagctggaccacctgctgctgctggccctgatgacagtgctcttcaccatgtgcagcctgcccgtcatctaccgggcctactatggagccttcaaggatgtgaaggagaagaacagaaccagcgaggaggccgaggacctgcgggccctgcgcttcctgagcgtcatcagcatcgtggacccctggatcttcatcatcttccgcagccctgtgttccgcatcttcttccacaagatcttcatccggcccctgcgctaccgcagccgctgcagcaacagcaccaacatggagagcagcctgtag

SEQ ID NO: 165588 - DNA, 8034 bp, Artificial Sequence
  Description of Artificial Sequence: Synthetic coding sequence
atgagcacctgctgctggtgcaccccaggaggagccagcaccatcgacttcctgaagagatatgccagcaacaccccatctggagagttccagacagcagatgaggacctgtgctactgcctggagtgtgtggccgagtaccacaaggccagagatgagctgcccttcctgcacgaggtgctgtgggagctggagaccctgcggctcatcaaccactttgagaagtccatgaaggccgagattggagatgatgatgagctgtacatcgtggacaacaatggagagatgcccctgtttgacatcaccggccaggactttgagaacaagctgcgggtgcccctgctggagatcctgaagtacccctacctgctgctgcacgagcgggtgaatgagctgtgtgtggaggccctgtgcaggatggagcaggccaactgcagcttccaggtgtttgacaagcaccctggcatctacctgttcctggtgcaccccaatgagatggtgcggcgctgggccatcctgacagccaggaacctgggcaaggtggacagagatgactactatgacctgcaggaggtgctgctgtgcctcttcaaggtgattgagctgggcctgctggagagcccagacatctacaccagctctgtgctggagaagggcaagctgatcctgctgcccagccacatgtatgacaccaccaactacaagagctactggctgggcatctgcatgctgctgaccatcctggaggagcaggccatggacagcctgctgctgggcagtgacaagcagaatgacttcatgcagagcatcctgcacaccatggagcgggaggctgatgatgacagcgtggaccccttctggccagccctgcactgcttcatggtgatcctggaccggctgggcagcaaggtgtggggccagctgatggaccccatcgtggccttccagaccatcatcaacaatgccagctacaaccgggagatccgccacatccggaacagctctgtgaggaccaagctggagcctgagagctacctggatgacatggtgacctgcagccagatcgtgtacaactacaaccctgagaagaccaagaaggacagcggctggaggacagccatctgcccagactactgccccaacatgtatgaggagatggagaccctggcctctgtgctgcagagcgacatcggccaggacatgagggtgcacaacagcaccttcctgtggttcatcccctttgtgcagagcctgatggacctgaaggacctgggcgtggcctacatcgcccaggtggtgaaccacctgtacagcgaggtgaaggaggtgctgaaccagacagatgctgtgtgtgacaaggtgacagagttcttcctgctgatcctggtgtctgtcatcgagctgcacaggaacaagaagtgcctgcacctgctgtgggtgagcagccagcagtgggtggaggccgtggtgaagtgtgccaagctgcccaccacagccttcaccaggagcagcgagaagagcagcggcaactgcagcaaaggaacagccatgatcagcagcctgagcctgcacagcatgcccagcaacagcgtgcagctggcctacgtgcagctgatccgcagcctgctgaaggagggctaccagctgggccagcagagcctgtgcaagcgcttctgggacaagctgaacctcttcctgcggggcaacctgagcctgggctggcagctgaccagccaggagacccatgagctgcagagctgcctgaagcagatcatccggaacatcaagttcaaggccccaccctgcaacacctttgtggacctgaccagcgcctgcaagatcagccctgccagctacaacaaggaggagagcgagcagatgggcaagaccagcaggaaggacatgcactgcctggaggccagcagccccaccttcagcaaggagcccatgaaggtgcaggacagcgtgctgatcaaggctgacaacaccatcgagggggacaacaatgagcagaactacatcaaggatgtgaagctggaggaccacctgctggccggcagctgcctgaagcagagcagcaagaacatcttcacagaaagagctgaggaccagatcaagatcagcaccaggaagcagaagtctgtgaaggagatcagcagctacacccccaaggactgcaccagcagaaatggacctgagcggggctgtgaccggggcatcatcgtgtccacccggctgctgacagacagcagcacagatgccctggagaaggtgtccaccagcaatgaagacttcagcctgaaggatgatgccctggccaagaccagcaagaggaagaccaaggtgcagaaggatgagatctgtgccaagctgagccacgtgatcaagaagcagcacaggaagagcaccctggtggacaacaccatcaacctggatgagaacctgactgtgagcaacatcgagagcttctacagcaggaaggacacaggagtgcagaagggagatggcttcatccacaacctgagcctggaccccagcggcgtgctggatgacaagaatggagagcagaagagccagaacaacgtgctgcccaaggagaagcagctgaagaatgaggagctggtgatcttctccttccacgagaacaactgcaagatccaggagttccacgtggatggcaaggagctgatccccttcacagagatgaccaatgccagcgagaagaagagcagccccttcaaggacctgatgacagtgcctgagagcagagatgaggagatgagcaacagcaccagcgtcatctacagcaacctgacccgggagcaggccccagacatcagccccaagagtgacaccctgacagacagccagattgaccgggacctgcacaagctgagcctgctggcccaggccagcgtcatcaccttccccagcgacagcccccagaacagcagccagctgcagaggaaggtgaaggaggacaagcgctgcttcaccgccaaccagaacaacgtgggggacaccagccggggccaggtgatcatcatcagtgacagtgatgatgatgatgatgagcgcatcctgagcctggagaagctgaccaagcaggacaagatctgcctggagcgggagcaccctgagcagcacgtgtccacagtgaacagcaaggaggagaagaaccctgtgaaggaggagaagacagagaccctcttccagtttgaggagagtgacagccagtgctttgaatttgagagcagcagcgaggtgttttctgtgtggcaggaccacccagatgacaacaacagcgtgcaggatggagagaagaagtgcctggcccccatcgccaacaccaccaacggccagggctgcacagattatgtgtctgaggtggtgaagaagggagctgagggcatcgaggagcacacccggcccaggagcatctctgtggaggagttctgtgaaattgaggtgaagaagcccaagaggaagaggtctgagaagcccatggctgaagatcctgtgcggcccagcagctctgtgagaaatgaaggccagagcgacaccaacaagagggacctggtgggcaatgacttcaagagcattgacaggaggaccagcacccccaacagccgcatccagagggccaccaccgtgtcccagaagaagagcagcaagctgtgcacctgcacagagcccatcaggaaggtgcctgtgtccaagacccccaagaagacccacagtgatgccaagaagggccagaacagaagcagcaactacctgagctgcaggaccaccccagccatcgtgccccccaagaagttccggcagtgcccagagcccaccagcacagctgagaagctgggcctgaagaagggccccaggaaggcctatgagctgagccagaggagcctggactatgtggcccagctgcgggaccacggcaagacagtgggcgtggtggacaccaggaagaagaccaagctgatcagcccccagaacctgtctgtgaggaacaacaagaagctgctgaccagccaggagctgcagatgcagaggcagatccggcccaagagccagaagaacagaagaaggctgagtgactgtgagagcacagatgtgaagagagctggcagccacacagcccagaacagcgacatctttgtgcctgagagtgacagaagtgactacaactgcacaggaggaacagaggtgctggccaacagcaacaggaagcagctgatcaagtgcatgcccagcgagcctgagaccatcaaggccaagcacggcagccctgccacagatgatgcctgccccctgaaccagtgtgacagcgtggtgctgaatggcaccgtgcccaccaatgaggtgattgtgtccaccagcgaggaccccctgggcggcggggaccccacagcccggcacatcgagatggccgccctgaaggagggggagccagacagcagcagtgatgctgaggaggacaacctcttcctgacccagaatgaccctgaggacatggacctgtgcagccagatggagaatgacaactacaagctgattgagctgatccacggcaaggacacagtggaggtggaggaggacagcgtgtcccggccccagctggagagcctgagcggcaccaagtgcaagtacaaggactgcctggagaccaccaagaaccagggcgagtactgccccaagcacagcgaggtgaaggccgcagatgaagatgtgttcaggaagccaggcctgcccccaccagccagcaagcccctgcggcccaccaccaagatcttcagcagcaagagcaccagcagaattgctggcctgagcaagagcctggagaccagcagcgccctgagccccagcctgaagaacaagagcaagggcatccagagcatcctgaaggtgccccagcctgtgcccctcatcgcccagaagcctgtgggggagatgaagaacagctgcaatgtgctgcacccccagagccccaacaacagcaaccggcagggctgcaaggtgccctttggagagagcaagtacttccccagcagcagccctgtgaacatcctgctgagcagccagagcgtgtctgacacctttgtgaaggaggtgctgaagtggaagtatgagatgttcctgaactttggccagtgtggccccccagccagcctgtgccagagcatcagcaggcctgtgcctgtgcgcttccacaactacggggactacttcaacgtgttcttccccctgatggtgctgaacacctttgagaccgtggcccaggagtggctgaacagccccaaccgggagaacttctaccagctgcaggtgaggaagtttcctgctgactacatcaagtactgggagtttgctgtgtacctggaggagtgtgagctggccaagcagctgtaccccaaggaaaatgacctggtgttcctggcccctgagcgcatcaatgaggagaagaaggacacagaaagaaatgacatccaggacctgcacgagtaccacagcggctacgtgcacaagttccggaggacctctgtgatgagaaatggcaagacagagtgctacctgagcatccagacccaggagaacttccctgccaacctgaatgagctggtgaactgcatcgtcatcagcagcctggtgaccacccagaggaagctgaaggccatgagcctgctgggcagcaggaaccagctggcccgggctgtgctgaaccccaaccccatggacttctgcaccaaggacctgctgaccaccaccagcgagcgcatcatcgcctacctgcgggacttcaatgaagaccagaagaaggccatcgagacagcctatgccatggtgaagcacagccccagcgtggccaagatctgcctgatccacggccccccaggcaccgggaagagcaagaccatcgtgggcctgctgtaccgcctgctgacagagaaccagaggaagggccacagtgatgagaacagcaatgccaagatcaagcagaacagagtgctggtgtgtgcccccagcaatgctgctgtggatgagctgatgaagaagatcatcctggagttcaaggagaagtgcaaggacaagaagaaccccctgggcaactgtggggacatcaacctggtgcggctgggccctgagaagagcatcaacagcgaggtgctgaagttcagcctggacagccaggtgaaccacaggatgaagaaggagctgcccagccacgtgcaggccatgcacaagaggaaggagttcctggactaccagctggatgagctgagccggcagagggccctgtgccggggcggccgggagatccagaggcaggagctggatgagaacatcagcaaggtgtccaaggagcggcaggagctggccagcaagatcaaggaggtgcagggccggccccagaagacccagagcatcatcatcctggagagccacatcatctgctgcaccctgagcaccagcggcggcctgctgctggagagcgccttccggggccagggcggcgtgcccttcagctgtgtgattgtggatgaagctggccagagctgtgaaattgagaccctgacccccctcatccaccgctgcaacaagctgatcctggtgggggaccccaagcagctgccccccaccgtcatctccatgaaggcccaggagtatggctatgaccagagcatgatggcccgcttctgccgcctgctggaggagaatgtggagcacaacatgatcagccggctgcccatcctgcagctgactgtgcagtacaggatgcacccagacatctgcctcttccccagcaactacgtgtacaacagaaacctgaagaccaaccggcagacagaggccatccgctgcagcagtgactggcccttccagccctacctggtgtttgatgtgggagatggcagcgagcggcgggacaatgacagctacatcaacgtgcaggagatcaagctggtgatggagatcatcaagctgatcaaggacaagaggaaggatgtgtccttcaggaacatcggcatcatcacccactacaaggcccagaagaccatgatccagaaggacctggacaaggagtttgacaggaagggccctgctgaggtggacacagtggatgccttccagggccggcagaaggactgtgtgattgtgacctgtgtgcgggccaacagcatccagggcagcatcggcttcctggccagcctgcagaggctgaatgtgaccatcacccgggccaagtacagcctcttcatcctgggccacctgcggaccctgatggagaaccagcactggaaccagctgatccaggatgcccagaagagaggagccatcatcaagacctgtgacaagaactacagacatgatgctgtgaagatcctgaagctgaagcctgtgctgcagaggagcctgacccacccccccaccatcgcccctgagggcagccggccccagggcggcctgcccagcagcaagctggacagcggctttgccaagacctctgtggccgccagcctgtaccacacccccagcgacagcaaggagatcaccctgactgtgaccagcaaggaccctgagcggccccctgtgcatgaccagctgcaggacccccggctgctgaagaggatgggcatcgaggtgaagggcggcatcttcctgtgggacccccagcccagcagcccccagcaccctggggccaccccacccaccggggagcccggcttccctgtggtgcaccaggacctgagccacatccagcagcctgctgctgtggtggccgccctgagcagccacaagccccctgtgcggggggagcccccagctgccagccctgaggccagcacctgccagagcaaatgtgatgatcctgaggaggagctgtgccaccggcgggaggcccgggccttcagcgagggggagcaggagaagtgtggcagcgagacccaccacaccaggaggaacagccgctgggacaagaggaccctggagcaggaggacagcagcagcaagaagaggaagctgctgtag

SEQ ID NO: 165589 - DNA, 483 bp, Artificial Sequence
  Description of Artificial Sequence: Synthetic coding sequence
atggccacccaccacaccctgtggatgggcctggccctgctgggcgtgctgggggacctgcaggccgcccctgaggcccaggtgtctgtgcagcccaacttccagcaggacaagttcctgggccgctggttctctgctggcctggccagcaacagctcctggctgcgggagaagaaggccgccctgtccatgtgcaagtctgtggtggccccagccacagatggcggcctgaacctgaccagcaccttcctgaggaagaaccagtgtgagaccaggaccatgctgctgcagcctgctggcagcctgggcagctacagctaccgcagcccccgggagtggggcctgcaccggcccccaggccccagcctgggcgccaccctggccggcaccaccctgggccagcccccagctgctgagatccatggagtgggcggagatggctgccccacctctgtgcggggcaagggccaggcctgggcctag

SEQ ID NO: 165590 - DNA, 573 bp, Artificial Sequence
  Description of Artificial Sequence: Synthetic coding sequence
atggccacccaccacaccctgtggatgggcctggccctgctgggcgtgctgggggacctgcaggccgcccctgaggcccaggtgtctgtgcagcccaacttccagcaggacaagttcctgggccgctggttctctgctggcctggccagcaacagctcctggctgcgggagaagaaggccgccctgtccatgtgcaagtctgtggtggccccagccacagatggcggcctgaacctgaccagcaccttcctgaggaagaaccagtgtgagaccaggaccatgctgctgcagcctgctggcagcctgggcagctacagctaccgcagcccccactggggcagcacctacagcgtgtctgtggtggagacagattatgaccagtatgccctgctgtacagccagggcagcaaaggacctggagaggacttcaggatggccaccctgtacagcaggacccagacccccagggctgagctgaaggagaagttcaccgccttctgcaaggcccagggcttcacagaggacaccatcgtgttcctgccccagacagacaagtgcatgacagagcagtag

SEQ ID NO: 165591 - DNA, 189 bp, Artificial Sequence
  Description of Artificial Sequence: Synthetic coding sequence
tgaggctaccactgcctgcctgcccccaacagagcccagggcgaggtgggcggagatggcggctctgtgcagtttggaggctctgtgaagaccagcagcgccctgcgggaggagcaggaggcccagtgggagaactggcccaagtctggagtgctgaccacagcccctggcttcttcctgggccgctag

SEQ ID NO: 165592 - DNA, 642 bp, Artificial Sequence
  Description of Artificial Sequence: Synthetic coding sequence
tgactgcggggcggcggccagttcctgggccggggcgtgcggggcgtggccgcccggggcatcggccggggcggcggggccggcctggagactggaggagtggatggccgcggggccccagctggaagaagacgctgggtgcggcgggtgctggctgatgctgggggcggccgcagcccccagttcctgggccgctggttctctgctggcctggccagcaacagctcctggctgcgggagaagaaggccgccctgtccatgtgcaagtctgtggtggccccagccacagatggcggcctgaacctgaccagcaccttcctgaggaagaaccagtgtgagaccaggaccatgctgctgcagcctgctggcagcctgggcagctacagctaccgcagcccccactggggcagcacctacagcgtgtctgtggtggagacagattatgaccagtatgccctgctgtacagccagggcagcaagggccctggagaggacttcaggatggccaccctgtacagcaggacccagacccccagggctgagctgaaggagaagttcaccgccttctgcaaggcccagggcttcacagaggacaccatcgtgttcctgccccagacagacaagtgcatgacagagcagtag

SEQ ID NO: 165593 - DNA, 588 bp, Artificial Sequence
  Description of Artificial Sequence: Synthetic coding sequence
atggccacccaccacaccctgtggatgggcctggccctgctgggcgtgctgggggacctgcaggccgcccctgaggcccaggtgtctgtgcagcccaacttccagcaggacaagttcctgggccgctggttctctgctggcctggccagcaacagctcctggctgcgggagaagaaggccgccctgtccatgtgcaagtctgtggtggccccagccacagatggcggcctgaacctgaccagcaccttcctgaggaagaaccagtgtgagaccaggaccatgctgctgcagcctgctggcagcctgggcagctacagctaccgcagcccccgggagtggggcctgcaccggcccccaggccccagcctgggcgccaccctggccggcaccaccctgggccagcccccagctgctgagatccatggagtgggggactggggcagcacctacagcgtgtctgtggtggagacagattatgaccagtatgccctgctgtacagccagggcagcaaaggacctggagaggacttcaggatggccaccctgtacagcaggacccagacccccagggctgagctgaaggagtag

SEQ ID NO: 165594 - DNA, 573 bp, Artificial Sequence; identical to SEQ ID NO: 165590
  Description of Artificial Sequence: Synthetic coding sequence

SEQ ID NO: 165595 - DNA, 1209 bp, Artificial Sequence
  Description of Artificial Sequence: Synthetic coding sequence
atgagcccctgtggccccctgaacctgagcctggccggggaggccaccacctgtgccgccccctgggtgcccaacaccagcgctgtgccccccagcggggccagccctgccctgcccatcttctccatgaccctgggcgctgtgagcaacctgctggccctggccctgctggcccaggccgccggccgcctgcggaggagaagatctgctgccaccttcctgctgtttgtggccagcctgctggccacagacctggccggccacgtgattcctggggccctggtgctgcggctgtacacagctggccgggccccagctgggggcgcctgccacttcctgggcggctgcatggtgttcttcggcctgtgccccctgctgctgggctgcggcatggctgtggagcgctgtgtgggcgtgacccggcccctgctgcacgccgcccgggtgtctgtggcccgggcccggctggccctggccgctgtggccgctgtggccctggccgtggccctgctgcccctggcccgggtgggccgctatgagctgcagtacccaggcacctggtgcttcatcggcctgggccccccaggcggctggaggcaggccctgctggccggcctgtttgccagcctgggcctggtggccctgctggccgccctggtgtgcaacaccctgagcggcctggccctgctgcgggcccgctggaggcggcgcagcagaagacctcctccagccagcggccctgacagcagaagacgctggggcgcccacggccccaggtctgccagcgccagcagcgccagcagcatcgccagcgccagcaccttcttcggcggcagccgcagcagcggcagcgcccggcgggcccgggcccatgatgtggagatggtgggccagctggtgggcatcatggtggtgtcctgcatctgctggagccccatgctggtgctggtggccctggccgtgggcggctggagcagcaccagcctgcagaggcccctcttcctggccgtgcggctggcctcctggaaccagatcctggacccctgggtgtacatcctgctgcggcaggccgtgctgcggcagctgctgcggctgctgcccccccgggccggggccaagggcggccctgctggcctgggcctgacccccagcgcctgggaggccagcagcctgcggagcagccgccacagcggcctgagccacttctag

SEQ ID NO: 165596 - DNA, 1077 bp, Artificial Sequence
  Description of Artificial Sequence: Synthetic coding sequence
atgggaaatgccagcaatgacagccagagcgaggactgtgagacccggcagtggctgcccccaggagagagccctgccatcagctctgtgatgttttctgctggggtgctgggcaacctgattgccctggccctgctggcccggcgctggagaggagatgtgggctgcagcgctggccgccgcagcagcctgagcctcttccacgtgctggtgacagagctggtgttcacagacctgctgggcacctgcctgatcagccctgtggtgctggccagctatgccaggaaccagaccctggtggccctggcccctgagagccgggcctgcacctactttgcctttgccatgaccttcttcagcctggccaccatgctgatgctgtttgccatggccctggagcgctacctgagcatcggccacccctacttctaccagaggagagtgagccgcagcggcggcctggccgtgctgcccgtcatctatgctgtgtccctgctcttctgcagcctgcccctgctggactatggccagtatgtgcagtactgccccggcacctggtgcttcatcagacatggccgcacagcctacctgcagctgtatgccaccctgctgctgctgctgattgtgtctgtgctggcctgcaacttcagcgtcatcctgaacctgatccgcatgcacagaagaagccgccgcagccgctgtggccccagcctgggcagcggccggggcggccctggggccaggagaagaggagagcgggtgtccatggccgaggagacagaccacctgatcctgctggccatcatgaccatcacctttgctgtgtgcagcctgcccttcaccatctttgcctacatgaatgagaccagcagcaggaaggagaagtgggacctgcaggccctgcgcttcctgagcatcaacagcatcatcgacccctgggtgtttgccatcctgcggccccctgtgctgcggctgatgaggtctgtgctgtgctgccgcatcagcctgcggacccaggatgccacccagaccagctgcagcacccagagtgatgccagcaagcaggccgacctgtag

SEQ ID NO: 165597 - DNA, 1173 bp, Artificial Sequence
  Description of Artificial Sequence: Synthetic coding sequence
atgaaggagacccggggctatggaggagatgcccccttctgcacccggctgaaccacagctacacaggcatgtgggcccctgagaggtctgctgaggcccggggcaacctgacccggcccccaggcagcggggaggactgtggctctgtgtctgtggccttccccatcaccatgctgctgactggatttgtgggcaatgccctggccatgctgctggtgagccgcagctacagaagaagagagagcaagaggaagaagagcttcctgctgtgcatcggctggctggccctgacagacctggtgggccagctgctgaccacccctgtggtgattgtggtgtacctgagcaagcagcgctgggagcacatcgaccccagcggccgcctgtgcaccttcttcggcctgaccatgacagtgtttggcctgagcagcctcttcatcgccagcgccatggctgtggagcgggccctggccatccgggccccccactggtacgccagccacatgaagacccgggccaccagggctgtgctgctgggcgtgtggctggccgtgctggcctttgccctgctgcctgtgctgggcgtgggccagtacacagtgcagtggccaggcacctggtgcttcatcagcacaggccggggcggcaatggcaccagcagcagccacaactggggcaacctcttctttgccagcgcctttgccttcctgggcctgctggccctgactgtgaccttcagctgcaacctggccaccatcaaggccctggtgagccgctgccgggccaaggccacagccagccagagcagcgcccagtggggccgcatcaccacagaaacagccatccagctgatgggcatcatgtgtgtgctgtctgtgtgctggagccccctgctgatcatgatgctgaagatgatcttcaaccagacctctgtggagcactgcaagacccacacagagaagcagaaggagtgcaacttcttcctgattgctgtgcggctggccagcctgaaccagatcctggacccctgggtgtacctgctgctgaggaagatcctgctgaggaagttctgccagatccgctaccacaccaacaactatgccagcagcagcaccagcctgccctgccagtgcagcagcaccctgatgtggagcgaccacctggagaggtag

SEQ ID NO: 165598 - DNA, 1260 bp, Artificial Sequence
  Description of Artificial Sequence: Synthetic coding sequence
atgaaggagacccggggctatggaggagatgcccccttctgcacccggctgaaccacagctacacaggcatgtgggcccctgagaggtctgctgaggcccggggcaacctgacccggcccccaggcagcggggaggactgtggctctgtgtctgtggccttccccatcaccatgctgctgactggatttgtgggcaatgccctggccatgctgctggtgagccgcagctacagaagaagagagagcaagaggaagaagagcttcctgctgtgcatcggctggctggccctgacagacctggtgggccagctgctgaccacccctgtggtgattgtggtgtacctgagcaagcagcgctgggagcacatcgaccccagcggccgcctgtgcaccttcttcggcctgaccatgacagtgtttggcctgagcagcctcttcatcgccagcgccatggctgtggagcgggccctggccatccgggccccccactggtacgccagccacatgaagacccgggccaccagggctgtgctgctgggcgtgtggctggccgtgctggcctttgccctgctgcctgtgctgggcgtgggccagtacacagtgcagtggccaggcacctggtgcttcatcagcacaggccggggcggcaatggcaccagcagcagccacaactggggcaacctcttctttgccagcgcctttgccttcctgggcctgctggccctgactgtgaccttcagctgcaacctggccaccatcaaggccctggtgagccgctgccgggccaaggccacagccagccagagcagcgcccagtggggccgcatcaccacagaaacagccatccagctgatgggcatcatgtgtgtgctgtctgtgtgctggagccccctgctgatcatgatgctgaagatgatcttcaaccagacctctgtggagcactgcaagacccacacagagaagcagaaggagtgcaacttcttcctgattgctgtgcggctggccagcctgaaccagatcctggacccctgggtgtacctgctgctgaggaagatcctgctgaggaagttctgccaggtggccaatgctgtgagcagctgcagcaatgatggccagaagggccagcccatcagcctgagcaatgagatcatccagacagaggccatccgctaccacaccaacaactatgccagcagcagcaccagcctgccctgccagtgcagcagcaccctgatgtggagcgaccacctggagaggtag

SEQ ID NO: 165599 - DNA, 1290 bp, Artificial Sequence
  Description of Artificial Sequence: Synthetic coding sequence
atgaaggagacccggggctatggaggagatgcccccttctgcacccggctgaaccacagctacacaggcatgtgggcccctgagaggtctgctgaggcccggggcaacctgacccggcccccaggcagcggggaggactgtggctctgtgtctgtggccttccccatcaccatgctgctgactggatttgtgggcaatgccctggccatgctgctggtgagccgcagctacagaagaagagagagcaagaggaagaagagcttcctgctgtgcatcggctggctggccctgacagacctggtgggccagctgctgaccacccctgtggtgattgtggtgtacctgagcaagcagcgctgggagcacatcgaccccagcggccgcctgtgcaccttcttcggcctgaccatgacagtgtttggcctgagcagcctcttcatcgccagcgccatggctgtggagcgggccctggccatccgggccccccactggtacgccagccacatgaagacccgggccaccagggctgtgctgctgggcgtgtggctggccgtgctggcctttgccctgctgcctgtgctgggcgtgggccagtacacagtgcagtggccaggcacctggtgcttcatcagcacaggccggggcggcaatggcaccagcagcagccacaactggggcaacctcttctttgccagcgcctttgccttcctgggcctgctggccctgactgtgaccttcagctgcaacctggccaccatcaaggccctggtgagccgctgccgggccaaggccacagccagccagagcagcgcccagtggggccgcatcaccacagaaacagccatccagctgatgggcatcatgtgtgtgctgtctgtgtgctggagccccctgctgatcatgatgctgaagatgatcttcaaccagacctctgtggagcactgcaagacccacacagagaagcagaaggagtgcaacttcttcctgattgctgtgcggctggccagcctgaaccagatcctggacccctgggtgtacctgctgctgaggaagatcctgctgaggaagttctgccagatgaggaagaggcggctgcgggagcagttctggaggcctgccagcagcggcagcggctgccagcagatccgctgcctgatggagagctgcagcctgacccagacaggagtgcagtggagcgacttccgcagcctgcagcccagccccccacccctgacagccatctttgcctcctgggtgcaggtgatcctgctgccccagccccccaagtag

SEQ ID NO: 165600 - DNA, 1257 bp, Artificial Sequence
  Description of Artificial Sequence: Synthetic coding sequence
atgaaggagacccggggctatggaggagatgcccccttctgcacccggctgaaccacagctacacaggcatgtgggcccctgagaggtctgctgaggcccggggcaacctgacccggcccccaggcagcggggaggactgtggctctgtgtctgtggccttccccatcaccatgctgctgactggatttgtgggcaatgccctggccatgctgctggtgagccgcagctacagaagaagagagagcaagaggaagaagagcttcctgctgtgcatcggctggctggccctgacagacctggtgggccagctgctgaccacccctgtggtgattgtggtgtacctgagcaagcagcgctgggagcacatcgaccccagcggccgcctgtgcaccttcttcggcctgaccatgacagtgtttggcctgagcagcctcttcatcgccagcgccatggctgtggagcgggccctggccatccgggccccccactggtacgccagccacatgaagacccgggccaccagggctgtgctgctgggcgtgtggctggccgtgctggcctttgccctgctgcctgtgctgggcgtgggccagtacacagtgcagtggccaggcacctggtgcttcatcagcacaggccggggcggcaatggcaccagcagcagccacaactggggcaacctcttctttgccagcgcctttgccttcctgggcctgctggccctgactgtgaccttcagctgcaacctggccaccatcaaggccctggtgagccgctgccgggccaaggccacagccagccagagcagcgcccagtggggccgcatcaccacagaaacagccatccagctgatgggcatcatgtgtgtgctgtctgtgtgctggagccccctgctgatcatgatgctgaagatgatcttcaaccagacctctgtggagcactgcaagacccacacagagaagcagaaggagtgcaacttcttcctgattgctgtgcggctggccagcctgaaccagatcctggacccctgggtgtacctgctgctgaggaagatcctgctgaggaagttctgccagatgaggaagaggcggctgcgggagcagctgatctgcagcctgcagaacagccagatccagagggccacagcccactgcggccaggtgcagacctacagagtgctgaaccgggaggagatggaggtgctggtgagcagcatcaacgtgtacacccgcatcagcacagtgaagacagaatag

SEQ ID NO: 165601 - DNA, 1209 bp, Artificial Sequence
  Description of Artificial Sequence: Synthetic coding sequence
atgaaggagacccggggctatggaggagatgcccccttctgcacccggctgaaccacagctacacaggcatgtgggcccctgagaggtctgctgaggcccggggcaacctgacccggcccccaggcagcggggaggactgtggctctgtgtctgtggccttccccatcaccatgctgctgactggatttgtgggcaatgccctggccatgctgctggtgagccgcagctacagaagaagagagagcaagaggaagaagagcttcctgctgtgcatcggctggctggccctgacagacctggtgggccagctgctgaccacccctgtggtgattgtggtgtacctgagcaagcagcgctgggagcacatcgaccccagcggccgcctgtgcaccttcttcggcctgaccatgacagtgtttggcctgagcagcctcttcatcgccagcgccatggctgtggagcgggccctggccatccgggccccccactggtacgccagccacatgaagacccgggccaccagggctgtgctgctgggcgtgtggctggccgtgctggcctttgccctgctgcctgtgctgggcgtgggccagtacacagtgcagtggccaggcacctggtgcttcatcagcacaggccggggcggcaatggcaccagcagcagccacaactggggcaacctcttctttgccagcgcctttgccttcctgggcctgctggccctgactgtgaccttcagctgcaacctggccaccatcaaggccctggtgagccgctgccgggccaaggccacagccagccagagcagcgcccagtggggccgcatcaccacagaaacagccatccagctgatgggcatcatgtgtgtgctgtctgtgtgctggagccccctgctgatcatgatgctgaagatgatcttcaaccagacctctgtggagcactgcaagacccacacagagaagcagaaggagtgcaacttcttcctgattgctgtgcggctggccagcctgaaccagatcctggacccctgggtgtacctgctgctgaggaagatcctgctgaggaagttctgccagatgaggaagaggcggctgcgggagcaggagatgggcccagatggccgctgcttctgccacgcctggaggcaggtgcccaggacctggtgcagcagccatgaccgggagccctgcagcgtgcagctgtcctag

SEQ ID NO: 165602 - DNA, 1167 bp, Artificial Sequence
  Description of Artificial Sequence: Synthetic coding sequence
atgaaggagacccggggctatggaggagatgcccccttctgcacccggctgaaccacagctacacaggcatgtgggcccctgagaggtctgctgaggcccggggcaacctgacccggcccccaggcagcggggaggactgtggctctgtgtctgtggccttccccatcaccatgctgctgactggatttgtgggcaatgccctggccatgctgctggtgagccgcagctacagaagaagagagagcaagaggaagaagagcttcctgctgtgcatcggctggctggccctgacagacctggtgggccagctgctgaccacccctgtggtgattgtggtgtacctgagcaagcagcgctgggagcacatcgaccccagcggccgcctgtgcaccttcttcggcctgaccatgacagtgtttggcctgagcagcctcttcatcgccagcgccatggctgtggagcgggccctggccatccgggccccccactggtacgccagccacatgaagacccgggccaccagggctgtgctgctgggcgtgtggctggccgtgctggcctttgccctgctgcctgtgctgggcgtgggccagtacacagtgcagtggccaggcacctggtgcttcatcagcacaggccggggcggcaatggcaccagcagcagccacaactggggcaacctcttctttgccagcgcctttgccttcctgggcctgctggccctgactgtgaccttcagctgcaacctggccaccatcaaggccctggtgagccgctgccgggccaaggccacagccagccagagcagcgcccagtggggccgcatcaccacagaaacagccatccagctgatgggcatcatgtgtgtgctgtctgtgtgctggagccccctgctgatcatgatgctgaagatgatcttcaaccagacctctgtggagcactgcaagacccacacagagaagcagaaggagtgcaacttcttcctgattgctgtgcggctggccagcctgaaccagatcctggacccctgggtgtacctgctgctgaggaagatcctgctgaggaagttctgccaggtggccaatgctgtgagcagctgcagcaatgatggccagaagggccagcccatcagcctgagcaatgagatcatccagacagaggcctag

SEQ ID NO: 165603 - DNA, 1173 bp, Artificial Sequence; identical to SEQ ID NO: 165597
  Description of Artificial Sequence: Synthetic coding sequence

SEQ ID NO: 165604 - DNA, 1098 bp, Artificial Sequence
  Description of Artificial Sequence: Synthetic coding sequence
atgaaggagacccggggctatggaggagatgcccccttctgcacccggctgaaccacagctacacaggcatgtgggcccctgagaggtctgctgaggcccggggcaacctgacccggcccccaggcagcggggaggactgtggctctgtgtctgtggccttccccatcaccatgctgctgactggatttgtgggcaatgccctggccatgctgctggtgagccgcagctacagaagaagagagagcaagaggaagaagagcttcctgctgtgcatcggctggctggccctgacagacctggtgggccagctgctgaccacccctgtggtgattgtggtgtacctgagcaagcagcgctgggagcacatcgaccccagcggccgcctgtgcaccttcttcggcctgaccatgacagtgtttggcctgagcagcctcttcatcgccagcgccatggctgtggagcgggccctggccatccgggccccccactggtacgccagccacatgaagacccgggccaccagggctgtgctgctgggcgtgtggctggccgtgctggcctttgccctgctgcctgtgctgggcgtgggccagtacacagtgcagtggccaggcacctggtgcttcatcagcacaggccggggcggcaatggcaccagcagcagccacaactggggcaacctcttctttgccagcgcctttgccttcctgggcctgctggccctgactgtgaccttcagctgcaacctggccaccatcaaggccctggtgagccgctgccgggccaaggccacagccagccagagcagcgcccagtggggccgcatcaccacagaaacagccatccagctgatgggcatcatgtgtgtgctgtctgtgtgctggagccccctgctgatcatgatgctgaagatgatcttcaaccagacctctgtggagcactgcaagacccacacagagaagcagaaggagtgcaacttcttcctgattgctgtgcggctggccagcctgaaccagatcctggacccctgggtgtacctgctgctgaggaagatcctgctgaggaagttctgccaggaggagttctggggcaactag

SEQ ID NO: 165605 - DNA, 1365 bp, Artificial Sequence
  Description of Artificial Sequence: Synthetic coding sequence
atgaaggagacccggggctatggaggagatgcccccttctgcacccggctgaaccacagctacacaggcatgtgggcccctgagaggtctgctgaggcccggggcaacctgacccggcccccaggcagcggggaggactgtggctctgtgtctgtggccttccccatcaccatgctgctgactggatttgtgggcaatgccctggccatgctgctggtgagccgcagctacagaagaagagagagcaagaggaagaagagcttcctgctgtgcatcggctggctggccctgacagacctggtgggccagctgctgaccacccctgtggtgattgtggtgtacctgagcaagcagcgctgggagcacatcgaccccagcggccgcctgtgcaccttcttcggcctgaccatgacagtgtttggcctgagcagcctcttcatcgccagcgccatggctgtggagcgggccctggccatccgggccccccactggtacgccagccacatgaagacccgggccaccagggctgtgctgctgggcgtgtggctggccgtgctggcctttgccctgctgcctgtgctgggcgtgggccagtacacagtgcagtggccaggcacctggtgcttcatcagcacaggccggggcggcaatggcaccagcagcagccacaactggggcaacctcttctttgccagcgcctttgccttcctgggcctgctggccctgactgtgaccttcagctgcaacctggccaccatcaaggccctggtgagccgctgccgggccaaggccacagccagccagagcagcgcccagtggggccgcatcaccacagaaacagccatccagctgatgggcatcatgtgtgtgctgtctgtgtgctggagccccctgctgatcatgatgctgaagatgatcttcaaccagacctctgtggagcactgcaagacccacacagagaagcagaaggagtgcaacttcttcctgattgctgtgcggctggccagcctgaaccagatcctggacccctgggtgtacctgctgctgaggaagatcctgctgaggaagttctgccaggtggccaatgctgtgagcagctgcagcaatgatggccagaagggccagcccatcagcctgagcaatgagatcatccagacagaggccatgaggaagaggcggctgcgggagcaggcccccctgctgcccaccagcacagtgattgaccccagccgcttctgtgcccagcccttccgctggttcctggacctgtccttccctgccatgagcagcagccacccccagctgcccctgaccctggccagcttcaagctgctgcgggagccctgcagcgtgcagctgtcctag

SEQ ID NO: 165606 - DNA, 1173 bp, Artificial Sequence; identical to SEQ ID NO: 165597
  Description of Artificial Sequence: Synthetic coding sequence

SEQ ID NO: 165607 - DNA, 1125 bp, Artificial Sequence
  Description of Artificial Sequence: Synthetic coding sequence
atgaaggagacccggggctatggaggagatgcccccttctgcacccggctgaaccacagctacacaggcatgtgggcccctgagaggtctgctgaggcccggggcaacctgacccggcccccaggcagcggggaggactgtggctctgtgtctgtggccttccccatcaccatgctgctgactggatttgtgggcaatgccctggccatgctgctggtgagccgcagctacagaagaagagagagcaagaggaagaagagcttcctgctgtgcatcggctggctggccctgacagacctggtgggccagctgctgaccacccctgtggtgattgtggtgtacctgagcaagcagcgctgggagcacatcgaccccagcggccgcctgtgcaccttcttcggcctgaccatgacagtgtttggcctgagcagcctcttcatcgccagcgccatggctgtggagcgggccctggccatccgggccccccactggtacgccagccacatgaagacccgggccaccagggctgtgctgctgggcgtgtggctggccgtgctggcctttgccctgctgcctgtgctgggcgtgggccagtacacagtgcagtggccaggcacctggtgcttcatcagcacaggccggggcggcaatggcaccagcagcagccacaactggggcaacctcttctttgccagcgcctttgccttcctgggcctgctggccctgactgtgaccttcagctgcaacctggccaccatcaaggccctggtgagccgctgccgggccaaggccacagccagccagagcagcgcccagtggggccgcatcaccacagaaacagccatccagctgatgggcatcatgtgtgtgctgtctgtgtgctggagccccctgctgatcatgatgctgaagatgatcttcaaccagacctctgtggagcactgcaagacccacacagagaagcagaaggagtgcaacttcttcctgattgctgtgcggctggccagcctgaaccagatcctggacccctgggtgtacctgctgctgaggaagatcctgctgaggaagttctgccagatgaggaagaggcggctgcgggagcaggaggagttctggggcaactag

SEQ ID NO: 165608 - DNA, 1467 bp, Artificial Sequence
  Description of Artificial Sequence: Synthetic coding sequence
atgagcaccccaggagtgaacagcagcgccagcctgagcccagaccggctgaacagccctgtgaccatcccagctgtgatgttcatcttcggcgtggtgggcaacctggtggccatcgtggtgctgtgcaagagcaggaaggagcagaaggagaccaccttctacaccctggtgtgtggcctggccgtgacagacctgctgggcaccctgctggtgtcccctgtgaccatcgccacctacatgaagggccagtggccaggcggccagcccctgtgtgagtacagcaccttcatcctgctcttcttcagcctgagcggcctgagcatcatctgtgccatgtctgtggagcgctacctggccatcaaccacgcctacttctacagccactacgtggacaagaggctggccggcctgaccctgtttgctgtgtatgccagcaatgtgctcttctgtgccctgcccaacatgggcctgggcagcagccggctgcagtacccagacacctggtgcttcatcgactggaccaccaacgtgacagcccacgccgcctacagctacatgtatgccggcttcagcagcttcctgatcctggccaccgtgctgtgcaatgtgctggtgtgtggggccctgctgaggatgcaccggcagttcatgaggaggaccagcctgggcacagagcagcaccacgccgctgctgctgcctctgtggccagccggggccaccctgctgccagccctgccctgccccggctgagtgacttcagaagaagaagaagcttcagaagaattgctggagctgagatccagatggtgatcctgctgattgccaccagcctggtggtgctgatctgcagcatccccctggtggtgcgggtgtttgtgaaccagctgtaccagcccagcctggagcgggaggtgtccaagaacccagacctgcaggccatcagaattgcctctgtgaaccccatcctggacccctggatctacatcctgctgaggaagacagtgctgagcaaggccatcgagaagatcaagtgcctcttctgcagaattggaggcagcagaagagagaggagcggccagcactgcagcgacagccagaggaccagcagcgccatgagcggccacagccgctccttcatcagccgggagctgaaggagatcagcagcaccagccagaccctgctgcctgacctgagcctgcctgacctgtctgaaaatggcctgggcggcaggaacctgctgcccggggtgcccggcatgggcctggcccaggaggacaccaccagcctgcggaccctgcgcatcagcgagaccagtgacagcagccagggccaggacagcgagagcgtgctgctggtggatgaagctgggggcagcggccgggccggccctgcccccaagggcagcagcctgcaggtgaccttccccagcgagaccctgaacctgtctgagaagtgcatctag

SEQ ID NO: 165609 - DNA, 459 bp, Artificial Sequence
  Description of Artificial Sequence: Synthetic coding sequence
atgcctgcccacagcctggtgatgagcagccctgccctgcctgccttcctgctgtgcagcaccctgctggtgatcaagatgtatgtggtggccatcatcaccggccaggtgcggctgaggaagaaggcctttgccaacccagaagatgccctgcggcatggaggcccccagtactgccgcagtgaccctgatgtggagcgctgcctgcgggcccacagaaatgacatggagaccatctaccccttcctgttcctgggctttgtgtacagcttcctgggccccaacccctttgtggcctggatgcacttcctggtgttcctggtgggccgggtggcccacacagtggcctacctgggcaagctgcgggcccccatccgctctgtgacctacaccctggcccagctgccctgtgcctccatggccctgcagatcctgtgggaggccgcccggcacctgtag

SEQ ID NO: 165610 - DNA, 561 bp, Artificial Sequence
  Description of Artificial Sequence: Synthetic coding sequence
atgaaggctgtgaatgagcagggcaaggaggtgacagaatttggaaacaagtactggctgatgctgaatgagaaggaggcccagcaggtgtatggaggcaaggaggccaggacagaggagatgaagtggaggcagtgggcagatgactggctggtgcacctgatcagccccaacgtgtaccgcacccccacagaggccctggccagctttgactacatcgtgcgggagggcaagtttggagctgtggagggcgctgtggccaagtacatgggcgctgctgccatgtacctgatcagcaagaggctgaagagccgccaccggctgcaggacaacgtgcgggaggacctgtatgaagctgctgacaagtgggtggccgctgtgggcaaggaccggcccttcatgggcggccagaagcccaacctggccgacctggccgtgtatggagtgctgcgggtgatggagggcctggatgcctttgatgacctgatgcagcacacccacatccagccctggtacctgcgggtggagcgggccatcacagaggccagccctgcccactag

SEQ ID NO: 165611 - DNA, 1134 bp, Artificial Sequence
  Description of Artificial Sequence: Synthetic coding sequence
atggaccctgctgcccgggtggtgcgggccctgtggccaggcggctgtgccctggcctggaggctgggcggccggccccagcccctgctgcccacccagagccgggccggctttgctggagctgctgggggccccagccctgtggccgccgccaggaagggcagcccccggctgctgggcgccgccgccctggccctgggcggggccctgggcctgtaccacacagcccgctggcacctgcgggcccaggacctgcatgctgagaggtctgctgcccagctgagcctgagcagccggctgcagctgaccctgtaccagtacaagacctgccccttctgcagcaaggtgcgggccttcctggacttccacgccctgccctaccaggtggtggaggtgaaccctgtgcggcgggcagagatcaagttcagcagctacaggaaggtgcccatcctggtggcccaggagggggagagcagccagcagctgaatgacagcagcgtcatcatcagcgccctgaagacctacctggtgtctggccagcccctggaggagatcatcacctactacccagccatgaaggctgtgaatgagcagggcaaggaggtgacagaatttggaaacaagtactggctgatgctgaatgagaaggaggcccagcaggtgtatggaggcaaggaggccaggacagaggagatgaagtggaggcagtgggcagatgactggctggtgcacctgatcagccccaacgtgtaccgcacccccacagaggccctggccagctttgactacatcgtgcgggagggcaagtttggagctgtggagggcgctgtggccaagtacatgggcgccgccgccatgtacctgatcagcaagaggctgaagagccgccaccggctgcaggacaacgtgcgggaggacctgtatgaggccgctgacaagtgggtggccgctgtgggcaaggaccggcccttcatgggcggccagaagcccaacctggccgacctggccgtgtatggagtgctgcgggtgatggagggcctggatgcctttgatgacctgatgcagcacacccacatccagccctggtacctgcgggtggagcgggccatcacagaggccagccctgcccactag

SEQ ID NO: 165612 - DNA, 894 bp, Artificial Sequence
  Description of Artificial Sequence: Synthetic coding sequence
atgtccatgaacaacagcaagcagctggtgtccccagctgctgccctgctgagcaacaccacctgccagacagaaaatcggctgtctgtgttcttcagcgtcatcttcatgacagtgggcatcctgagcaacagcctggccatcgccatcctgatgaaggcctaccagcgcttccggcagaagagcaaggccagcttcctgctgctggccagcggcctggtgatcacagacttcttcggccacctgatcaacggggccatcgctgtgtttgtgtatgccagtgacaaggagtggatccgctttgaccagagcaatgtgctgtgcagcatcttcggcatctgcatggtgttcagcggcctgtgccccctgctgctgggctctgtgatggccatcgagcgctgcattggagtgaccaagcccatcttccacagcaccaagatcaccagcaagcacgtgaagatgatgctgtctggagtgtgcctgtttgctgtgttcatcgccctgctgcccatcctgggccaccgggactacaagatccaggccagcaggacctggtgcttctacaacacagaggacatcaaggactgggaggaccgcttctacctgctgctcttctccttcctgggcctgctggccctgggcgtgtccctgctgtgcaatgccatcaccggcatcaccctgctgcgggtgaagttcaagagccagcagcaccggcagggccgcagccaccacctggagatggtgatccagctgctggccatcatgtgtgtgtcctgcatctgctggagccccttcctgggctaccgcatcatcctgaatggcaaggagaagtacaaggtgtatgaggagcagagcgacttcctgcaccggctgcagtggcccaccctggagtag

SEQ ID NO: 165613 - DNA, 1080 bp, Artificial Sequence
  Description of Artificial Sequence: Synthetic coding sequence
atgtccatgaacaacagcaagcagctggtgtccccagctgctgccctgctgagcaacaccacctgccagacagaaaatcggctgtctgtgttcttcagcgtcatcttcatgacagtgggcatcctgagcaacagcctggccatcgccatcctgatgaaggcctaccagcgcttccggcagaagagcaaggccagcttcctgctgctggccagcggcctggtgatcacagacttcttcggccacctgatcaacggggccatcgctgtgtttgtgtatgccagtgacaaggagtggatccgctttgaccagagcaatgtgctgtgcagcatcttcggcatctgcatggtgttcagcggcctgtgccccctgctgctgggctctgtgatggccatcgagcgctgcattggagtgaccaagcccatcttccacagcaccaagatcaccagcaagcacgtgaagatgatgctgtctggagtgtgcctgtttgctgtgttcatcgccctgctgcccatcctgggccaccgggactacaagatccaggccagcaggacctggtgcttctacaacacagaggacatcaaggactgggaggaccgcttctacctgctgctcttctccttcctgggcctgctggccctgggcgtgtccctgctgtgcaatgccatcaccggcatcaccctgctgcgggtgaagttcaagagccagcagcaccggcagggccgcagccaccacctggagatggtgatccagctgctggccatcatgtgtgtgtcctgcatctgctggagccccttcctggtgaccatggccaacatcggcatcaatggaaaccacagcctggagacctgtgagaccaccctgtttgccctgaggatggccacctggaaccagatcctggacccctgggtgtacatcctgctgaggaaggctgtgctgaagaacctgtacaagctggccagccagtgctgcggcgtgcacgtgatcagcctgcacatctgggagctgagcagcatcaagaacagcctgaaggtggccgccatcagcgagagccctgtggccgagaagagcgccagcacctag

SEQ ID NO: 165614 - DNA, 1080 bp, Artificial Sequence; identical to SEQ ID NO: 165613
  Description of Artificial Sequence: Synthetic coding sequence

SEQ ID NO: 165615 - DNA, 2640 bp, Artificial Sequence
  Description of Artificial Sequence: Synthetic coding sequence
atgggccgcctggccagccggcccctgctgctggccctgctgagcctggccctgtgccggggccgggtggtgcgggtgcccacagccaccctggtgcgggtggtgggcacagagctggtgatcccctgcaatgtgtctgactatgatggccccagcgagcagaactttgactggagcttcagcagcctgggcagcagctttgtggagctggccagcacctgggaggtgggcttccctgcccagctgtaccaggagcggctgcagagaggagagatcctgctgcggaggacagccaatgatgctgtggagctgcacatcaagaatgtgcagcccagcgaccagggccactacaagtgcagcacccccagcacagatgccaccgtgcagggcaactatgaagatactgtgcaggtgaaggtgctggccgacagcctgcacgtgggccccagcgcccggcccccacccagcctgagcctgcgggagggggagccctttgagctgcgctgcacagctgccagcgccagccccctgcacacccacctggccctgctgtgggaggtgcaccggggccctgccaggagatctgtgctggccctgacccatgagggccgcttccaccctggcctgggctatgagcagcgctaccacagcggagatgtgcggctggacacagtgggcagtgatgcctaccgcctgtctgtgtcccgggccctgtctgctgaccagggcagctaccgctgcatcgtgtctgagtggattgctgagcagggcaactggcaggagatccaggagaaggctgtggaggtggccaccgtggtgatccagcccagcgtgctgcgggctgctgtgcccaagaatgtgtctgtggccgagggcaaggagctggacctgacctgcaacatcaccacagacagagcagatgatgtgcggcctgaggtgacctggagcttcagcaggatgccagacagcaccctgcccggcagccgggtgctggcccggctggaccgggacagcctggtgcacagcagcccccacgtggccctgagccacgtggatgcccggagctaccacctgctggtgagagatgtgtccaaggagaacagcggctactactactgccacgtgtccctgtgggcccctggccacaacagatcctggcacaaggtggccgaggccgtgagcagccctgctggggtgggcgtgacctggctggagccagactaccaggtgtacctgaatgccagcaaggtgcccggctttgctgatgaccccacagagctggcctgccgggtggtggacaccaagagcggggaggccaacgtgcgcttcaccgtgtcctggtactacaggatgaacagaagaagtgacaacgtggtgaccagcgagctgctggccgtgatggatggagactggaccctgaagtatggagagaggagcaagcagagggcccaggatggagacttcatcttcagcaaggagcacacagacaccttcaacttccgcatccagaggaccacagaggaggaccggggcaactactactgtgtggtgtctgcctggaccaagcagaggaacaacagctgggtgaagagcaaggatgtgttcagcaagcctgtgaacatcttctgggccctggaggacagcgtgctggtggtgaaggcccggcagcccaagcccttctttgctgctggcaacacctttgagatgacctgcaaggtgagcagcaagaacatcaagagcccccgctacagcgtgctgatcatggccgagaagcctgtgggggacctgagcagccccaatgagaccaagtacatcatcagcctggaccaggacagcgtggtgaagctggagaactggacagatgccagccgggtggatggagtggtgctggagaaggtgcaggaggatgagttccgctacaggatgtaccagacccaggtgtctgatgctggcctgtaccgctgcatggtgacagcctggagccctgtgcggggcagcctgtggagggaggccgccaccagcctgagcaaccccattgaaattgacttccagaccagcggccccatcttcaatgcctctgtgcacagcgacacccccagcgtcatccggggggacctgatcaagctgttctgcatcatcaccgtggagggcgccgccctggaccctgatgacatggcctttgatgtgtcctggtttgctgtgcacagctttggcctggacaaggcccctgtgctgctgagcagcctggacaggaagggcatcgtgaccaccagcagaagagactggaagagtgacctgagcctggagcgggtgtctgtgctggagttcctgctgcaggtgcacggcagcgaggaccaggactttggaaactactactgcagcgtgaccccctgggtgaagagccccaccggctcctggcagaaggaggccgagatccacagcaagcctgtgttcatcaccgtgaagatggatgtgctgaatgccttcaagtaccccctgctgattggagtgggcctgagcacagtgattggcctgctgagctgcctgattggctactgcagcagccactggtgctgcaagaaggaggtgcaggagacccggcgggagcggcggcggctgatgtccatggagatggactag

SEQ ID NO: 165616 - DNA, 2217 bp, Artificial Sequence
  Description of Artificial Sequence: Synthetic coding sequence
tctggagctgctggggccggccggggcggcggcggggaggccgccggcaaggaggaggagggggagccctttgagctgcgctgcacagctgccagcgccagccccctgcacacccacctggccctgctgtgggaggtgcaccggggccctgcccggcgctctgtgctggccctgacccatgagggccgcttccaccctggcctgggctatgagcagcgctaccacagcggagatgtgcggctggacacagtgggcagtgatgcctaccgcctgtctgtgtcccgggccctgtctgctgaccagggcagctaccgctgcatcgtgtctgagtggattgctgagcagggcaactggcaggagatccaggagaaggctgtggaggtggccaccgtggtgatccagcccagcgtgctgcgggctgctgtgcccaagaatgtgtctgtggccgagggcaaggagctggacctgacctgcaacatcaccacagacagagcagatgatgtgcggcctgaggtgacctggagcttcagcaggatgccagacagcaccctgcccggcagccgggtgctggcccggctggaccgggacagcctggtgcacagcagcccccacgtggccctgagccacgtggatgcccggagctaccacctgctggtgagagatgtgtccaaagaaaattctggctactactactgccacgtgtccctgtgggcccctggccacaacagatcctggcacaaggtggccgaggccgtgagcagccctgctggggtgggcgtgacctggctggagccagactaccaggtgtacctgaatgccagcaaggtgcccggctttgctgatgaccccacagagctggcctgccgggtggtggacaccaagtctggagaggccaacgtgcgcttcaccgtgtcctggtactacaggatgaacagaagaagtgacaacgtggtgaccagcgagctgctggccgtgatggatggagactggaccctgaagtacggggagaggagcaagcagagggcccaggatggagacttcatcttcagcaaggagcacacagacaccttcaacttccgcatccagaggaccacagaagaagatcggggcaactactactgtgtggtgtctgcctggaccaagcagaggaacaacagctgggtgaagagcaaggatgtgttcagcaagcctgtgaacatcttctgggccctggaggacagcgtgctggtggtgaaggcccggcagcccaagcccttctttgctgctggcaacacctttgagatgacctgcaaggtgagcagcaagaacatcaagagcccccgctacagcgtgctgatcatggccgagaagcctgtgggggacctgagcagccccaatgagaccaagtacatcatcagcctggaccaggacagcgtggtgaagctggagaactggacagatgccagccgggtggatggagtggtgctggagaaggtgcaggaggatgagttccgctacaggatgtaccagacccaggtgtctgatgctggcctgtaccgctgcatggtgacagcctggagccctgtgcggggcagcctgtggagggaggccgccaccagcctgagcaaccccatcgagattgacttccagaccagcggccccatcttcaatgcctctgtgcacagcgacaccccatctgtcatccggggggacctgatcaagctgttctgcatcatcaccgtggagggcgccgccctggaccctgatgacatggcctttgatgtgtcctggtttgctgtgcacagctttggcctggacaaggcccctgtgctgctgagcagcctggacagaaaaggaattgtgaccaccagccggcgggactggaagagtgacctgagcctggagcgggtgtctgtgctggagttcctgctgcaggtgcacggcagcgaggaccaggactttggaaactactactgcagcgtgaccccctgggtgaagagccccaccggctcctggcagaaggaggccgagatccacagcaagcctgtgttcatcaccgtgaagatggatgtgctgaatgccttcaagtaccccctgctgattggagtgggcctgagcaccgtcatcggcctgctgagctgcctgattggctactgcagcagccactggtgctgcaagaaggaggtgcaggagacccggcgggagcggcggcggctgatgtccatggagatggactag

SEQ ID NO: 165617 - DNA, 1161 bp, Artificial Sequence
  Description of Artificial Sequence: Synthetic coding sequence
atggctgacagctgcaggaacctgacctacgtgcggggctctgtgggccctgccaccagcaccctgatgtttgtggccggcgtggtgggcaatggcctggccctgggcatcctgagcgcccggcggcctgcccggcccagcgcctttgctgtgctggtgacaggcctggccgccacagacctgctgggcaccagcttcctgagccctgctgtgtttgtggcctatgccaggaacagcagcctgctgggcctggcccggggcggccctgccctgtgtgatgcctttgcctttgccatgaccttcttcggcctggcctccatgctgatcctgtttgccatggctgtggagcgctgcctggccctgagccacccctacctgtatgcccagctggatggcccccgctgtgcccggctggccctgcctgccatctatgccttctgtgtgctcttctgtgccctgcccctgctgggcctgggccagcaccagcagtactgccccggctcctggtgcttcctgaggatgcgctgggcccagcctggaggagctgccttcagcctggcctatgccggcctggtggccctgctggtggccgccatcttcctgtgcaatggatctgtgaccctgagcctgtgcaggatgtaccggcagcagaagaggcaccagggcagcctgggcccccggcccaggactggagaagatgaggtggaccacctgatcctgctggccctgatgacagtggtgatggctgtgtgcagcctgcccctgaccatccgctgcttcacccaggccgtggccccagacagcagcagcgagatgggagacctgctggccttccgcttctacgccttcaaccccatcctggacccctgggtgttcatcctcttcaggaaggctgtgttccagaggctgaagctgtgggtgtgctgcctgtgcctgggccctgcccacggggacagccagacccccctgagccagctggccagcggccggcgggacccccgggcccccagcgcccctgtgggcaaggagggcagctgtgtgcccctgagcgcctggggcgagggccaggtggagcccctgccccccacccagcagagcagcggcagcgctgtgggcaccagcagcaaggccgaggcctctgtggcctgcagcctgtgctag

SEQ ID NO: 165618 - DNA, 1503 bp, Artificial Sequence
  Description of Artificial Sequence: Synthetic coding sequence
atggcctgggccgccctgctgggcctgctggccgccctgctgctgctgctgctgctgagcagaagaaggaccaggaggcctggagagccccccctggacctgggcagcatcccctggctgggctacgccctggactttgggaaggatgctgccagcttcctgaccaggatgaaggagaagcatggagacatcttcaccatcctggtgggcggccgctacgtgacagtgctgctggacccccacagctatgatgctgtggtgtgggagcccaggacccggctggacttccacgcctatgccatcttcctgatggagcgcatctttgatgtgcagctgccccactacagccccagtgatgagaaggccaggatgaagctgaccctgctgcaccgggagctgcaggccctgacagaggccatgtacaccaacctgcatgctgtgctgctgggagatgccacagaagctggcagcggctggcatgagatgggcctgctggacttctcctacagcttcctgctgcgggccggctacctgaccctgtatggaattgaggccctgcccaggacccatgagagccaggcccaggacagagtgcacagcgcagatgtgttccacaccttccggcagctggaccggctgctgcccaagctggcccggggcagcctgtctgtgggggacaaggaccacatgtgcagcgtgaagagccggctgtggaagctgctgagccctgcccggctggcccggcgggcccacaggagcaagtggctggagagctacctgctgcacctggaggagatgggcgtgtctgaggagatgcaggcccgggccctggtgctgcagctgtgggccacccagggcaacatgggccctgctgccttctggctgctgctcttcctgctgaagaaccctgaggccctggccgctgtgcggggggagctggagagcatcctgtggcaggccgagcagcctgtgtcccagaccaccaccctgccccagaaggtgctggacagcacccctgtgctggacagcgtgctgtctgagagcctgcggctgacagctgcccccttcatcacccgggaggtggtggtggacctggccatgcccatggctgatggccgggagttcaacctgcggcggggggaccggctgctgctcttccccttcctgagcccccagagggaccctgagatctacacagatcctgaggtgttcaagtacaaccgcttcctgaacccagatggcagcgagaagaaggacttctacaaggatggcaagaggctgaagaactacaacatgccctggggcgccggccacaaccactgcctgggccgctcctatgctgtgaacagcatcaagcagtttgtgttcctggtgctggtgcacctggacctggagctgatcaatgctgatgtggagatccctgagtttgacctgagccgctatggcttcggcctgatgcagcctgagcatgatgtgcctgtgcgctaccgcatccggccctag

SEQ ID NO: 165619 - DNA, 408 bp, Artificial Sequence
  Description of Artificial Sequence: Synthetic coding sequence
atgagggccttcctgaggaaccagaagtatgaggacatgcacaacatcatccacatcctgcagatcaggaagctgcggcaccggctgagcaacttcccccggctgcccggcatcctggcccctgagaccgtgctgctgcccttctgctacaaggtgttcaggaagaaggagaaggtgaagaggagccagaaggccacagagttcatcgactacagcattgagcagagccaccacgccatcctgacccccctgcagacccacctgaccatgaagggcagctccatgaagtgcagcagcctgagcagcgaggccatcctcttcaccctgaccctgcagctgacccagaccctgggcctggagtgctgcctgctgtacctgagcaagaccatccacccccagatcatctag

SEQ ID NO: 165620 - DNA, 345 bp, Artificial Sequence
  Description of Artificial Sequence: Synthetic coding sequence
atggccggcctggccctgcagcccggcacagccctgctgtgctacagctgcaaggcccaggtgtccaatgaagactgcctgcaggtggagaactgcacccagctgggggagcagtgctggacagcccgcatccgggctgtgggcctgctgaccgtcatcagcaagggctgcagcctgaactgtgtggatgacagccaggactactacgtgggcaagaagaacatcacctgctgtgacacagacctgtgcaatgccagcggggcccacgccctgcagcctgctgctgccatcctggccctgctgcctgccctgggcctgctgctgtggggccctggccagctgtag

SEQ ID NO: 165621 - DNA, 714 bp, Artificial Sequence
  Description of Artificial Sequence: Synthetic coding sequence
atgatggtgatggtggtggtgatcacctgcctgctgagccactacaagctgagcgcccgctccttcatcagccgccacagccagggcagaagaagagaagatgccctgagcagcgagggctgcctgtggcccagcgagagcacagtgtctggaaatggcatccctgagccccaggtgtatgccccaccccggcccacagaccggctggccgtgcccccatttgcccagcgggagcgcttccaccgcttccagcccacctacccctacctgcagcacgagattgacctgccccccaccatcagcctgagtgatggagaggagcccccaccctaccagggcccctgcaccctgcagctgcgggaccctgagcagcagctggagctgaaccgggagagcgtgcgggccccacccaacagaaccatctttgacagcgacctgatggattctgcccggctgggcggcccctgcccccccagcagcaacagcggcatcagcgccacctgctacggcagcggcggccgcatggagggccccccacccacctacagcgaggtgattggccactacccaggcagcagcttccagcaccagcagagcagcggcccccccagcctgctggagggcacccggctgcaccacacccacatcgcccccctggagagcgctgccatctggagcaaggagaaggacaagcagaagggccaccccctgtag

SEQ ID NO: 165622 - DNA, 864 bp, Artificial Sequence
  Description of Artificial Sequence: Synthetic coding sequence
atgcaccggctgatgggcgtgaacagcacagctgctgctgctgctggccagcccaacgtgtcctgcacctgcaactgcaagaggagcctcttccagagcatggagatcacagagctggagtttgtgcagatcatcatcatcgtggtggtgatgatggtgatggtggtggtgatcacctgcctgctgagccactacaagctgagcgcccgctccttcatcagccgccacagccagggcagaagaagagaagatgccctgagcagcgagggctgcctgtggcccagcgagagcacagtgtctggaaatggcatccctgagccccaggtgtatgccccaccccggcccacagaccggctggccgtgcccccatttgcccagcgggagcgcttccaccgcttccagcccacctacccctacctgcagcacgagattgacctgccccccaccatcagcctgagtgatggagaggagcccccaccctaccagggcccctgcaccctgcagctgcgggaccctgagcagcagctggagctgaaccgggagagcgtgcgggccccacccaacagaaccatctttgacagcgacctgatggattctgcccggctgggcggcccctgcccccccagcagcaacagcggcatcagcgccacctgctacggcagcggcggccgcatggagggccccccacccacctacagcgaggtgattggccactacccaggcagcagcttccagcaccagcagagcagcggcccccccagcctgctggagggcacccggctgcaccacacccacatcgcccccctggagagcgctgccatctggagcaaggagaaggacaagcagaagggccaccccctgtag

SEQ ID NO: 165623 - DNA, 759 bp, Artificial Sequence
  Description of Artificial Sequence: Synthetic coding sequence
atggccgagctggagtttgtgcagatcatcatcatcgtggtggtgatgatggtgatggtggtggtgatcacctgcctgctgagccactacaagctgagcgcccggagcttcatcagccgccacagccagggcagaagaagagaagatgccctgagcagcgagggctgcctgtggcccagcgagagcacagtgtctggaaatggcatccctgagccccaggtgtatgccccaccccggcccacagaccggctggccgtgcccccatttgcccagcgggagcgcttccaccgcttccagcccacctacccctacctgcagcatgaaattgacctgccccccaccatcagcctgagtgatggagaggagcccccaccctaccagggcccctgcaccctgcagctgcgggaccctgagcagcagctggagctgaaccgggagagcgtgcgggccccacccaacagaaccatctttgacagcgacctgatggacagcgcccggctgggcggcccctgcccccccagcagcaacagcggcatcagcgccacctgctacggcagcggcggccgcatggagggccccccacccacctacagcgaggtgattggccactacccaggcagcagcttccagcaccagcagagcagcggcccccccagcctgctggagggcacccggctgcaccacacccacatcgcccccctggagagcgctgccatctggagcaaggagaaggacaagcagaagggccaccccctgtag

SEQ ID NO: 165624 - DNA, 714 bp, Artificial Sequence; identical to SEQ ID NO: 165621
  Description of Artificial Sequence: Synthetic coding sequence

SEQ ID NO: 165625 - DNA, 714 bp, Artificial Sequence; identical to SEQ ID NO: 165621
  Description of Artificial Sequence: Synthetic coding sequence

SEQ ID NO: 165626 - DNA, 684 bp, Artificial Sequence
  Description of Artificial Sequence: Synthetic coding sequence
atgcaccggctgatgggcgtgaacagcacagctgctgctgctgctggccagcccaacgtgtcctgcacctgcaactgcaagaggagcctcttccagagcatggagatcagctgccacggcttccctgtgtgcaagagccaccagcaccaggagtggaagagcctgtgctggagcctgcggagccctgggggcgccagcagcatcactggatttggctccatgaaggtgaccaacccagccatgaacctgcctgagtgccagtggctgcgcatccagaaggccgagctggagtttgtgcagatcatcatcatcgtggtggtgatgatggtgatggtggtggtgatcacctgcctgctgagccactacaagctgagcgcccggagcttcatcagccgccacagccagggcagaagaagagaagatgccctgagcagcgagggctgcctgtggcccagcgagagcacagtgtctggaaatggcatccctgagccccaggtgtatgccccaccccggcccacagaccggctggccgtgcccccatttgcccagcgggagcgcttccaccgcttccagcccacctacccctacctgcagcatgaaattgacctgccccccaccatcagcctgagtgatggagaggagcccccaccctaccagggcccctgcaccctgcagctgaggtag

SEQ ID NO: 165627 - DNA, 627 bp, Artificial Sequence
  Description of Artificial Sequence: Synthetic coding sequence
atgcctgccatcccagcccatggagctgagctggagtttgtgcagatcatcatcatcgtggtggtgatgatggtgatggtggtggtgatcacctgcctgctgagccactacaagctgagcgcccgctccttcatcagccgccacagccagggcagaagaagagaagatgccctgagcagcgagggctgcctgtggcccagcgagagcacagtgtctggaaatggcatccctgagccccaggtgtatgccccaccccggcccacagaccggctggccgtgcccccatttgcccagcgggagcgcttccaccgcttccagcccacctacccctacctgcagcacgagattgacctgccccccaccatcagcctgagtgatggagaggagcccccaccctaccagggcccctgcaccctgcagctgcgggaccctgagcagcagctggagctgaaccgggagagcgtgcgggccccacccaacagaaccatctttgacagcgacctgatggattctgcccggctgggcggcccctgcccccccagcagcaacagcggcatcagcgccacctgctacggcagcggcggccgcatggagggccccccacccacctacagcgaggtgatctag

SEQ ID NO: 165628 - DNA, 156 bp, Artificial Sequence
  Description of Artificial Sequence: Synthetic coding sequence
atggcccgctaccgctgctgccgcagccagagccgcagccgctactaccggcagaggcagaggagcagaagaagaagaagaagaagctgccagacccggcggcgggccatgcgctgctgccggccccgctaccggccccgctgcagaagacactag

SEQ ID NO: 165629 - DNA, 309 bp, Artificial Sequence
  Description of Artificial Sequence: Synthetic coding sequence
atggtgcgctacagagtgcgcagcctgtctgagaggagccatgaggtgtaccggcagcagctgcacggccaggagcagggccaccacggccaggaggagcagggcctgagccctgagcacgtggaggtgtatgaaagaacccacggccagagccactacagaagaagacactgcagcagaagaaggctgcaccgcatccaccggcggcagcacaggagctgcagaagaaggaagagaagaagctgccgccacagaagaagacacagaagaggctgcaggaccaggaagaggacctgccgccgccactag

SEQ ID NO: 165630 - DNA, 423 bp, Artificial Sequence
  Description of Artificial Sequence: Synthetic coding sequence
atggtgcgctacagagtgcgcagcctgtctgagaggagccatgaggtgtaccggcagcagctgcacggccaggagcagggccaccacggccaggaggagcagggcctgagccctgagcacgtggaggtgtatgaaagaacccacggccagagccactacagaagaagacactgcagcagaagaaggctgcaccgcatccaccggcggcagcacaggagctgcagaagaaggaagagaagaagctgccgccacagaagaagacacagaagagagagcctgggggaccccctgaaccagaacttcctgagccagaaggctgctgagcccggccgggagcacgccgagggcaccaagctgcccggccccctgacccccagctggaagctgaggaagagccggcccaagcaccaggtgcggccctag

SEQ ID NO: 165631 - DNA, 657 bp, Artificial Sequence
  Description of Artificial Sequence: Synthetic coding sequence
tgactggccctgctgctggcccgggccggcctgaggaagccagagagccaggaggccgcccccctgagcggcccctgtggccggcgggtcatcaccagcagaattgtgggcggagaagatgctgagctgggccgctggccctggcagggcagcctgcggctgtgggacagccacgtgtgtggggtgtccctgctgagccaccgctgggccctgacagctgcccactgctttgaaacagacctgagtgaccccagcggctggatggtgcagtttggccagctgacctccatgcccagcttctggagcctgcaggcctactacacccgctactttgtgagcaacatctacctgagcccccgctacctgggcaacagcccctatgacatcgccctggtgaagctgagcgcccctgtgacctacaccaagcacatccagcccatctgcctgcaggccagcacctttgaatttgaaaatagaacagactgctgggtgacaggctggggctacatcaaggaggatgagggcagcagcggccgccaccacaagcagctgtatgtgcagccccccctgccccaggtgcagttcccccagggccacctgtggaggcatggcctgtgctggcagtgcccccggcgggagggctgcctgctgaggtag

SEQ ID NO: 165632 - DNA, 744 bp, Artificial Sequence
  Description of Artificial Sequence: Synthetic coding sequence
atgaaccccctgctgatcctgacctttgtggccgccgccctggccgccccctttgatgatgatgacaagatcgtgggcggctacaactgtgaggagaacagcgtgccctaccaggtgtccctgaacagcggctaccacttctgtggcggcagcctcatcaatgagcagtgggtggtgtctgctggccactgctacaagagccgcatccaggtgcggctgggggagcacaacatcgaggtgctggagggcaatgagcagttcatcaatgctgccaagatcatccgccacccccagtatgacaggaagaccctgaacaatgacatcatgctgatcaagctgagcagcagagctgtgatcaatgcccgggtgtccaccatcagcctgcccacagcccccccagccaccggcaccaagtgcctgatcagcggctggggcaacacagccagcagcggggctgactacccagatgagctgcagtgcctggatgcccctgtgctgagccaggccaagtgtgaggccagctacccaggcaagatcaccagcaacatgttctgtgtgggcttcctggagggcggcaaggacagctgccagggcgacagcggcggccctgtggtgtgcaatggccagctgcagggcgtggtgtcctggggagatggctgtgcccagaagaacaagccaggagtgtacaccaaggtgtacaactacgtgaagtggatcaagaacaccatcgccgccaacagctag

SEQ ID NO: 165633 - DNA, 714 bp, Artificial Sequence
  Description of Artificial Sequence: Synthetic coding sequence
atgaaccccctgctgatcctgacctttgtggccgccgccctggccgccccctttgatgatgatgacaagatcgtgggcggctacaactgtgaggagaacagcgtgccctaccaggtgtccctgaacagcggctaccacttctgtggcggcagcctcatcaatgagcagtgggtggtgtctgctggccactgctacaagagccgcatccaggtgcggctgggggagcacaacatcaatgctgccaagatcatccgccacccccagtatgacaggaagaccctgaacaatgacatcatgctgatcaagctgagcagcagagctgtgatcaatgcccgggtgtccaccatcagcctgcccacagcccccccagccaccggcaccaagtgcctgatcagcggctggggcaacacagccagcagcggggctgactacccagatgagctgcagtgcctggatgcccctgtgctgagccaggccaagtgtgaggccagctacccaggcaagatcaccagcaacatgttctgtgtgggcttcctggagggcggcaaggacagctgccagggcgacagcggcggccctgtggtgtgcaatggccagctgcagggcgtggtgtcctggggagatggctgtgcccagaagaacaagccaggagtgtacaccaaggtgtacaactacgtgaagtggatcaagaacaccatcgccgccaacagctag

SEQ ID NO: 165634 - DNA, 2628 bp, Artificial Sequence
  Description of Artificial Sequence: Synthetic coding sequence
atgaccctggccaggtttgtgctggccctgatgctgggcgccctgcctgaggtggtgggctttgattctgtgctgaatgacagcctgcaccacagccaccgccacagccccccagctggcccccactacccctactacctgcccacccagcagaggcctcccaggacccggcccccaccacccctgccccgcttcccccggcccccccgggccctgcctgcccagaggccccacgccctgcaggccggccacaccccccggccccacccctggggctgcccagctggggagccctgggtgtctgtgacagactttggagccccctgcctgcgctgggccgaggtgccccccttcctggagaggagccccccagcctcctgggcccagctgcggggccagaggcacaacttctgccgcagcccagatggagctggccggccctggtgcttctatggagatgcccggggcaaggtggactggggctactgtgactgcagacatggctctgtgcggctgcggggcggcaagaatgaatttgagggcaccgtggaggtgtatgccagcggcgtgtggggcaccgtgtgcagcagccactgggatgacagtgatgccagcgtcatctgccaccagctgcagctgggcggcaagggcatcgccaagcagacccccttcagcggcctgggcctcatccccatctactggagcaatgtgcgctgcagaggagatgaggagaacatcctgctgtgtgagaaggacatctggcagggcggcgtgtgcccccagaagatggctgctgctgtgacctgcagcttcagccacggccccaccttccccatcatccggctggccggcggcagctctgtgcatgagggccgggtggagctgtaccacgccggccagtggggcaccgtgtgtgatgaccagtgggatgatgctgatgctgaggtgatctgccggcagctgggcctgagcggcatcgccaaggcctggcaccaggcctactttggagagggcagcggccctgtgatgctggatgaggtgcgctgcacaggaaatgagctgagcattgagcagtgccccaagagctcctggggcgagcacaactgtggccacaaggaggatgctggggtgtcctgcacccccctgacagatggagtcatccggctggccggcggcaagggcagccatgagggccgcctggaggtgtactaccggggccagtggggcaccgtgtgtgatgatggctggacagagctgaacacctacgtggtgtgccggcagctgggcttcaagtatggcaagcaggccagcgccaaccactttgaggagagcacaggccccatctggctggatgatgtgtcctgcagcggcaaggagacccgcttcctgcagtgcagccggcggcagtggggcagacatgactgcagccacagagaagatgtgtccatcgcctgctacccaggaggagagggccaccggctgagcctgggcttccctgtgcggctgatggatggagagaacaagaaggagggccgggtggaggtgttcatcaatggccagtggggcaccatctgtgatgatggctggacagacaaggatgctgctgtgatctgccggcagctgggctacaagggccctgcccgggcccggaccatggcctactttggagagggcaagggccccatccacgtggacaacgtgaagtgcacaggaaatgaaagaagcctggccgactgcatcaagcaggacatcggccgccacaactgccgccacagtgaagatgctggggtcatctgtgactactttgggaagaaggccagcggcaacagcaacaaggagagcctgagctctgtgtgtggcctgcggctgctgcaccggcggcagaagaggatcatcggcggcaagaacagcctgcggggcggctggccctggcaggtgtccctgcggctgaagagcagccatggagatggccgcctgctgtgtggggccaccctgctgagcagctgctgggtgctgacagctgcccactgcttcaagagatatggcaacagcaccaggagctatgctgtgcgggtgggggactaccacaccctggtgcctgaggagtttgaggaggagattggagtgcagcagatcgtcatccaccgggagtacagaccagacagaagtgactatgacatcgccctggtgcggctgcagggccctgaggagcagtgtgcccgcttcagcagccacgtgctgcctgcctgcctgcccctgtggagggagcggccccagaagacagccagcaactgctacatcaccggctggggagacaccggccgggcctacagcaggaccctgcagcaggccgccatccccctgctgcccaagcgcttctgtgaggagcgctacaagggccgcttcaccggccgcatgctgtgtgccggcaacctgcacgagcacaagagggtggacagctgccagggcgacagcggcggccccctgatgtgtgagaggcctggagagagctgggtggtgtatggagtgacctcctggggctacggctgcggcgtgaaggacagccctggggtgtacaccaaggtgtctgcctttgtgccctggatcaagtctgtgaccaagctgtag

SEQ ID NO: 165635 - DNA, 489 bp, Artificial Sequence
  Description of Artificial Sequence: Synthetic coding sequence
atgaagggcttcaccgccaccctcttcctgtggaccctcatcttccccagctgcagcggcggcggcggcggcaaggcctggcccacccacgtggtgtgcagcgacagcggcctggaggtgctgtaccagagctgtgaccccctgcaggactttggcttctctgtggagaagtgcagcaagcagctgaagagcaacatcaacatccgcttcggcatcatcctgcgggaggacatcaaggagctgttcctggacctggccctgatgagccagggcagctctgtgctgaacttctcctaccccatctgtgaggccgccctgcccaagttctccttctgtggccgcaggaagggggagcagatctactatgccggccctgtgaacaaccctgagttcaccatcccccagggcgagtaccaggtgctgctggagctgtacacagagaagaggagcacagtggcctgtgccaatgccaccatcatgtgcagctag

SEQ ID NO: 165636 - DNA, 822 bp, Artificial Sequence
  Description of Artificial Sequence: Synthetic coding sequence
atggctgtgtggctggcccagtggctgggccccctgctgctggtgtccctgtggggcctgctggccccagccagcctgctgcggcggctgggggagcacatccagcagttccaggagagcagcgcccagggcctgggcctgagcctgggccctggagctgctgccctgcccaaggtgggctggctggagcagctgctggaccccttcaacgtgtctgaccggcgctccttcctgcagcgctactgggtgaatgaccagcactgggtgggccaggacggccccatcttcctgcacctgggcggggagggcagcctgggccctggctctgtgatgaggggccaccctgctgccctggccccagcctggggcgccctggtgatcagcctggagcaccgcttctacggcctgagcatcccagctgggggcctggagatggcccagctgcgcttcctgagcagccggctggccctggctgatgtggtgtctgcccggctggccctgagccgcctcttcaacatcagcagcagcagcccctggatctgcttcggcggcagctatgccggcagcctggccgcctgggcccggctgaagttcccccacctgatctttgcctctgtggccagcagcgcccctgtgcgggctgtgctggacttcagcgagtacaatgacatcgtgctgcacagcctgggccagaagtgcctgtccttcagcagagctgagaccgtggcccagctgcggagcacagagccccagctgtctggagtgggggaccggcagtggctgtaccagacctgcacagaatttggcttctacatcacctag

SEQ ID NO: 165637 - DNA, 501 bp, Artificial Sequence
  Description of Artificial Sequence: Synthetic coding sequence
atggctgtgtggctggcccagtggctgggccccctgctgctggtgtccctgtggggcctgctggccccagccagcctgctgcggcggctgggggagcacatccagcagttccaggagagcagcgcccagggcctgggcctgagcctgggccctggagctgctgccctgcccaaggtgggctggctggagcagctgctggaccccttcaacgtgtctgaccggcgctccttcctgcagcgctactgggtgaatgaccagcactgggtgggccaggacggccccatcttcctgcacctgggcggggagggcagcctgggccctggctctgtgatgaggggccaccctgctgccctggccccagcctggggcgccctggtgatcagcctggagcaccgcttctacggcctgagcatcccagctgggggcctggagatggcccagctgcgcttcctgagcagccggctggccctgagctgcacagcctgggcccggtctgtgtag

SEQ ID NO: 165638 - DNA, 498 bp, Artificial Sequence
  Description of Artificial Sequence: Synthetic coding sequence
tgagtgatgaggggccaccctgctgccctggccccagcctggggcgccctggtgatcagcctggagcaccgcttctacggcctgagcatcccagctgggggcctggagatggcccagctgcgcttcctgagcagccggctggccctggctgatgtggtgtctgcccggctggccctgagccgcctcttcaacatcagcagcagcagcccctggatctgcttcggcggcagctatgccggcagcctggccgcctgggcccggctgaagttcccccacctgatctttgcctctgtggccagcagcgcccctgtgcgggctgtgctggacttcagcgagtacaatgacatcgtgctgcacagcctgggccagaagtgcctgtccttcagcagagctgagaccgtggcccagctgcggagcacagagccccagctgtctggagtgggggaccggcagtggctgtaccagacctgcacagaatttggcttctacgtgacctag

SEQ ID NO: 165639 - DNA, 945 bp, Artificial Sequence
  Description of Artificial Sequence: Synthetic coding sequence
atgggcgcccggggggccctgctgctggccctgctgctggcccgggccggcctgaggaagccagagagccaggaggccgcccccctgagcggcccctgtggcagaagagtcatcaccagccgcatcgtgggcggggaggatgctgagctgggccgctggccctggcagggcagcctgcggctgtgggacagccacgtgtgtggggtgtccctgctgagccaccgctgggccctgacagctgcccactgctttgagacctacagcgacctgagtgaccccagcggctggatggtgcagtttggccagctgacctccatgcccagcttctggagcctgcaggcctactacacccgctactttgtgagcaacatctacctgagcccccgctacctgggcaacagcccctatgacatcgccctggtgaagctgagcgcccctgtgacctacaccaagcacatccagcccatctgcctgcaggccagcacctttgaatttgagaacagaacagactgctgggtgacaggctggggctacatcaaggaggatgaggccctgcccagcccccacaccctgcaggaggtgcaggtggccatcatcaacaacagcatgtgcaaccacctgttcctgaagtacagcttcaggaaggacatctttggagacatggtgtgtgctggaaatgcccagggcggcaaggatgcctgctttggagacagcggcggccccctggcctgcaacaagaatggcctgtggtaccagattggagtggtgtcctggggcgtgggctgcggccggcccaacagacctggggtgtacaccaacatcagccaccactttgagtggatccagaagctgatggcccagagcggcatgagccagcctgaccccagctggcccctgctcttcttccccctgctgtgggccctgcccctgctgggccctgtgtag

SEQ ID NO: 165640 - DNA, 903 bp, Artificial Sequence
  Description of Artificial Sequence: Synthetic coding sequence
atgggcgcccggggggccctgctgctggccctgctgctggcccgggccggcctgaggaagccagagagccaggaggccgcccccctgagcggcccctgtggcagaagagtcatcaccagccgcatcgtgggcggggaggatgctgagctgggccgctggccctggcagggcagcctgcggctgtgggacagccacgtgtgtggggtgtccctgctgagccaccgctgggccctgacagctgcccactgctttgagacctacagcgacctgagtgaccccagcggctggatggtgcagtttggccagctgacctccatgcccagcttctggagcctgcaggcctactacacccgctactttgtgagcaacatctacctgagcccccgctacctgggcaacagcccctatgacatcgccctggtgaagctgagcgcccctgtgacctacaccaagcacatccagcccatctgcctgcaggccagcacctttgaatttgagaacagaacagactgctgggtgacaggctggggctacatcaaggaggatgaggccctgcccagcccccacaccctgcaggaggtgcaggtggccatcatcaacaacagcatgtgcaaccacctgttcctgaagtacagcttcaggaaggacatctttggagacatgggagacagcggcggccccctggcctgcaacaagaatggcctgtggtaccagattggagtggtgtcctggggcgtgggctgcggccggcccaacagacctggggtgtacaccaacatcagccaccactttgagtggatccagaagctgatggcccagagcggcatgagccagcctgaccccagctggcccctgctcttcttccccctgctgtgggccctgcccctgctgggccctgtgtag

SEQ ID NO: 165641 - DNA, 939 bp, Artificial Sequence
  Description of Artificial Sequence: Synthetic coding sequence
atgggcgcccggggggccctgctgctggccctgctgctggcccgggccggcctgaggaagccagagagccaggaggccgcccccctgagcggcccctgtggcagaagagtcatcaccagccgcatcgtgggcggggaggatgctgagctgggccgctggccctggcagggcagcctgcggctgtgggacagccacgtgtgtggggtgtccctgctgagccaccgctgggccctgacagctgcccactgctttgaaacagacctgagtgaccccagcggctggatggtgcagtttggccagctgacctccatgcccagcttctggagcctgcaggcctactacacccgctactttgtgagcaacatctacctgagcccccgctacctgggcaacagcccctatgacatcgccctggtgaagctgagcgcccctgtgacctacaccaagcacatccagcccatctgcctgcaggccagcacctttgaatttgagaacagaacagactgctgggtgacaggctggggctacatcaaggaggatgaggccctgcccagcccccacaccctgcaggaggtgcaggtggccatcatcaacaacagcatgtgcaaccacctgttcctgaagtacagcttcaggaaggacatctttggagacatggtgtgtgctggaaatgcccagggcggcaaggatgcctgctttggagacagcggcggccccctggcctgcaacaagaatggcctgtggtaccagattggagtggtgtcctggggcgtgggctgcggccggcccaacagacctggggtgtacaccaacatcagccaccactttgagtggatccagaagctgatggcccagagcggcatgagccagcctgaccccagctggcccctgctcttcttccccctgctgtgggccctgcccctgctgggccctgtgtag

SEQ ID NO: 165642 - DNA, 954 bp, Artificial Sequence
  Description of Artificial Sequence: Synthetic coding sequence
atggtggtgtctggggcccccccagccctgggcggcggctgcctgggcaccttcaccagcctgctgctgctggccagcacagccatcctgaatgctgcccgcatccctgtgcccccagcctgtgggaagccccagcagctgaacagagtggtgggcggggaggacagcacagattctgagtggccctggatcgtgtccatccagaagaatggcacccaccactgtgccggcagcctgctgaccagccgctgggtgatcacagctgcccactgcttcaaggacaacctgaacaagccctacctgttctctgtgctgctgggcgcctggcagctgggcaaccctggcagccgcagccagaaggtgggcgtggcctgggtggagccccaccctgtgtacagctggaaggagggcgcctgtgccgacatcgccctggtgcggctggagaggagcatccagttcagcgagcgggtgctgcccatctgcctgcctgatgccagcatccacctgccccccaacacccactgctggatcagcggctggggcagcatccaggatggagtgcccctgccccacccccagaccctgcagaagctgaaggtgcccatcattgattctgaggtgtgcagccacctgtactggaggggggccggccagggccccatcacagaggacatgctgtgtgccggctacctggagggggagagagatgcctgcctgggggacagcggcggccccctgatgtgccaggtggatggagcctggctgctggccggcatcatctcctggggcgagggctgtgccgagaggaacagacctggggtgtacatcagcctgagcgcccaccgctcctgggtggagaagatcgtgcagggcgtgcagctgcggggccgggcccagggcggcggggccctgcgggcccccagccagggcagcggggccgccgcccggagctag

SEQ ID NO: 165643 - DNA, 786 bp, Artificial Sequence
  Description of Artificial Sequence: Synthetic coding sequence
atgcacatgagggagaccagcggcttcaccctgaagaagggccgcagcgcccccctggtgttccaccccccagatgccctgattgctgtgccctttgatgatgatgacaagatcgtgggcggctacacctgtgaggagaacagcctgccctaccaggtgtccctgaacagcggcagccacttctgtggcggcagcctcatcagcgagcagtgggtggtgtctgctgcccactgctacaagacccgcatccaggtgcggctgggggagcacaacatcaaggtgctggagggcaatgagcagttcatcaatgctgccaagatcatccgccaccccaagtacaacagagacaccctggacaatgacatcatgctgatcaagctgagcagccctgctgtgatcaatgcccgggtgtccaccatcagcctgcccaccaccccacctgctgctggaacagagtgcctgatcagcggctggggcaacaccctgagctttggagctgactacccagatgagctgaagtgcctggatgcccctgtgctgacccaggccgagtgcaaggccagctacccaggcaagatcaccaacagcatgttctgtgtgggcttcctggagggcggcaaggacagctgccagagggacagcggcggccctgtggtgtgcaatggccagctgcagggcgtggtgtcctggggccacggctgtgcctggaagaacagacctggggtgtacaccaaggtgtacaactacgtggactggatcaaggacaccatcgccgccaacagctag

SEQ ID NO: 165644 - DNA, 915 bp, Artificial Sequence
  Description of Artificial Sequence: Synthetic coding sequence
atgtgtggcccagatgaccgctgcccagcccgctggccaggccctggccgggctgtgaagtgtgggaagggcctggccgccgcccggcccggccgggtggagcggggcggggcccagagaggaggagctggcctggagctgcaccccctgctgggcggccgcacctggagggctgccagagatgctgatggctgtgaggccctgggcaccgtggccgtgccctttgatgatgatgacaagatcgtgggcggctacacctgtgaggagaacagcctgccctaccaggtgtccctgaacagcggcagccacttctgtggcggcagcctcatcagcgagcagtgggtggtgtctgctgcccactgctacaagacccgcatccaggtgcggctgggggagcacaacatcaaggtgctggagggcaatgagcagttcatcaatgctgccaagatcatccgccaccccaagtacaacagagacaccctggacaatgacatcatgctgatcaagctgagcagccctgctgtgatcaatgcccgggtgtccaccatcagcctgcccaccaccccacctgctgctggaacagaatgtctcatcagcggctggggcaacaccctgagctttggagctgactacccagatgagctgaagtgcctggatgcccctgtgctgacccaggccgagtgcaaggccagctacccaggcaagatcaccaacagcatgttctgtgtgggcttcctggagggcggcaaggacagctgccagagggacagcggcggccctgtggtgtgcaatggccagctgcagggcgtggtgtcctggggccacggctgtgcctggaagaacagacctggggtgtacaccaaggtgtacaactacgtggactggatcaaggacaccatcgccgccaacagctag

SEQ ID NO: 165645 - DNA, 744 bp, Artificial Sequence
  Description of Artificial Sequence: Synthetic coding sequence
atgaaccccttcctgatcctggcctttgtgggcgctgctgtggccgtgccctttgatgatgatgacaagatcgtgggcggctacacctgtgaggagaacagcctgccctaccaggtgtccctgaacagcggcagccacttctgtggcggcagcctcatcagcgagcagtgggtggtgtctgctgcccactgctacaagacccgcatccaggtgcggctgggggagcacaacatcaaggtgctggagggcaatgagcagttcatcaatgctgccaagatcatccgccaccccaagtacaacagagacaccctggacaatgacatcatgctgatcaagctgagcagccctgctgtgatcaatgcccgggtgtccaccatcagcctgcccaccaccccacctgctgctggaacagagtgcctgatcagcggctggggcaacaccctgagctttggagctgactacccagatgagctgaagtgcctggatgcccctgtgctgacccaggccgagtgcaaggccagctacccaggcaagatcaccaacagcatgttctgtgtgggcttcctggagggcggcaaggacagctgccagagggacagcggcggccctgtggtgtgcaatggccagctgcagggcgtggtgtcctggggccacggctgtgcctggaagaacagacctggggtgtacaccaaggtgtacaactacgtggactggatcaaggacaccatcgccgccaacagctag

SEQ ID NO: 165646 - DNA, 723 bp, Artificial Sequence
  Description of Artificial Sequence: Synthetic coding sequence
atgggccctgctggggaggtggccgtgccctttgatgatgatgacaagatcgtgggcggctacacctgtgaggagaacagcctgccctaccaggtgtccctgaacagcggcagccacttctgtggcggcagcctcatcagcgagcagtgggtggtgtctgctgcccactgctacaagacccgcatccaggtgcggctgggggagcacaacatcaaggtgctggagggcaatgagcagttcatcaatgctgccaagatcatccgccaccccaagtacaacagagacaccctggacaatgacatcatgctgatcaagctgagcagccctgctgtgatcaatgcccgggtgtccaccatcagcctgcccaccaccccacctgctgctggaacagaatgtctcatcagcggctggggcaacaccctgagctttggagctgactacccagatgagctgaagtgcctggatgcccctgtgctgacccaggccgagtgcaaggccagctacccaggcaagatcaccaacagcatgttctgtgtgggcttcctggagggcggcaaggacagctgccagagggacagcggcggccctgtggtgtgcaatggccagctgcagggcgtggtgtcctggggccacggctgtgcctggaagaacagacctggggtgtacaccaaggtgtacaactacgtggactggatcaaggacaccatcgccgccaacagctag

SEQ ID NO: 165647 - DNA, 537 bp, Artificial Sequence
  Description of Artificial Sequence: Synthetic coding sequence
atgagggagaccagcggcttcaccctgaagaagggccgcagcgcccccctggtgttccaccccccagatgccctgattgctgtgccctttgatgatgatgacaagatcgtgggcggctacacctgtgaggagaacagcctgccctaccaggtgtccctgaacagcggcagccacttctgtggcggcagcctcatcagcgagcagtgggtggtgtctgctgcccactgctacaagacccgcatccaggtgcggctgggggagcacaacatcaaggtgctggagggcaatgagcagttcatcaatgctgccaagatcatccgccaccccaagtacaacagagacaccctggacaatgacatcatgctgatcaagctgagcagccctgctgtgatcaatgcccgggtgtccaccatcagcctgcccaccaccccacctgctgctggaacagagtgcctgatcagcggctggggcaacaccctgagctttggagctgactacccagatgagctgaagtgcctggatgcccctgtgctgtag

SEQ ID NO: 165648 - DNA, 843 bp, Artificial Sequence
  Description of Artificial Sequence: Synthetic coding sequence
atgagaggagtgtcctgcctgcaggtgctgctgctgctggtgctgggcgccgccggcacccagggcaggaagtctgctgcctgtggccagcccaggatgagcagcagaattgtgggcggcagagatggaagagatggagagtggccctggcaggccagcatccagcacagaggagcccacgtgtgtggcggcagcctgattgccccccagtgggtgctgacagctgcccactgcttcccccggcgggccctgcctgctgagtacagagtgcggctgggcgccctgcggctgggcagcaccagccccaggaccctgtctgtgcctgtgcggcgggtgctgctgcccccagactacagtgaagatggagcccggggggacctggccctgctgcagctgcggcggcctgtgcccctgagcgcccgggtgcagcctgtgtgcctgcctgtgcctggggcccggcccccacctggcaccccctgccgggtgacaggctggggcagcctgcggcctggggtgcccctgcctgagtggaggcccctgcagggcgtgcgggtgcccctgctggacagcaggacctgtgatggcctgtaccacgtgggcgcagatgtgccccaggccgagagaattgtgctgcccggcagcctgtgtgccggctacccccagggccacaaggatgcctgccagggcgacagcggcggccccctgacctgcctgcagagcggctcctgggtgctggtgggcgtggtgtcctggggcaagggctgtgccctgcccaacagacctggggtgtacacctctgtggccacctacagcccctggatccaggcccgggtgtccttctag

SEQ ID NO: 165649 - DNA, 1032 bp, Artificial Sequence
  Description of Artificial Sequence: Synthetic coding sequence
atggcccagaagggcgtgctgggccctggccagctgggcgctgtggccatcctgctgtacctgggcctgctgcggagcggcaccggggctgagggcgctgaggccccctgtggggtggccccccaggcccgcatcaccggcggcagcagcgctgtggccggccagtggccctggcaggtgtccatcacctatgagggcgtgcacgtgtgtggcggcagcctggtgtctgagcagtgggtgctgtctgctgcccactgcttccccagcgagcaccacaaggaggcctatgaggtgaagctgggcgcccaccagctggacagctacagtgaagatgccaaggtgtccaccctgaaggacatcatcccccaccccagctacctgcaggagggcagccagggcgacatcgccctgctgcagctgagccggcccatcaccttcagccgctacatccggcccatctgcctgcctgctgccaatgccagcttccccaacggcctgcactgcaccgtgacaggctggggccacgtggcccccagcgtgtccctgctgacccccaagcccctgcagcagctggaggtgcccctcatcagccgggagacctgcaactgcctgtacaacattgatgccaagccagaggagccccactttgtgcaggaggacatggtgtgtgccggctacgtggagggcggcaaggatgcctgccagggcgacagcggcggccccctgagctgccctgtggagggcctgtggtacctgactggaattgtgtcctggggagatgcctgtggggccaggaacagacctggggtgtacaccctggccagcagctatgcctcctggatccagagcaaggtgacagagctgcagccccgggtggtgccccagacccaggagagccagcctgacagcaacctgtgtggcagccacctggccttcagcagcgccccagcccagggcctgctgcggcccatcctcttcctgcccctgggcctggccctgggcctgctgagcccctggctgtctgagcactag

SEQ ID NO: 165650 - DNA, 504 bp, Artificial Sequence
  Description of Artificial Sequence: Synthetic coding sequence
atggcccagaagggcgtgctgggccctggccagctgggcgctgtggccatcctgctgtacctgggcctgctgcggagcggcaccgggaaggagggcgccgccgccccctgtggggtggccccccaggcccgcatcaccggcggcagcagcgctgtggccggccagtggccctggcaggtgtccatcaccttcagccgctacatccggcccatctgcctgcctgctgccaatgccagcttccccaacggcctgcactgcaccgtgacaggctggggccacgtggcccccagcgtgtccctgctgacccccaagcccctgcagcagctggaggtgcccctcatcagccgggagacctgcaactgcctgtacaacattgatgccaagccagaggagccccactttgtgcaggaggacatggtgtgtgccggctacgtggagggcgccctgctgcgggtgaccctgggcgcccacagccctgccctgtggagggtgtctggcacctag

SEQ ID NO: 165651 - DNA, 1197 bp, Artificial Sequence
  Description of Artificial Sequence: Synthetic coding sequence
atggagctggaggagggcaaggccggcagcggcctgcggcagtactacctgagcaagattgaggagctgcagctgattgtgaatgacaagagccagaacctgcggcggctgcaggcccagagaaatgagctgaatgccaaggtgcggctgctgcgggaggagctgcagctgctgcaggagcagggcagctatgtgggggaggtggtgcgggccatggacaagaagaaggtgctggtgaaggtgcaccctgagggcaagtttgtggtggatgtggacaagaacatcgacatcaatgatgtgacccccaactgccgggtggccctgagaaatgacagctacaccctgcacaagatcctgcccaacaaggtggaccccctggtgtccctgatgatggtggagaaggtgcctgacagcacctatgagatgattggaggcctggacaagcagatcaaggagatcaaggaggtgattgagctgcctgtgaagcaccctgagctgtttgaggccctgggcatcgcccagcccaagggcgtgctgctgtatggccccccaggcaccgggaagaccctgctggcccgggctgtggcccaccacacagactgcaccttcatccgggtgtctggcagcgagctggtgcagaagttcatcggggagggcgccaggatggtgcgggagctgtttgtgatggcccgggagcacgcccccagcatcatcttcatggatgaaattgacagcatcggcagcagccggctggagggcggcagcggcggggacagcgaggtgcagaggaccatgctggagctgctgaaccagctggatggctttgaggccaccaagaacatcaaggtgatcatggccaccaacagaattgacatcctggacagcgccctgctgcggcccggcagaattgacaggaagattgagttccccccaccaaatgaggaggcccggctggacatcctgaagatccacagcaggaagatgaacctgacccggggcatcaacctgaggaagattgctgagctgatgcctggggccagcggggctgaggtgaagggcgtgtgcacagaggccggcatgtatgccctgcgggagcggcgggtgcacgtgacccaggaggactttgagatggctgtggccaaggtgatgcagaaggacagcgagaagaacatgagcatcaagaagctgtggaagtag

SEQ ID NO: 165652 - DNA, 765 bp, Artificial Sequence
  Description of Artificial Sequence: Synthetic coding sequence
atggccagcctgctgaaggtggaccaggaggtgaagctgaaggtggacagcttccgggagcgcatcaccagcgaggccgaggacctggtggccaacttcttccccaagaagctgctggagctggacagcttcctgaaggagcccatcctgaacatccatgacctgacccagatccacagcgacatgaacctgcctgtgcctgaccccatcctgctgaccaacagccatgatggcctggatggccccacctacaagaagaggcggctggatgaatgtgaggaggccttccagggcaccaaggtgtttgtgatgcccaacggcatgctgaagagcaaccagcagctggtggacatcatcgagaaggtgaagccagagatccggctgctgattgagaagtgcaacacagtgaagatgtgggtgcagctgctgatccccagaattgaagatggcaacaactttggagtgtccatccaggaggagaccgtggccgagctgaggacagtggagagcgaggccgccagctacctggaccagatcagccgctactacatcacccgggccaagctggtgtccaagatcgccaagtacccccacgtggaggactacagaagaacagtgacagaaattgatgagaaggagtacatcagcctgcggctcatcatcagcgagctgaggaaccagtatgtgaccctgcatgacatgatcctgaagaacatcgagaagatcaagaggcccaggagcagcaatgctgagaccctgtactag

SEQ ID NO: 165653 - DNA, 1323 bp, Artificial Sequence
  Description of Artificial Sequence: Synthetic coding sequence
atgggccagagccagagcggcggccacggccctgggggcggcaagaaggatgacaaggacaagaagaagaagtatgagccccctgtgcccaccagggtgggcaagaagaagaagaagaccaagggcccagatgctgccagcaagctgcccctggtgaccccccacacccagtgccgcctgaagctgctgaagctggagcgcatcaaggactacctgctgatggaggaggagttcatccggaaccaggagcagatgaagcccctggaggagaagcaggaggaggagaggagcaaggtggatgacctgcggggcacccccatgtctgtgggcaccctggaggagatcattgatgacaaccacgccatcgtgtccacctctgtgggcagcgagcactacgtgtccatcctgagctttgtggacaaggacctgctggagcccggctgcagcgtgctgctgaaccacaaggtgcacgccgtcatcggcgtgctgatggatgacacagaccccctggtgacagtgatgaaggtggagaaggccccccaggagacctatgctgacattggaggcctggacaaccagatccaggagatcaaggagagcgtggagctgcccctgacccaccctgagtactatgaggagatgggcatcaagccacccaagggcgtcatcctgtatggccccccaggcaccgggaagaccctgctggccaaggctgtggccaaccagaccagcgccaccttcctgcgggtggtgggcagcgagctgatccagaagtacctgggagatggccccaagctggtgcgggagctgttccgggtggccgaggagcacgcccccagcatcgtgttcattgatgaaattgatgccatcggcaccaagagatatgacagcaacagcggcggggagcgggagatccagaggaccatgctggagctgctgaaccagctggatggctttgacagcagaggagatgtgaaggtgatcatggccaccaaccgcatcgagaccctggaccctgccctgatccggcccggcagaattgacaggaagattgagttccccctgcctgatgagaagaccaagaagaggatcttccagatccacaccagcaggatgaccctggctgatgatgtgaccctggatgacctgatcatggccaaggatgacctgtctggagctgacatcaaggccatctgcacagaggccggcctgatggccctgcgggagaggaggatgaaggtgaccaatgaagacttcaagaagagcaaagaaaatgtgctgtacaagaagcaggagggcaccccagagggcctgtacctgtag

SEQ ID NO: 165654 - DNA, 1104 bp, Artificial Sequence
  Description of Artificial Sequence: Synthetic coding sequence
atggaggaggagttcatccggaaccaggagcagatgaagcccctggaggagaagcaggaggaggagaggagcaaggtggatgacctgcggggcacccccatgtctgtgggcaccctggaggagatcattgatgacaaccacgccatcgtgtccacctctgtgggcagcgagcactacgtgtccatcctgagctttgtggacaaggacctgctggagcccggctgcagcgtgctgctgaaccacaaggtgcatgctgtgattggagtgctgatggatgacacagaccccctggtgacagtgatgaaggtggagaaggccccccaggagacctacgccgacatcggcggcctggacaaccagatccaggagatcaaggagagcgtggagctgcccctgacccaccctgagtactatgaggagatgggcatcaagccacccaagggcgtcatcctgtatggccccccaggcaccgggaagaccctgctggccaaggctgtggccaaccagaccagcgccaccttcctgcgggtggtgggcagcgagctgatccagaagtacctgggagatggccccaagctggtgcgggagctgttccgggtggccgaggagcacgcccccagcatcgtgttcattgatgaaattgatgccatcggcaccaagagatatgacagcaacagcggcggggagcgggagatccagaggaccatgctggagctgctgaaccagctggatggctttgacagcagaggagatgtgaaggtgatcatggccaccaacagaattgagaccctggaccctgccctgatccggcccggcagaattgacaggaagattgagttccccctgcctgatgagaagaccaagaagaggatcttccagatccacaccagcaggatgaccctggctgatgatgtgaccctggatgacctgatcatggccaaggatgacctgagcggggctgacatcaaggccatctgcacagaagctggcctgatggccctgcgggagaggaggatgaaggtgaccaatgaagacttcaagaagagcaaagaaaatgtgctgtacaagaagcaggagggcaccccagagggcctgtacctgtag

SEQ ID NO: 165655 - DNA, 1302 bp, Artificial Sequence
  Description of Artificial Sequence: Synthetic coding sequence
atgccagactacctgggcgctgaccagaggaagaccaaggaggatgagaaggatgacaagcccatccgggccctggatgaaggagacatcgccctgctgaagacctacggccagagcacctacagccggcagatcaagcaggtggaggatgacatccagcagctgctgaagaagatcaatgagctgaccggcatcaaggagagtgacaccggcctggcccccccagccctgtgggacctggccgctgacaagcagaccctgcagagcgagcagcccctgcaggtggcccgctgcaccaagatcatcaatgctgacagcgaggaccccaagtacatcatcaacgtgaagcagtttgccaagtttgtggtggacctgagtgaccaggtggcccccacagacatcgaggagggcatgagggtgggcgtggacaggaacaagtaccagatccacatccccctgccccccaagattgaccccaccgtgaccatgatgcaggtggaggagaagccagatgtgacctacagtgatgtgggcggctgcaaggagcagatcgagaagctgcgggaggtggtggagacccccctgctgcaccctgagagatttgtgaacctgggcatcgagccccccaagggcgtgctgctgtttggacctcctggcaccgggaagaccctgtgtgcccgggctgtggccaacagaacagatgcctgcttcatccgggtgattggcagcgagctggtgcagaagtatgtgggggagggcgccaggatggtgcgggagctgtttgagatggcccggaccaagaaggcctgcctgatcttctttgatgaaattgatgccatcggcggggccaggtttgatgatggagctggaggagacaatgaggtgcagaggaccatgctggagctgatcaaccagctggatggctttgacccccggggcaacatcaaggtgctgatggccaccaacagaccagacaccctggaccctgccctgatgaggcctggccgcctggacaggaagattgagttcagcctgcctgacctggagggccgcacccacatcttcaagatccacgcccgctccatgtctgtggagcgggacatccgctttgagctgctggcccggctgtgccccaacagcactggagctgagatccgctctgtgtgcacagaggccggcatgtttgccatccgggcccggaggaagatcgccacagagaaggacttcctggaggccgtgaacaaggtgatcaagagctatgccaagttcagcgccaccccccgctacatgacctacaactag

SEQ ID NO: 165656 - DNA, 393 bp, Artificial Sequence
  Description of Artificial Sequence: Synthetic coding sequence
atgccagactacctgggcgctgaccagaggaagaccaaggaggatgagaaggatgacaagcccatccgggccctggatgaaggagacatcgccctgctgaagacctacggccagagcacctacagccggcagatcaagcaggtggaggatgacatccagcagctgctgaagaagatcaatgagctgaccggcatcaaggagagtgacaccggcctggcccccccagccctgtgggacctggccgctgacaagcagaccctgcagagcgagcagcccctgcaggtggcccgctgcaccaagatcatcaatgctgacagcgaggaccccaagtacatcatcaacgtgaagcagtttgccaagtttgtggtggacctgagtgaccaggtggcctag

SEQ ID NO: 165657 - DNA, 1302 bp, Artificial Sequence; identical to SEQ ID NO: 165655
  Description of Artificial Sequence: Synthetic coding sequence

SEQ ID NO: 165658 - DNA, 393 bp, Artificial Sequence; identical to SEQ ID NO: 165656
  Description of Artificial Sequence: Synthetic coding sequence

SEQ ID NO: 165659 - DNA, 891 bp, Artificial Sequence
  Description of Artificial Sequence: Synthetic coding sequence
atgagggtgggcgtggacaggaacaagtaccagatccacatccccctgccccccaagattgaccccaccgtgaccatgatgcaggtggaggagaagccagatgtgacctacagtgatgtgggcggctgcaaggagcagatcgagaagctgcgggaggtggtggagacccccctgctgcaccctgagagatttgtgaacctgggcatcgagccccccaagggcgtgctgctgtttggccccccaggcaccgggaagaccctgtgtgcccgggctgtggccaacagaacagatgcctgcttcatccgggtcatcggcagcgagctggtgcagaagtatgtgggggagggcgccaggatggtgcgggagctgtttgagatggcccggaccaagaaggcctgcctgatcttctttgatgaaattgatgccatcggcggggccaggtttgatgatggagctggaggagacaatgaggtgcagaggaccatgctggagctgatcaaccagctggatggctttgacccccggggcaacatcaaggtgctgatggccaccaacagaccagacaccctggaccctgccctgatgaggcctggccgcctggacaggaagattgagttcagcctgcctgacctggagggccgcacccacatcttcaagatccacgcccgctccatgtctgtggagcgggacatccgctttgagctgctggcccggctgtgccccaacagcactggagctgagatccgctctgtgtgcacagaagctggcatgtttgccatccgggcccggaggaagatcgccacagagaaggacttcctggaggccgtgaacaaggtgatcaagagctatgccaagttcagcgccaccccccgctacatgacctacaactag

SEQ ID NO: 165660 - DNA, 1320 bp, Artificial Sequence
  Description of Artificial Sequence: Synthetic coding sequence
atgaacctgctgcccaacatcgagagccctgtgacccggcaggagaagatggccaccgtgtgggatgaggccgagcaggacggcattggagaggaggtgctgaagatgagcacagaggagatcatccagaggacccggctgctggacagcgagatcaagatcatgaagtctgaggtgctgcgggtgacccatgagctgcaggccatgaaggacaagatcaaggaaaattctgagaagatcaaggtgaacaagaccctgccctacctggtgtccaatgtcatcgagctgctggatgtggaccccaatgaccaggaggaggatggagccaacatcgacctggacagccagaggaagggcaaatgtgccgtcatcaagaccagcacccggcagacctacttcctgcctgtgattggcctggtggatgctgagaagctgaagccaggggacctggtgggcgtgaacaaggacagctacctgatcctggagaccctgcccacagaatatgacagccgggtgaaggccatggaggtggatgagcggcccacagagcagtacagcgacatcggcggcctggacaagcagatccaggagctggtggaggccatcgtgctgcccatgaaccacaaggagaagtttgagaacctgggcatccagccccccaagggcgtgctgatgtatggccccccaggcaccgggaagaccctgctggcccgggcctgtgccgcccagaccaaggccaccttcctgaagctggccggcccccagctggtgcagatgtttattggagatggagccaagctggtgagagatgcctttgccctggccaaggagaaggcccccagcatcatcttcattgatgagctggatgccatcggcaccaagagatttgacagcgagaaggccggggaccgggaggtgcagaggaccatgctggagctgctgaaccagctggatggcttccagcccaacacccaggtgaaggtgattgctgccaccaacagagtggacatcctggaccctgccctgctgcggagcggccgcctggacaggaagattgagttccccatgcccaatgaggaggcccgggcccgcatcatgcagatccacagcaggaagatgaatgtgtccccagatgtgaactatgaggagctggcccgctgcacagatgacttcaacggggcccagtgcaaggctgtgtgtgtggaggccggcatgattgccctgcggcggggggccacagagctgacccatgaggactacatggagggcatcctggaggtgcaggccaagaagaaggccaacctgcagtactatgcctag

SEQ ID NO: 165661 - DNA, 1257 bp, Artificial Sequence
  Description of Artificial Sequence: Synthetic coding sequence
atggaggagatcggcatcctggtggagaaggcccaggatgagatcccagccctgtctgtgtcccggccccagacaggcctgtccttcctgggccctgagcctgaggacctggaggacctgtacagccgctacaagaagctgcagcaggagctggagttcctggaggtgcaggaggagtacatcaaggatgagcagaagaacctgaagaaggagttcctgcacgcccaggaggaggtgaagaggatccagagcatccccctggtgattggccagttcctggaggccgtggaccagaacacagccatcgtgggcagcaccaccggcagcaactactacgtgcgcatcctgagcaccatcgaccgggagctgctgaagcccaatgcctctgtggccctgcacaagcacagcaatgccctggtggatgtgctgcccccagaggccgacagcagcatcatgatgctgaccagtgaccagaagccagatgtgatgtatgctgacattggaggcatggacatccagaagcaggaggtgcgggaggccgtggagctgcccctgacccactttgagctgtacaagcagatcggcatcgaccccccccggggcgtgctgatgtatggccccccaggctgtgggaagaccatgctggccaaggctgtggcccaccacaccacagctgccttcatccgggtggtgggcagcgagtttgtgcagaagtacctgggggagggccccaggatggtgagagatgtgttccggctggccaaggaaaatgccccagccatcatcttcattgatgaaattgatgccatcgccaccaagagatttgatgcccagacaggagctgaccgggaggtgcagaggatcctgctggagctgctgaaccagatggatggctttgaccagaatgtgaatgtgaaggtgatcatggccaccaacagagctgacaccctggaccctgccctgctgcggcccggccgcctggacaggaagattgagttccccctgcctgaccggcggcagaagaggctcatcttcagcaccatcaccagcaagatgaacctgtctgaggaggtggacctggaggactatgtggcccggccagacaagatctctggagctgacatcaacagcatctgccaggagagcggcatgctggccgtgagagaaaatcgctacatcgtgctggccaaggactttgagaaggcctacaagacagtcatcaagaaggatgagcaggagcacgagttctacaagtag

SEQ ID NO: 165662 - DNA, 1164 bp, Artificial Sequence
  Description of Artificial Sequence: Synthetic coding sequence
atggaggagatcggcatcctggtggagaaggcccaggatgagatcccagccctgtctgtgtcccggccccagacaggcctgtccttcctgggccctgagcctgaggacctggaggacctgtacagccgctacaaggaggaggtgaagaggatccagagcatccccctggtgattggccagttcctggaggccgtggaccagaacacagccatcgtgggcagcaccaccggcagcaactactacgtgcgcatcctgagcaccatcgaccgggagctgctgaagcccaatgcctctgtggccctgcacaagcacagcaatgccctggtggatgtgctgcccccagaggccgacagcagcatcatgatgctgaccagtgaccagaagccagatgtgatgtatgctgacatcggcggcatggacatccagaagcaggaggtgcgggaggccgtggagctgcccctgacccactttgagctgtacaagcagattggaattgatcctccccggggcgtgctgatgtatggccccccaggctgcggcaagaccatgctggccaaggctgtggcccaccacaccacagctgccttcatccgggtggtgggcagcgagtttgtgcagaagtacctgggggagggccccaggatggtgagagatgtgttccggctggccaaggaaaatgccccagccatcatcttcattgatgaaattgatgccatcgccaccaagagatttgatgcccagacaggagctgaccgggaggtgcagaggatcctgctggagctgctgaaccagatggatggctttgaccagaatgtgaatgtgaaggtgatcatggccaccaacagagctgacaccctggaccctgccctgctgcggcccggccgcctggacaggaagattgagttccccctgcctgaccggcggcagaagaggctcatcttcagcaccatcaccagcaagatgaacctgtctgaggaggtggacctggaggactatgtggcccggccagacaagatcagcggggctgacatcaacagcatctgccaggagagcggcatgctggccgtgcgggagaaccgctacatcgtgctggccaaggactttgagaaggcctacaagacagtcatcaagaaggatgagcaggagcacgagttctacaagtag

SEQ ID NO: 165663 - DNA, 1221 bp, Artificial Sequence
  Description of Artificial Sequence: Synthetic coding sequence
atggccctggatggccctgagcagatggagctggaggagggcaaggccggcagcggcctgcggcagtactacctgagcaagattgaggagctgcagctgattgtgaatgacaagagccagaacctgcggcggctgcaggcccagagaaatgagctgaatgccaaggtgcggctgctgcgggaggagctgcagctgctgcaggagcagggcagctatgtgggggaggtggtgcgggccatggacaagaagaaggtgctggtgaaggtgcaccctgagggcaagtttgtggtggatgtggacaagaacatcgacatcaatgatgtgacccccaactgccgggtggccctgagaaatgacagctacaccctgcacaagatcctgcccaacaaggtggaccccctggtgtccctgatgatggtggagaaggtgcctgacagcacctatgagatgattggaggcctggacaagcagatcaaggagatcaaggaggtgattgagctgcctgtgaagcaccctgagctgtttgaggccctgggcatcgcccagcccaagggcgtgctgctgtatggccccccaggcaccgggaagaccctgctggcccgggctgtggcccaccacacagactgcaccttcatccgggtgtctggcagcgagctggtgcagaagttcatcggggagggcgccaggatggtgcgggagctgtttgtgatggcccgggagcacgcccccagcatcatcttcatggatgaaattgacagcatcggcagcagccggctggagggcggcagcggcggggacagcgaggtgcagaggaccatgctggagctgctgaaccagctggatggctttgaggccaccaagaacatcaaggtgatcatggccaccaacagaattgacatcctggacagcgccctgctgcggcccggcagaattgacaggaagattgagttccccccaccaaatgaggaggcccggctggacatcctgaagatccacagcaggaagatgaacctgacccggggcatcaacctgaggaagattgctgagctgatgcctggggccagcggggctgaggtgaagggcgtgtgcacagaggccggcatgtatgccctgcgggagcggcgggtgcacgtgacccaggaggactttgagatggctgtggccaaggtgatgcagaaggacagcgagaagaacatgagcatcaagaagctgtggaagtag

SEQ ID NO: 165664 - DNA, 1197 bp, Artificial Sequence; identical to SEQ ID NO: 165651
  Description of Artificial Sequence: Synthetic coding sequence

SEQ ID NO: 165665 - DNA, 1212 bp, Artificial Sequence
  Description of Artificial Sequence: Synthetic coding sequence
atggccatccctggcatcccctatgaaagaaggctgctgatcatggctgacccccgggacaaggccctgcaggactacaggaagaagctgctggagcacaaggagattgatggccgcctgaaggagctgcgggagcagctgaaggagctgaccaagcagtatgagaagtcagaaaatgacctgaaggccctgcagagcgtgggccagatcgtgggggaggtgctgaagcagctgacagaggagaagttcatcgtgaaggccaccaacggccccaggtatgtggtgggctgccggcggcagctggacaagagcaagctgaagccaggcaccagggtggccctggacatgaccaccctgaccatcatgagatacctgccccgggaggtggaccccctggtgtacaacatgagccatgaagatcctggaaatgtgtcctacagcgagattggaggcctgtctgagcagatccgggagctgcgggaggtgattgagctgcccctgaccaaccctgagctgttccagagggtgggcatcatcccccccaagggctgcctgctgtatggccccccaggcaccgggaagaccctgctggcccgggctgtggccagccagctggactgcaacttcctgaaggtggtgagcagcagcatcgtggacaagtacatcggggagagcgcccggctcatccgggagatgttcaactatgcccgggaccaccagccctgcatcatcttcatggatgaaattgatgccatcggcggccgccgcttcagcgagggcaccagcgctgaccgggagatccagaggaccctgatggagctgctgaaccagatggatggctttgacaccctgcaccgggtgaagatgatcatggccaccaacagaccagacaccctggaccctgccctgctgcggcccggccgcctggacaggaagatccacatcgacctgcccaatgagcaggcccggctggacatcctgaagatccatgctggccccatcaccaagcatggagaaattgattatgaggccatcgtgaagctgagtgatggcttcaatggagctgacctgagaaatgtgtgcacagaggccggcatgtttgccatccgggctgaccatgactttgtggtgcaggaggacttcatgaaggctgtgaggaaggtggccgacagcaagaagctggagagcaagctggactacaagcctgtgtag

SEQ ID NO: 165666 - DNA, 933 bp, Artificial Sequence
  Description of Artificial Sequence: Synthetic coding sequence
atggaccggctgctgcggctgggcggcggcatgcctggcctgggccagggccccccaacagatgccccagctgtggacacagctgagcaggtgtacatcagcagcctggccctgctgaagatgctgaagcacggccgggccggcgtgcccatggaggtgatgggcctgatgctgggggagtttgtggatgactacacagtgcgggtgattgatgtgtttgccatgccccagagcggcaccggggtgtctgtggaggccgtggaccctgtgttccaggccaagatgctggacatgctgaagcagacaggccggcctgagatggtggtgggctggtaccacagccaccctggcttcggctgctggctgtctggagtggacatcaacacccagcagagctttgaggccctgtctgaaagagctgtggccgtggtggtggaccccatccagagcgtgaagggcaaggtggtgattgatgccttccgcctcatcaatgccaacatgatggtgctgggccacgagccccggcagaccaccagcaacctgggccacctgaacaagcccagcatccaggccctgatccacggcctgaacagacactactacagcatcaccatcaactacaggaagaatgagctggagcagaagatgctgctgaacctgcacaagaagtcctggatggagggcctgaccctgcaggactacagcgagcactgcaagcacaatgaatctgtggtgaaggagatgctggagctggccaagaactacaacaaggctgtggaggaggaggacaagatgaccccagagcagctggccatcaagaatgtgggcaagcaggaccccaagaggcacctggaggagcacgtggatgtgctgatgaccagcaacatcgtgcagtgcctggccgccatgctggacacagtggtgttcaagtag

SEQ ID NO: 165667 - DNA, 255 bp, Artificial Sequence
  Description of Artificial Sequence: Synthetic coding sequence
atggaccggctgctgcggctgggcggcggcatgcctggcctgggccagggccccccaacagatgccccagctgtggacacagctgagcaggtgtacatcagcagcctggccctgctgaagatgctgaagcacggccgggccggcgtgcccatggaggtgatgggcctgatgctgggggagtttgtggatgactacacagtgcgggtgattgatgtgtttgccatgccccagagcggcaccggggtgtctgtgtag

SEQ ID NO: 165668 - DNA, 2727 bp, Artificial Sequence
  Description of Artificial Sequence: Synthetic coding sequence
atggaggagggcggccgggacaaggcccctgtgcagccccagcagagccctgctgctgcccctgggggcacagatgagaagcccagcggcaaggagaggagagatgctggggacaaggacaaggagcaggagctgtctgaggaggacaagcagctgcaggatgagctggagatgctggtggagcggctgggggagaaggacaccagcctgtacagacctgccctggaggagctgcggcggcagatccgcagcagcaccacctccatgacctctgtgcccaagcccctgaagttcctgcggccccactacggcaagctgaaggagatctatgagaacatggcccctggagagaacaagagatttgctgctgacatcatctctgtgctggccatgaccatgtctggagagcgggagtgcctgaagtaccgcctggtgggcagccaggaggagctggcctcctggggccacgagtatgtgcgccacctggccggggaggtggccaaggagtggcaggagctggatgatgctgagaaggtgcagcgggagcccctgctgaccctggtgaaggagatcgtgccctacaacatggcccacaatgctgagcacgaggcctgtgacctgctgatggagattgagcaggtggacatgctggagaaggacattgatgaaaatgcctatgccaaggtgtgcctgtacctgaccagctgtgtgaactacgtgcctgagcctgagaacagcgccctgctgcgctgtgccctgggcgtcttcaggaagttcagccgcttccctgaggccctgcggctggccctgatgctgaatgacatggagctggtggaggacatcttcaccagctgcaaggatgtggtggtgcagaagcagatggccttcatgctgggcagacatggagtcttcctggagctgtctgaagatgtggaggagtatgaggacctgacagagatcatgagcaatgtgcagctgaacagcaacttcctggccctggcccgggagctggacatcatggagcccaaggtgcctgatgacatctacaagacccacctggagaacaacagatttggaggcagcggcagccaggtggacagcgccaggatgaacctggccagcagctttgtgaatggatttgtgaatgctgccttcggccaggacaagctgctgacagatgatggcaacaagtggctgtacaagaacaaggaccacggcatgctgtctgctgctgccagcctgggcatgatcctgctgtgggatgtggatggcggcctgacccagattgacaagtacctgtacagcagcgaggactacatcaagagcggggccctgctggcctgtggcatcgtgaacagcggcgtgagaaatgaatgtgaccctgccctggccctgctgagtgactatgtgctgcacaacagcaacaccatgaggctgggcagcatcttcggcctgggcctggcctatgccggcagcaacagagaagatgtgctgaccctgctgctgcctgtgatgggagacagcaagagctccatggaggtggccggcgtgacagccctggcctgtggcatgattgctgtgggcagctgcaatggagatgtgaccagcaccatcctgcagaccatcatggagaagtcagaaacagagctgaaggacacctacgcccgctggctgcccctgggcctgggcctgaaccacctgggcaaaggagaggccatcgaggccatcctggccgccctggaggtggtgtctgagcccttccgcagctttgccaacaccctggtggatgtgtgtgcctatgccggcagcggaaatgtgctgaaggtgcagcagctgctgcacatctgcagcgagcactttgacagcaaggagaaggaggaggacaaggacaagaaggagaagaaggacaaggacaagaaggaggccccagctgacatgggcgcccaccagggcgtggccgtgctgggcatcgccctgattgccatgggagaggagatcggggctgagatggccctgcggaccttcggccacctgctgcgctatggagagcccaccctgcggcgggctgtgcccctggccctggccctgatctctgtgagcaacccccggctgaacatcctggacaccctgagcaagttcagccatgatgctgaccctgaggtgtcctacaacagcatctttgccatgggcatggtgggcagcggcaccaacaatgcccggctggccgccatgctgcggcagctggcccagtaccacgccaaggaccccaacaacctcttcatggtgcggctggcccagggcctgacccacctgggcaagggcaccctgaccctgtgcccctaccacagcgaccggcagctgatgagccaggtggccgtggccggcctgctgactgtgctggtgtccttcctggatgtgaggaacatcatcctgggcaagagccactacgtgctgtatggcctggtggccgccatgcagcccaggatgctggtgacctttgatgaggagctgcggcccctgcctgtgtctgtgcgggtgggccaggccgtggatgtggtgggccaggccggcaagcccaagaccatcaccggcttccagacccacaccacccctgtgctgctggcccacggggagcgggcagagctggccacagaggagttcctgcctgtgacccccatcctggagggctttgtgatcctgaggaagaaccccaactatgacctgtag

SEQ ID NO: 165669 - DNA, 1743 bp, Artificial Sequence
  Description of Artificial Sequence: Synthetic coding sequence
cagtgcacagcccagcagcagctgctgggcctgagcagtggagctggccaccacggggcccagctgatgctgcagaaccccccccgggagcagcaggtgtggggccagtggctgagcggcggcctgtgcccccatgagcccggcctgctcttctgtgagtggctgtgtgaatgttccttctgggacaagctgctgacagatgatggcaacaagtggctgtacaagaacaaggaccacggcatgctgtctgctgctgccagcctgggcatgatcctgctgtgggatgtggatggcggcctgacccagattgacaagtacctgtacagcagcgaggactacatcaagagcggggccctgctggcctgtggcatcgtgaacagcggcgtgagaaatgaatgtgaccctgccctggccctgctgagtgactatgtgctgcacaacagcaacaccatgaggctgggcagcatcttcggcctgggcctggcctatgccggcagcaacagagaagatgtgctgaccctgctgctgcctgtgatgggagacagcaagagctccatggaggtggccggcgtgacagccctggcctgtggcatgattgctgtgggcagctgcaatggagatgtgaccagcaccatcctgcagaccatcatggagaagtcagaaacagagctgaaggacacctacgcccgctggctgcccctgggcctgggcctgaaccacctgggcaaaggagaggccatcgaggccatcctggccgccctggaggtggtgtctgagcccttccgcagctttgccaacaccctggtggatgtgtgtgcctatgccggcagcggaaatgtgctgaaggtgcagcagctgctgcacatctgcagcgagcactttgacagcaaggagaaggaggaggacaaggacaagaaggagaagaaggacaaggacaagaaggaggccccagctgacatgggcgcccaccagggcgtggccgtgctgggccccctgctgctgtggggccgccgcctggtgcagcgctggcactatgagccctaccaccagctgcgctatggagagcccaccctgcggcgggctgtgcccctggccctggccctgatctctgtgagcaacccccggctgaacatcctggacaccctgagcaagttcagccatgatgctgaccctgaggtgtcctacaacagcatctttgccatgggcatggtgggcagcggcaccaacaatgcccggctggccgccatgctgcggcagctggcccagtaccacgccaaggaccccaacaacctcttcatggtgcggctggcccagggcctgacccacctgggcaagggcaccctgaccctgtgcccctaccacagcgaccggcagctgatgagccaggtggccgtggccggcctgctgactgtgctggtgtccttcctggatgtgaggaacatcatcctgggcaagagccactacgtgctgtatggcctggtggccgccatgcagcccaggatgctggtgacctttgatgaggagctgcggcccctgcctgtgtctgtgcgggtgggccaggccgtggatgtggtgggccaggccggcaagcccaagaccatcaccggcttccagacccacaccacccctgtgctgctggcccacggggagcgggcagagctggccacagaggagttcctgcctgtgacccccatcctggagggctttgtgtttggaagaacacccatcatgatcagcaagtag

SEQ ID NO: 165670 - DNA, 2703 bp, Artificial Sequence
  Description of Artificial Sequence: Synthetic coding sequence
atggaggagggcggccgggacaaggcccctgtgcagccccagcagagccctgctgctgcccctgggggcacagatgagaagcccagcggcaaggacaaggagcaggagctgtctgaggaggacaagcagctgcaggatgagctggagatgctggtggagcggctgggggagaaggacaccagcctgtacagacctgccctggaggagctgcggcggcagatccgcagcagcaccacctccatgacctctgtgcccaagcccctgaagttcctgcggccccactacggcaagctgaaggagatctatgagaacatggcccctggagagaacaagagatttgctgctgacatcatctctgtgctggccatgaccatgtctggagagcgggagtgcctgaagtaccgcctggtgggcagccaggaggagctggcctcctggggccacgagtatgtgcgccacctggccggggaggtggccaaggagtggcaggagctggatgatgctgagaaggtgcagcgggagcccctgctgaccctggtgaaggagatcgtgccctacaacatggcccacaatgctgagcacgaggcctgtgacctgctgatggagattgagcaggtggacatgctggagaaggacattgatgaaaatgcctatgccaaggtgtgcctgtacctgaccagctgtgtgaactacgtgcctgagcctgagaacagcgccctgctgcgctgtgccctgggcgtcttcaggaagttcagccgcttccctgaggccctgcggctggccctgatgctgaatgacatggagctggtggaggacatcttcaccagctgcaaggatgtggtggtgcagaagcagatggccttcatgctgggcagacatggagtcttcctggagctgtctgaagatgtggaggagtatgaggacctgacagagatcatgagcaatgtgcagctgaacagcaacttcctggccctggcccgggagctggacatcatggagcccaaggtgcctgatgacatctacaagacccacctggagaacaacagatttggaggcagcggcagccaggtggacagcgccaggatgaacctggccagcagctttgtgaatggatttgtgaatgctgccttcggccaggacaagctgctgacagatgatggcaacaagtggctgtacaagaacaaggaccacggcatgctgtctgctgctgccagcctgggcatgatcctgctgtgggatgtggatggcggcctgacccagattgacaagtacctgtacagcagcgaggactacatcaagagcggggccctgctggcctgtggcatcgtgaacagcggcgtgagaaatgaatgtgaccctgccctggccctgctgagtgactatgtgctgcacaacagcaacaccatgaggctgggcagcatcttcggcctgggcctggcctatgccggcagcaacagagaagatgtgctgaccctgctgctgcctgtgatgggagacagcaagagctccatggaggtggccggcgtgacagccctggcctgtggcatgattgctgtgggcagctgcaatggagatgtgaccagcaccatcctgcagaccatcatggagaagtcagaaacagagctgaaggacacctacgcccgctggctgcccctgggcctgggcctgaaccacctgggcaaaggagaggccatcgaggccatcctggccgccctggaggtggtgtctgagcccttccgcagctttgccaacaccctggtggatgtgtgtgcctatgccggcagcggaaatgtgctgaaggtgcagcagctgctgcacatctgcagcgagcactttgacagcaaggagaaggaggaggacaaggacaagaaggagaagaaggacaaggacaagaaggaggccccagctgacatgggcgcccaccagggcgtggccgtgctgggcatcgccctgattgccatgggagaggagatcggggctgagatggccctgcggaccttcggccacctgctgcgctatggagagcccaccctgcggcgggctgtgcccctggccctggccctgatctctgtgagcaacccccggctgaacatcctggacaccctgagcaagttcagccatgatgctgaccctgaggtgtcctacaacagcatctttgccatgggcatggtgggcagcggcaccaacaatgcccggctggccgccatgctgcggcagctggcccagtaccacgccaaggaccccaacaacctcttcatggtgcggctggcccagggcctgacccacctgggcaagggcaccctgaccctgtgcccctaccacagcgaccggcagctgatgagccaggtggccgtggccggcctgctgactgtgctggtgtccttcctggatgtgaggaacatcatcctgggcaagagccactacgtgctgtatggcctggtggccgccatgcagcccaggatgctggtgacctttgatgaggagctgcggcccctgcctgtgtctgtgcgggtgggccaggccgtggatgtggtgggccaggccggcaagcccaagaccatcaccggcttccagacccacaccacccctgtgctgctggcccacggggagcgggcagagctggccacagaggagttcctgcctgtgacccccatcctggagggctttgtgatcctgaggaagaaccccaactatgacctgtag

SEQ ID NO: 165671 - DNA, 552 bp, Artificial Sequence
  Description of Artificial Sequence: Synthetic coding sequence
atggatgccagccccagccccttcagcctgcccaagaagctgaatgagctgagcgcccggcggggcagtgatgagctgctgagcagcggcatcatcaatggccccttcaccatgaacagcagcacccccagcacagccaatggaaatgacagcaagaagttcaagagggacaggcctccctgcagccccagccgggtgctgcacctgaggaagatcccctgtgatgtgacagaagctgagatcatcagcctgggcctgccctttgggaaggtgaccaacctgctgatgctgaagggcaagagccaggccttcctggagatggccagcgaggaggccgctgtgaccatggtgaactactacacccccatcaccccccacctgcggagccagcctgtgtacatccagtacagcaaccaccgggagctgaagacagacaacctgcccaaccaggcccgggcccaggccgccctgcaggccgtgtctgctgtgcagagcggcagcctggccctgagcggcggccccagcaatgaaggaacagtgctgcccggctag

SEQ ID NO: 165672 - DNA, 474 bp, Artificial Sequence
  Description of Artificial Sequence: Synthetic coding sequence
atggtgaccagcctggcctacacccaccacggccggcagtacctggcccaggagggcgtgattgaccagatcagcaacatcatcgtgggcgctgacagcgaccccttcagcagcttctacctgcccggctttgtgaagttcttcggcaacctggccgtgatggacagcccccagcagatctgtgagcgctaccccatctttgtggagaaggtgtttgagatgattgagagccaggaccccaccatgattggagtggccgtggacacagtgggcatcctgggcagcaatgtggagggcaagcaggtgctgcagaagacaggctggtatgacctggccctcttccgggacatcctgatctttgaccggggcagcatctgcaagttcatctgctggtgggtgaactacatcgtggagaccatcctgtgggtggccgtgctgctgaccatgaccctgtacagctgcctgaagatctag

SEQ ID NO: 165673 - DNA, 1386 bp, Artificial Sequence
  Description of Artificial Sequence: Synthetic coding sequence
atggccgcccaggccctggccctgctgcgggaggtggcccggctggaggcccccctggaggagctgcgggccctgcacagcgtgctgcaggccgtgcccctgaatgagctgcggcagcaggccgctgagctgcggctgggccccctcttcagcctgctgaatgaaaaccaccgggagaagaccaccctgtgtgtgtccatcctggagcggctgctgcaggccatggagcctgtgcacgtggccaggaacctgcgggtggacctgcagaggggcctcatccacccagatgacagcgtgaagatcctgaccctgagccagatcggccgcatcgtggagaacagtgatgctgtgacagagatcctgaacaatgctgagctgctgaagcagatcgtgtactgcattggaggagagaacctgtctgtggccaaggccctgatcatcgagatcagctctgtgtccccagagagcctgaactactgcaccaccagcggcctggtgacccagctgctgcgggagctgaccggggaggatgtgctggtgcgggccacctgcatcgagatggtgaccagcctggcctacacccaccacggccggcagtacctggcccaggagggcgtgattgaccagatcagcaacatcatcgtgggcgctgacagcgaccccttcagcagcttctacctgcccggctttgtgaagttcttcggcaacctggccgtgatggacagcccccagcagatctgtgagcgctaccccatctttgtggagaaggtgtttgagatgattgagagccaggaccccaccatgattggagtggccgtggacacagtgggcatcctgggcagcaatgtggagggcaagcaggtgctgcagaagacaggcaccaggtttgagcggctgctgatgagaattggccaccagagcaagaatgcccctgtggagctgaagatccgctgcctggatgccatcagcagcctgctgtacctgcccccagagcagcagacagatgacctgctgaggatgacagagagctggttcagcagcctgagccgggaccccctggagctgttccggggcatcagcagccagcccttccctgagctgcactgtgccgccctgaaggtgttcaccgccatcgccaaccagccctgggcccagaagctgatgttcaacagccctggctttgtggagtatgtggtggacagatctgtggagcatgacaaggccagcaaggatgccaagtatgagctggtgaaggccctggccaacagcaagaccatcgccgagatcttcggcaaccccaactacctgcggctgcggacctacctgtctgagggcccctactacgtgaagcctgtgtccaccacagctgtggagggcgctgagtag

SEQ ID NO: 165674 - DNA, 294 bp, Artificial Sequence
  Description of Artificial Sequence: Synthetic coding sequence
atgagaattggccaccagagcaagaatgcccctgtggagctgaagatccgctgcctggatgccatcagcagcctgctgtacctgcccccagagcagcagacagatgacctgctgaggatgacagagagctggttcagcagcctgagccgggaccccctggagctgttccggggcatcagcagccagcccttccctgagctgcactgtgccgccctgaaggtgttcaccggcaggaagcacctgcacctggaggagctggtgggcggcaaccaggtgaagaacacagtggagtag

SEQ ID NO: 165675 - DNA, 510 bp, Artificial Sequence
  Description of Artificial Sequence: Synthetic coding sequence
atgatctgcctggtgctgaccatctttgccaacctcttccctgctgcctgcaccggggcccacgagaggaccttcctggccgtgaagccagatggagtgcagaggcggctggtgggggagatcgtgagaagatttgagaggaagggcttcaagctggtggccctgaagctggtgcaggccagcgaggagctgctgcgggagcactacgccgagctgcgggagcggcccttctacggccgcctggtgaagtacatggccagcggccctgtggtggccatggtgtggcagggcctggatgtggtgaggaccagccgggccctgattggagccaccaacccagcagatgcccctcctggcaccatccggggggacttctgcatcgaggtgggcaagaacctgattcatggcagtgacagcgtggagagcgcccggcgggagatcgccctgtggttccgggcagatgagctgctgtgctgggaggacagcgctggccactggctgtatgaatag

SEQ ID NO: 165676 - DNA, 744 bp, Artificial Sequence
  Description of Artificial Sequence: Synthetic coding sequence
atgtatggcatgttcaagaaggtgaatgcccgggagcgcatcgtgggctggtaccacacaggccccaagctgcacaagaatgacatcgccatcaatgagctgatgaagcgctactgccccaacagcgtgctggtgatcattgatgtgaagcccaaggacctgggcctgcccacagaggcctacatctctgtggaggaggtgcatgatgatggcacccccaccagcaagacctttgagcacgtgaccagcgagattggagctgaggaggccgaggaggtgggcgtggagcacctgctgcgggacatcaaggacaccaccgtgggcaccctgagccagaggatcaccaaccaggtgcacggcctgaagggcctgaacagcaagctgctggacatccgcagctacctggagaaggtggccaccgggaagctgcccatcaaccaccagatcatctaccagctgcaggatgtgttcaacctgctgcctgatgtgtccctgcaggagtttgtgaaggccttctacctgaagaccaatgaccagatggtggtggtgtacctggccagcctcatccgctctgtggtggccctgcacaacctgatcaacaacaagatcgccaacagagatgctgagaagaaggagggccaggagaaggaggagagcaagaaggacagaaaagaagacaaggagaaggacaaggacaaggagaagagtgatgtgaagaaggaggagaagaaggagaagaagtag

SEQ ID NO: 165677 - DNA, 624 bp, Artificial Sequence
  Description of Artificial Sequence: Synthetic coding sequence
atgtctgatgaggaggcccggcagagcggcggcagcagccaggccggcgtggtgacagtgtctgatgtgcaggagctgatgaggaggaaggaggagattgaggcccagatcaaggccaactatgatgtgctggagagccagaagggcatcggcatgaatgagcccctggtggactgtgagggctaccccaggagtgatgtggacctgtaccaggtgaggacagcccggcacaacatcatctgcctgcagaatgaccacaaggctgtgatgaagcaggtggaggaggccctgcaccagctgcacgcccgggacaaggagaagcaggcccgggacatggccgaggcccacaaggaggccatgagcaggaagctgggccagagcgagagccagggccccccccgggcctttgccaaggtgaacagcatcagccctggcagccctgccagcattgctggcctgcaggtggatgatgaaattgtggagtttggatctgtgaacacccagaacttccagagcctgcacaacatcggctctgtggtgcagcacagcgagggcgccctggcccccaccatcctgctgtctgtgtccatgaacctgaccaccccaggcaccagcagcaggtag

SEQ ID NO: 165678 - DNA, 672 bp, Artificial Sequence
  Description of Artificial Sequence: Synthetic coding sequence
atgtctgatgaggaggcccggcagagcggcggcagcagccaggccggcgtggtgacagtgtctgatgtgcaggagctgatgaggaggaaggaggagattgaggcccagatcaaggccaactatgatgtgctggagagccagaagggcatcggcatgaatgagcccctggtggactgtgagggctaccccaggagtgatgtggacctgtaccaggtgaggacagcccggcacaacatcatctgcctgcagaatgaccacaaggctgtgatgaagcaggtggaggaggccctgcaccagctgcacgcccgggacaaggagaagcaggcccgggacatggccgaggcccacaaggaggccatgagcaggaagctgggccagagcgagagccagggccccccccgggcctttgccaaggtgaacagcatcagccctggcagccctgccagcattgctggcctgcaggtggatgatgaaattgtggagtttggatctgtgaacacccagaacttccagagcctgcacaacatcggctctgtggtgcagcacagcgagggcaagcccctgaatgtgaccgtcatccggcggggggagaagcaccagctgcggctggtgcccacccgctgggccggcaagggcctgctgggctgcaacatcatccccctgcagaggtag

SEQ ID NO: 165679 - DNA, 411 bp, Artificial Sequence
  Description of Artificial Sequence: Synthetic coding sequence
atgctgctgaagctgaaggagaaggccagcctgaccctggccgtgggcaccctgcccttccccagccagttcaactttgtgcccccaggccgcatgtgccgggtggccggctggggccgcactggagtgctgaagccaggcagtgacaccctgcaggaggtgaagctgcggctgatggacccccaggcctgcagccacttccgggactttgaccacaacctgcagctgtgtgtgggcaaccccaggaagaccaagagcgccttcaagggggacagcggcggccccctgctgtgtgccggcgtggcccagggcatcgtgtcctatggccgcagtgatgccaagcccccagctgtgttcacccgcatcagccactaccggccctggatcaaccagatcctgcaggccaactag

SEQ ID NO: 165680 - DNA, 753 bp, Artificial Sequence
  Description of Artificial Sequence: Synthetic coding sequence
atggccatgctgcgggtgcagcctgaggcccaggccaaggtggatgtgttccgggaggacctgtgcaccaagacagagaacctgctgggcagctacttccccaagaagatcagcgagctggatgccttcctgaaggagcccgccctgaatgaggccaacctgagcaacctgaaggcccccctggacatccctgtgcctgaccctgtgaaggagaaggagaaggaggagaggaagaagcagcaggagaaggaggacaaggatgagaagaagaagggagaagatgaagataaaggaccaccctgtggccctgtgaactgcaatgagaagatcgtggtgctgctgcagaggctgaagccagagatcaaggatgtgattgagcagctgaacctggtgaccacctggctgcagctgcagatccccagaattgaagatggcaacaactttggagtggccgtgcaggagaaggtgtttgagctgatgaccagcctgcacaccaagctggagggcttccacacccagatcagcaagtacttcagcgagagaggagatgctgtgaccaaggccgccaagcagccccacgtgggggactaccggcagctggtgcatgagctggatgaagctgagtacagagacatccggctgatggtgatggagatcagaaatgcctacgtgcggcggcagggccagggccggggcggccagaggcagctgagccaggccacccacagcctgaccctgcaggcccggggctag

SEQ ID NO: 165681 - DNA, 627 bp, Artificial Sequence
  Description of Artificial Sequence: Synthetic coding sequence
atgggagaggtggagatcagcgccctggcctacgtgaagatgtgcctgcacgccgcccgctacccccacgccgctgtgaatggcctcttcctggccccagcccccaggtctggagaatgtctgtgcctgacagactgtgtgcccctcttccacagccacctggccctgtctgtgatgctggaggtggccctgaaccaggtggatgtgtggggcgcccaggccggcctggtggtggccggctactaccacgccaatgctgctgtgaatgaccagagccctggccccctggccctgaagattgctggaagaattgctgagttcttcccagatgctgtgctgatcatgctggacaaccagaagctggtgccccagccccgggtgccccctgtgattgtgctggagaaccagggcctgcgctgggtgcccaaggacaagaacctggtgatgtggagggactgggaggagagccggcagatggtgggcgccctgctggaggaccgggcccaccagcacctggtggactttgactgccacctggatgacatccggcaggactggaccaaccagaggctgaacacccagatcacccagtgggtgggccccaccaatggaaatggaaatgcctag

SEQ ID NO: 165682 - DNA, 804 bp, Artificial Sequence
  Description of Artificial Sequence: Synthetic coding sequence
atggccagcctgctgaaggtggaccaggaggtgaagctgaaggtggacagcttccgggagcgcatcaccagcgaggccgaggacctggtggccaacttcttccccaagaagctgctggagctggacagcttcctgaaggagcccatcctgaacatccatgacctgacccagatccacagcgacatgaacctgcctgtgcctgaccccatcctgctgaccaacagccatgatggcctggatggccccacctacaagaagaggcggctggatgaatgtgaggaggccttccagggcaccaaggtgtttgtgatgcccaacggcatgctgaagagcaaccagcagctggtggacatcatcgagaaggtgaagccagagatccggctgctgattgagaagtgcaacaccccatctgggaagggcccccacatctgctttgacctgcaggtgaagatgtgggtgcagctgctgatccccagaattgaagatggcaacaactttggagtgtccatccaggaggagaccgtggccgagctgaggacagtggagagcgaggccgccagctacctggaccagatcagccgctactacatcacccgggccaagctggtgtccaagatcgccaagtacccccacgtggaggactacagaagaacagtgacagaaattgatgagaaggagtacatcagcctgcggctcatcatcagcgagctgaggaaccagtatgtgaccctgcatgacatgatcctgaagaacatcgagaagatcaagaggcccaggagcagcaatgctgagaccctgtactag

SEQ ID NO: 165683 - DNA, 765 bp, Artificial Sequence; identical to SEQ ID NO: 165652
  Description of Artificial Sequence: Synthetic coding sequence

SEQ ID NO: 165684 - DNA, 48 bp, Artificial Sequence; identical to SEQ ID NO: 94888
  Description of Artificial Sequence: Synthetic coding sequence

SEQ ID NO: 165685 - DNA, 393 bp, Artificial Sequence
  Description of Artificial Sequence: Synthetic coding sequence
atggccagcctgctgaaggtggaccaggaggtgaagctgaaggtggacagcttccgggagcgcatcaccagcgaggccgaggacctggtggccaacttcttccccaagaagctgctggagctggacagcttcctgaaggagcccatcctgaacatccatgacctgacccagatccacagcgacatgaacctgcctgtgcctgaccccatcctgctgaccaacagccatgatggcctggatggccccacctacaagaagaggcggctggatgaatgtgaggaggccttccagggccagaatgtgggcacagccccagacagccaggaccggcgctggaagcagctgtggggcgtgcacagcggcggcaacagctgccgggccaagaactgctag

SEQ ID NO: 165686 - DNA, 582 bp, Artificial Sequence
  Description of Artificial Sequence: Synthetic coding sequence
atgaacctgcctgtgcctgaccccatcctgctgaccaacagccatgatggcctggatggccccacctacaagaagaggcggctggatgaatgtgaggaggccttccagggcaccaaggtgtttgtgatgcccaacggcatgctgaagagcaaccagcagctggtggacatcatcgagaaggtgaagccagagatccggctgctgattgagaagtgcaacacagtgaagatgtgggtgcagctgctgatccccagaattgaagatggcaacaactttggagtgtccatccaggaggagaccgtggccgagctgaggacagtggagagcgaggccgccagctacctggaccagatcagccgctactacatcacccgggccaagctggtgtccaagatcgccaagtacccccacgtggaggactacagaagaacagtgacagaaattgatgagaaggagtacatcagcctgcggctcatcatcagcgagctgaggaaccagtatgtgaccctgcatgacatgatcctgaagaacatcgagaagatcaagaggcccaggagcagcaatgctgagaccctgtactag

SEQ ID NO: 165687 - DNA, 5532 bp, Artificial Sequence
  Description of Artificial Sequence: Synthetic coding sequence
atggagcctgctgagagagctggggtgggggagcccccagagcccggcggccggcctgagcccggcccccggggctttgtgccccagaaggagatcgtgtacaacaagctgctgccctatgcagagcggctggatgctgagagtgacctgcagctggcccagatcaagtgcaacctgggccgggctgtgcagctgcaggagctgtggccaggcggcctcttctggaccaggaagctgagcacctacatccggctgtatggcaggaagttcagcaaagaagatcatgtgctcttcatcaagctgctgtatgagctggtgtccatccccaagctggagatctccatgatgcagggctttgcccggctgctgatcaacctgctgaagaagaaggagctgctgagcagagctgacctggagctgccctggaggcccctgtatgacatggtggagcgcatcctgtacagcaagacagagcacctgggcctgaactggttccccaacagcgtggagaacatcctgaagaccctggtgaagagctgccggccctacttcccagcagatgccacagctgagatgctggaggagtggaggcccctgatgtgcccctttgatgtgaccatgcagaaggccatcacctactttgagatcttcctgcccaccagcctgcccccagagctgcaccacaagggcttcaagctgtggtttgatgagctgattggcctgtgggtgtctgtgcagaacctgccccagtgggagggccagctggtgaacctgtttgcccggctggccacagacaacatcggctacatcgactgggacccctacgtgcccaagatcttcacccgcatcctgcggagcctgaacctgcctgtgggcagcagccaggtgctggtgccccgcttcctgaccaatgcctatgacatcggccatgctgtgatctggatcacagccatgatgggcggccccagcaagctggtgcagaagcacctggccggcctcttcaacagcatcaccagcttctaccaccccagcaacaacggccgctggctgaacaagctgatgaagctgctgcagaggctgcccaacagcgtggtgcggcggctgcaccgggagcgctacaagaagcccagctggctgacccctgtgcctgacagccacaagctgacagaccaggatgtgacagactttgtgcagtgcatcatccagcctgtgctgctggccatgttcagcaagacaggcagcctggaggccgcccaggccctgcagaacctggccctgatgaggcctgagctggtgatcccccctgtgctggagaggacctacccagccctggagaccctgacagagccccaccagctgacagccaccctgagctgtgtgattggagtggcccggagcctggtgtctgggggccgctggttccctgagggccccacccacatgctgcccctgctgatgagggccctgcccggggtggaccccaatgacttcagcaagtgcatgatcaccttccagttcatcgccaccttcagcaccctggtgcccctggtggactgcagctctgtgctgcaggagagaaatgacctgacagaggtggagcgggagctgtgcagcgccacagctgagtttgaggactttgtgctgcagttcatggaccgctgcttcggcctcatcgagagcagcaccctggagcagacccgggaggagacagaaacagagaagatgacccacctggagagcctggtggagctgggcctgagcagcaccttcagcaccatcctgacccagtgcagcaaggagatcttcatggtggccctgcagaaggtgttcaacttcagcaccagccacatctttgagaccagggtggccggccgcatggtggccgacatgtgcagagctgctgtgaagtgctgcccagaggagagcctgaagctgtttgtgccccactgctgcagcgtcatcacccagctgaccatgaatgatgatgtgctgaatgatgaggagctggacaaggagctgctgtggaacctgcagctgctgtctgagatcaccagggtggatggcaggaagctgctgctgtaccgggagcagctggtgaagatcctgcagaggaccctgcacctgacctgcaagcagggctacaccctgagctgcaacctgctgcaccacctgctgcggagcaccaccctcatctaccccacagagtactgcagcgtgcctgggggctttgacaagccacccagcgagtacttccccatcaaggactggggcaagccaggggacctgtggaacctgggcatccagtggcacgtgcccagcagcgaggaggtgtcctttgccttctacctgctggacagcttcctgcagcctgagctggtgaagctgcagcactgtggagatggcaagctggagatgagcagagatgacatcctgcagagcctgaccatcgtgcacaactgcctgattggcagcggcaacctgctgccccccctgaagggggagcctgtgaccaacctggtgcccagcatggtgtccctggaggagaccaagctgtacacaggcctggagtatgacctgagccgggagaaccaccgggaggtgattgccaccgtcatcaggaagctgctgaaccacatcctggacaacagtgaagatgacaccaagagcctcttcctgatcatcaagatcattggagacctgctgcagttccagggcagccacaagcatgaatttgacagccgctggaagagcttcaacctggtgaagaagtccatggagaaccggctgcacggcaagaagcagcacatccgggccctgctgattgacagagtgatgctgcagcacgagctgcggaccctgactgtggagggctgtgagtacaagaagatccaccaggacatgatccgggacctgctgcggctgagcaccagcagctacagccaggtgaggaacaaggcccagcagaccttctttgctgccctgggcgcctacaacttctgctgccgggacatcatccccctggtgctggagttcctgcggccagaccggcagggcgtgacccagcagcagttcaagggggccctgtactgcctgctgggcaaccacagcggcgtgtgcctggccaacctgcatgactgggactgcatcgtgcagacctggccagccatcgtgagcagcggcctgagccaggccatgagcctggagaagcccagcatcgtgcggctgtttgatgacctggccgagaagatccaccggcagtatgagaccatcggcctggacttcaccatccccaagagctgtgtggagattgctgagctgctgcagcagagcaagaaccccagcatcaaccagatcctgctgagccctgagaagatcaaggagggcatcaagaggcagcaggagaagaatgctgatgccctgagaaattatgagaacctggtggacaccctgctggatggagtggagcagaggaacctgccctggaagtttgagcacatcggcatcggcctgctgagcctgctgctgagagatgacagagtgctgcccctgcgggccatccgcttctttgtggagaacctgaaccatgatgccatcgtggtgaggaagatggccatctctgctgtggccggcatcctgaagcagctgaagaggacccacaagaagctgaccatcaacccctgtgagatcagcggctgccccaagcccacccagatcatcgccggggacagaccagacaaccactggctgcactatgacagcaagaccatccccaggaccaagaaggagtgggagagcagctgctttgtggagaagacccactggggctactacacctggcccaagaacatggtggtgtatgccggcgtggaggagcagcccaagctgggccgcagccgggaggacatgacagaagctgagcagatcatctttgaccacttcagtgaccccaagtttgtggagcagctgatcaccttcctgagcctggaggacaggaagggcaaggacaagttcaacccccggcgcttctgcctcttcaagggcatcttcaggaactttgatgatgccttcctgcctgtgctgaagccccacctggagcacctggtggccgacagccatgagagcacccagagatgtgtggccgagatcatcgccggcctcatccggggcagcaagcactggacctttgagaaggtggagaagctgtgggagctgctgtgccccctgctgaggacagccctgagcaacatcaccgtggagacctacaatgactggggcgcctgcatcgccaccagctgtgagagccgggaccccaggaagctgcactggctgtttgagctgctgctggagagccccctgtctggagagggcggcagctttgtggatgcctgccgcctgtatgtgctgcagggcggcctggcccagcaggagtggagggtgcctgagctgctgcaccggctgctgaagtacctggagcccaagctgacccaggtgtacaagaatgtgcgggagagaattggctctgtgctgacctacatcttcatgattgatgtgtccctgcccaacaccacccccaccatcagcccccacgtgcctgagttcaccgcccgcatcctggagaagctgaagcccctgatggatgtggatgaggagatccagaaccacgtgatggaggagaatggaattggagaggaggatgagaggacccagggcatcaagctgctgaagaccatcctgaagtggctgatggccagcgctggccgctccttcagcacagctgtgacagagcagctgcagctgctgcccctcttcttcaagatcgcccctgtggagaatgacaacagctatgatgagctgaagagagatgccaagctgtgcctgagcctgatgagccagggcctgctgtacccccaccaggtgcccctggtgctgcaggtgctgaagcagacagcccggagcagctcctggcacgcccgctacacagtgctgacctacctgcagaccatggtgttctacaacctcttcatcttcctgaacaatgaagatgctgtgaaggacatccgctggctggtgatcagcctgctggaggatgagcagctggaggtgcgggagatggccgccaccaccctgagcggcctgctgcagtgcaacttcctgaccatggacagccccatgcagatccactttgagcagctgtgcaagaccaagctgcccaagaagaggaagagggaccccggctctgtgggggacaccatccccagcgctgagctggtgaagagacatgctggggtgctgggcctgggcgcctgtgtgctgagcagcccctatgatgtgcccacctggatgccccagctgctgatgaacctgagcgcccacctgaatgacccccagcccatcgagatgacagtgaagaagaccctgagcaacttccggaggacccaccacgacaactggcaggagcacaagcagcagttcacagatgaccagctgctggtgctgacagacctgctggtgagcccctgctactatgcctag

SEQ ID NO: 165688 - DNA, 2964 bp, Artificial Sequence
  Description of Artificial Sequence: Synthetic coding sequence
atgggagagaacctggccaagaagatcatgttcttcctgctgaccatcaagctgatcctgaaccacatcctggacaacagtgaagatgacaccaagagcctcttcctgatcatcaagatcattggagacctgctgcagttccagggcagccacaagcatgaatttgacagccgctggaagagcttcaacctggtgaagaagtccatggagaaccggctgcacggcaagaagcagcacatccgggccctgctgattgacagagtgatgctgcagcacgagctgcggaccctgactgtggagggctgtgagtacaagaagatccaccaggacatgatccgggacctgctgcggctgagcaccagcagctacagccaggtgaggaacaaggcccagcagaccttctttgctgccctgggcgcctacaacttctgctgccgggacatcatccccctggtgctggagttcctgcggccagaccggcagggcgtgacccagcagcagttcaagggggccctgtactgcctgctgggcaaccacagcggcgtgtgcctggccaacctgcatgactgggactgcatcgtgcagacctggccagccatcgtgagcagcggcctgagccaggccatgagcctggagaagcccagcatcgtgcggctgtttgatgacctggccgagaagatccaccggcagtatgagaccatcggcctggacttcaccatccccaagagctgtgtggagattgctgagctgctgcagcagagcaagaaccccagcatcaaccagatcctgctgagccctgagaagatcaaggagggcatcaagaggcagcaggagaagaatgctgatgccctgagaaattatgagaacctggtggacaccctgctggatggagtggagcagaggaacctgccctggaagtttgagcacatcggcatcggcctgctgagcctgctgctgagagatgacagagtgctgcccctgcgggccatccgcttctttgtggagaacctgaaccatgatgccatcgtggtgaggaagatggccatctctgctgtggccggcatcctgaagcagctgaagaggacccacaagaagctgaccatcaacccctgtgagatcagcggctgccccaagcccacccagatcatcgccggggacagaccagacaaccactggctgcactatgacagcaagaccatccccaggaccaagaaggagtgggagagcagctgctttgtggagaagacccactggggctactacacctggcccaagaacatggtggtgtatgccggcgtggaggagcagcccaagctgggccgcagccgggaggacatgacagaagctgagcagatcatctttgaccacttcagtgaccccaagtttgtggagcagctgatcaccttcctgagcctggaggacaggaagggcaaggacaagttcaacccccggcgcttctgcctcttcaagggcatcttcaggaactttgatgatgccttcctgcctgtgctgaagccccacctggagcacctggtggccgacagccatgagagcacccagagatgtgtggccgagatcatcgccggcctcatccggggcagcaagcactggacctttgagaaggtggagaagctgtgggagctgctgtgccccctgctgaggacagccctgagcaacatcaccgtggagacctacaatgactggggcgcctgcatcgccaccagctgtgagagccgggaccccaggaagctgcactggctgtttgagctgctgctggagagccccctgtctggagagggcggcagctttgtggatgcctgccgcctgtatgtgctgcagggcggcctggcccagcaggagtggagggtgcctgagctgctgcaccggctgctgaagtacctggagcccaagctgacccaggtgtacaagaatgtgcgggagagaattggctctgtgctgacctacatcttcatgattgatgtgtccctgcccaacaccacccccaccatcagcccccacgtgcctgagttcaccgcccgcatcctggagaagctgaagcccctgatggatgtggatgaggagatccagaaccacgtgatggaggagaatggaattggagaggaggatgagaggacccagggcatcaagctgctgaagaccatcctgaagtggctgatggccagcgctggccgctccttcagcacagctgtgacagagcagctgcagctgctgcccctcttcttcaagatcgcccctgtggagaatgacaacagctatgatgagctgaagagagatgccaagctgtgcctgagcctgatgagccagggcctgctgtacccccaccaggtgcccctggtgctgcaggtgctgaagcagacagcccggagcagctcctggcacgcccgctacacagtgctgacctacctgcagaccatggtgttctacaacctcttcatcttcctgaacaatgaagatgctgtgaaggacatccgctggctggtgatcagcctgctggaggatgagcagctggaggtgcgggagatggccgccaccaccctgagcggcctgctgcagtgcaacttcctgaccatggacagccccatgcagatccactttgagcagctgtgcaagaccaagctgcccaagaagaggaagagggaccccggctctgtgggggacaccatccccagcgctgagctggtgaagagacatgctggggtgctgggcctgggcgcctgtgtgctgagcagcccctatgatgtgcccacctggatgccccagctgctgatgaacctgagcgcccacctgaatgacccccagcccatcgagatgacagtgaagaagaccctgagcaacttccggaggacccaccacgacaactggcaggagcacaagcagcagttcacagatgaccagctgctggtgctgacagacctgctggtgagcccctgctactatgcctag

SEQ ID NO: 165689 - DNA, 867 bp, Artificial Sequence
  Description of Artificial Sequence: Synthetic coding sequence
atggccgccaccttcttcggggaggtggtgaaggccccctgccgggccggcacagaagatgaggaggaggaggaggagggccggcgggagaccccagaagatcgggaggtgcggctgcagctggccaggaagcgggaggtgcggctgctgcggcggcagaccaagaccagcctggaggtgtccctgctggagaagtacccctgcagcaagttcatcatcgccatcggcaacaatgctgtggccttcctgagcagctttgtgatgaacagcggcgtgtgggaggaggtgggctgtgccaagctgtggaatgagtggtgcaggaccacagacaccacccacctgagcagcacagaggccttctgtgtgttctaccacctgaagagcaaccccagcgtcttcctgtgccagtgcagctgctacgtggccgaggaccagcagtaccagtggctggagaaggtgtttggcagctgccccaggaagaacatgcagatcaccatcctgacctgcagacatgtgacagactacaagaccagcgagagcacaggcagcctgcccagccccttcctgcgggccctgaagacccagaacttcaaggacagcgcctgctgccccctgctggagcagcccaacatcgtgcatgacctgcctgctgctgtgctgagctactgccaggtgtggaagatcccagccatcctgtacctgtgctacacagatgtgatgaagctggacctgatcaccgtggaggccttcaagcccatcctgagcaccaggagcctgaagggcctggtgaagaacatcccccagagcacagagatcctgaagaagctgatgaccaccaatgagatccagagcaacatctacacctag

SEQ ID NO: 165690 - DNA, 804 bp, Artificial Sequence
  Description of Artificial Sequence: Synthetic coding sequence
atggccgccaccttcttcggggaggtggtgaaggccccctgccgggccggcacagaagatgaggaggaggaggaggagggccggcgggagaccccagaagatcgggaggtgcggctgcagctggccaggaagcgggaggtgcggctgctgcggcggcagaccaagaccagcctggaggtgtccctgctggagaagtacccctgcagcaagttcatcatcgccatcggcaacaatgctgtggccttcctgagcagctttgtgatgaacagcggcgtgtgggaggaggtgggctgtgccaagctgtggaatgagtggtgcaggaccacagacaccacccacctgagcagcacagaggccttctgtgtgttctaccacctgaagagcaaccccagcgtgtttggcagctgccccaggaagaacatgcagatcaccatcctgacctgccgccacgtgacagactacaagaccagcgagagcacaggcagcctgcccagccccttcctgcgggccctgaagacccagaacttcaaggacagcgcctgctgccccctgctggagcagcccaacatcgtgcatgacctgcctgctgctgtgctgagctactgccaggtgtggaagatcccagccatcctgtacctgtgctacacagatgtgatgaagctggacctgatcaccgtggaggccttcaagcccatcctgagcaccaggagcctgaagggcctggtgaagaacatcccccagagcacagagatcctgaagaagctgatgaccaccaatgagatccagagcaacatctacacctag

SEQ ID NO: 165691 - DNA, 795 bp, Artificial Sequence
  Description of Artificial Sequence: Synthetic coding sequence
atgtttgtgccctgtggggagagcgccccagacctggccggcttcaccctgctgatgcctgctgtgtctgtgggcaatgtgggccagctggccatggacctgatcatcagcaccctgaacatgagcaagattggctacttctacacagactgcctggtgcccatggtgggcaacaacccctatgccaccacagagggcaacagcacagagctgagcatcaatgctgaggtgtacagcctgcccagcaggaagctggtggccctgcagctgcggagcatcttcatcaagtacaagagcaagcccttctgtgagaagctgctgtcctgggtgaagagcagcggctgtgcccgggtgattgtgctgagcagcagccacagctaccagagaaatgacctgcagctgcggagcacccccttccgctacctgctgacccccagcatgcagaagtctgtgcagaacaagatcaagagcctgaactgggaggagatggagaagagccgctgcatccctgagattgatgattctgagttctgcatccgcatccctgggggcggcatcaccaagaccctgtatgatgagagctgcagcaaggagatccagatggctgtgctgctgaagtttgtgtctgagggggacaacatcccagatgccctgggcctggtggagtacctgaatgagtggctgcagatcctgaagcccctgagtgatgaccccaccgtgtctgccagccgctggaagatccccagctcctggaggctgctgtttggaagtggcctgcccccagccctcttctag

SEQ ID NO: 165692 - DNA, 459 bp, Artificial Sequence
  Description of Artificial Sequence: Synthetic coding sequence
atgcctgctgtgtctgtgggcaatgtgggccagctggccatggacctgatcatcagcaccctgaacatgagcaagattggctacttctacacagactgcctggtgcccatggtgggcaacaacccctatgccaccacagagggcaacagcacagagctgagcatcaatgctgaggtgtacagcctgcccagcaggaagctggtggccctgcagctgcggagcatcttcatcaagtacaagagcaagcccttctgtgagaagctgctgtcctgggtgaagagcagcggctgtgcccgggtgattgtgctgagcagcagccacagctaccagagaaatgacctgcagctgcggagcacccccttccgctacctgctgacccccagcatgcagaagtctgtgcagaacaagatcaagagcctgaactgggaggagatggagaagggggccttcctgaagtag

SEQ ID NO: 165693 - DNA, 792 bp, Artificial Sequence
  Description of Artificial Sequence: Synthetic coding sequence
atgttcaggaaccagtatgacaatgatgtgacagtgtggagcccccagggccgcatccaccagatcgagtatgccatggaggccgtgaagcagggcagcgccaccgtgggcctgaagagcaagacccatgctgtgctggtggccctgaagagggcccagagcgagctggccgcccaccagaagaagatcctgcacgtggacaaccacatcggcatcagcattgctggcctgacagcagatgcccggctgctgtgcaacttcatgaggcaggagtgcctggacagcagatttgtgtttgaccggcccctgcctgtgtcccggctggtgtccctcatcggcagcaagacccagatccccacccagagatatggaagaagaccctacggcgtgggcctgctgattgctggctatgatgacatgggcccccacatcttccagacctgccccagcgccaactactttgactgccgggccatgagcattggagcccggagccagagcgcccggacctacctggagcggcacatgtctgagttcatggagtgcaacctgaatgagctggtgaagcacggcctgcgggccctgcgggagaccctgcctgctgagcaggacctgaccaccaagaatgtgtccatcggcatcgtgggcaaggacctggagttcaccatctatgatgatgatgatgtgagccccttcctggagggcctggaggagcggccccagaggaaggcccagcctgcccagcctgcagatgagcctgctgagaaggcagatgagcccatggagcactag

SEQ ID NO: 165694 - DNA, 792 bp, Artificial Sequence; identical to SEQ ID NO: 165693
  Description of Artificial Sequence: Synthetic coding sequence

SEQ ID NO: 165695 - DNA, 810 bp, Artificial Sequence
  Description of Artificial Sequence: Synthetic coding sequence
atgcagctgagcaaggtgaagttcaggaaccagtatgacaatgatgtgacagtgtggagcccccagggccgcatccaccagatcgagtatgccatggaggccgtgaagcagggcagcgccaccgtgggcctgaagagcaagacccatgctgtgctggtggccctgaagagggcccagagcgagctggccgcccaccagaagaagatcctgcacgtggacaaccacatcggcatcagcattgctggcctgacagcagatgcccggctgctgtgcaacttcatgaggcaggagtgcctggacagcagatttgtgtttgaccggcccctgcctgtgtcccggctggtgtccctcatcggcagcaagacccagatccccacccagagatatggaagaagaccctacggcgtgggcctgctgattgctggctatgatgacatgggcccccacatcttccagacctgccccagcgccaactactttgactgccgggccatgagcattggagcccggagccagagcgcccggacctacctggagcggcacatgtctgagttcatggagtgcaacctgaatgagctggtgaagcacggcctgcgggccctgcgggagaccctgcctgctgagcaggacctgaccaccaagaatgtgtccatcggcatcgtgggcaaggacctggagttcaccatctatgatgatgatgatgtgagccccttcctggagggcctggaggagcggccccagaggaaggcccagcctgcccagcctgcagatgagcctgctgagaaggcagatgagcccatggagcactag

SEQ ID NO: 165696 - DNA, 495 bp, Artificial Sequence
  Description of Artificial Sequence: Synthetic coding sequence
atgttcaggaaccagtatgacaatgatgtgacagtgtggagcccccagggccgcatccaccagatcgagtatgccatggaggccgtgaagcagggcagcgccaccgtgggcctgaagagcaagacccatgctgtgctggtggccctgaagagggcccagagcgagctggccgcccaccagaagaagatcctgcacgtggacaaccacatcggcatcagcattgctggcctgacagcagatgcccggctgctgtgcaacttcatgaggcaggagtgcctggacagcagatttgtgtttgaccggcccctgcctgtgtcccggctggtgtccctcatcggcagcagcatcctcttcatgatctgggccctgaccttcagcaagcctgtgcacctgctgaccatcctgacagctgagccctgccccctggagcctgtgcccaaccagctggtgctgacctggagggacatctgcctgaacctgtggagcgtcatctag

SEQ ID NO: 165697 - DNA, 1014 bp, Artificial Sequence
  Description of Artificial Sequence: Synthetic coding sequence
atggaccagaatgagcacagccactggggcccccacgccaagggccagtgtgccagccgctctgagctgcgcatcatcctggtgggcaagacaggaacaggcaagtctgctgctggcaacagcatcctgaggaagcaggcctttgagagcaagctgggcagccagaccctgaccaagacctgcagcaagagccagggctcctggggcaaccgggagatcgtcatcatcgacaccccagacatgttctcctggaaggaccactgtgaggccctgtacaaggaggtgcagcgctgctacctgctgagcgcccctggcccccacgtgctgctgctggtgacccagctgggccgctacaccagccaggaccagcaggccgcccagagggtgaaggagatctttggagaagatgccatgggccacaccatcgtgctcttcacccacaaggaggacctgaatggaggcagcctgatggactacatgcatgacagcgacaacaaggccctgagcaagctggtggccgcctgtggcggccgcatctgtgccttcaacaacagagctgagggcagcaaccaggatgaccaggtgaaggagctgatggactgcatcgaggacctgctgatggagaagaatggagaccactacaccaacggcctgtacagcctcatccagaggagcaaatgtggccctgtgggcagtgatgagcgggtgaaggagttcaagcagagcctcatcaagtacatggagacccagaggagctacacagccctggccgaggccaactgcctgaagggggccctgatcaagacccagctgtgtgtgctcttctgcatccagctgttcctgcggctcatcatcctgtggctgtgcatcctgcacagcatgtgcaacctcttctgctgcctgctcttctccatgtgcaacctcttctgcagcctgctcttcatcatccccaagaagctgatgatcttcctgaggacagtcatccggctggagaggaagaccccccggctgtag

SEQ ID NO: 165698 - DNA, 300 bp, Artificial Sequence
  Description of Artificial Sequence: Synthetic coding sequence
atgggccctgactacagagtgctggtgcaccgggccaggaagctggcccagcagtactacctggtgtaccaggagcccatccccacagcccagctggtgcagagggtggcctctgtgatgcaggagtacacccagagcggcggcgtgcggcccttcggcgtgtccctgctgatctgtggctggaatgaaggccggccctacctgttccagagcgaccccagcggggcctactttgcctggaaggccacagccatgggcaagaactacgtgaatggcaagaccttcctggagaagaggtag

SEQ ID NO: 165699 - DNA, 465 bp, Artificial Sequence
  Description of Artificial Sequence: Synthetic coding sequence
atgctgtactgtgaggccgagagccccccaacagtggagaaggtgaagccagcccgggagaacagcgagacagacctggagattgaaggagagcacggccacctgggcgctgtgcgggccgccagcccccagaagctggagaagagcggcttccaggagctgagcagccacagcttccctgagagcgccctgaggatggcctgtggcggcaatgtggccgagaggcctgcccgcttctgcctggagagcagcagcggcctggccggggagagcagctgcagcttcccccggctgagccctgccagcggggctgtgcccagccggcggctggtgaagagcggcatcaacacccagacccgcttcagcaacctgctgaatgtgtccacctggggcatcctgtgcaacctgtgcaacagccccaggagcttccccaagaagggcagcacagagcgggagcacctgtag

SEQ ID NO: 165700 - DNA, 747 bp, Artificial Sequence
  Description of Artificial Sequence: Synthetic coding sequence
atgagcagcatcggcaccggctatgacctgagcgccagcaccttctccccagatggccgggtcttccaggtggagtatgccatgaaggctgtggagaacagcagcacagccatcggcatccgctgcaaggatggagtggtgtttggagtggagaagctggtgctgagcaagctgtatgaggagggcagcaacaagaggctcttcaacgtggacagacatgtgggcatggctgtggccggcctgctggctgatgcccggagcctggccgacatcgcccgggaggaggccagcaacttccgcagcaactttggctacaacatccccctgaagcacctggccgacagagtggccatgtatgtgcacgcctacaccctgtacagcgctgtgcggcccttcggctgcagcgtgaatgatggagcccagctgtacatgattgaccccagcggcgtgtcctatggctactggggctgtgccatcggcaaggcccggcaggccgccaagacagaaattgagaagctgcagatgaaggagatgacctgccgggacatcgtgaaggaggtggccaagatcatctacatcgtgcatgatgaggtgaaggacaaggcctttgagctggagctgtcctgggtgggggagctgaccaacggcagacatgagatcgtgcccaaggacatccgggaggaggccgagaagtatgccaaggagagcctgaaggaggaggatgaaagtgatgatgacaacatgtag

SEQ ID NO: 165701 - DNA, 786 bp, Artificial Sequence
  Description of Artificial Sequence: Synthetic coding sequence
atgagcagaagatatgacagcaggaccaccatcttcagccctgagggccgcctgtaccaggtggagtatgccatggaggccatcggccatgctggcacctgcctgggcatcctggccaatgatggagtgctgctggccgctgagaggaggaacatccacaagctgctggatgaggtgttcttcagcgagaagatctacaagctgaatgaagacatggcctgcagcgtggccggcatcaccagtgatgccaacgtgctgaccaatgagctgcggctgattgcccagcgctacctgctgcagtaccaggagcccatcccctgtgagcagctggtgacagccctgtgtgacatcaagcaggcctacacccagtttggaggcaagaggcccttcggcgtgtccctgctgtacatcggctgggacaagcactacggcttccagctgtaccagagcgaccccagcggcaactacggcggctggaaggccacctgcatcggcaacaacagcgctgctgctgtgtccatgctgaagcaggactacaaggagggggagatgaccctgaagagcgccctggccctggccatcaaggtgctgaacaagaccatggatgtgtccaagctgtctgctgagaaggtggagatcgccaccctgaccagagaaaatggcaagacagtcatccgggtgctgaagcagaaggaggtggagcagctgatcaagaagcatgaggaggaggaggccaaggccgagcgggagaagaaggagaaggagcagaaggagaaggacaagtag

SEQ ID NO: 165702 - DNA, 573 bp, Artificial Sequence
  Description of Artificial Sequence: Synthetic coding sequence
atggcctgcagcgtggccggcatcaccagtgatgccaacgtgctgaccaatgagctgcggctcatcgcccagcgctacctgctgcagtaccaggagcccatcccctgtgagcagctggtgacagccctgtgtgacatcaagcaggcctacacccagtttggaggcaagaggccctttggagtgtccctgctgtacatcggctgggacaagcactacggcttccagctgtaccagagcgaccccagcggcaactatggaggctggaaggccacctgcatcggcaacaacagcgctgctgctgtgtccatgctgaagcaggactacaaggagggggagatgaccctgaagagcgccctggccctggccatcaaggtgctgaacaagaccatggatgtgtccaagctgtctgctgagaaggtggagatcgccaccctgacccgggagaatggcaagacagtcatccgggtgctgaagcagaaggaggtggagcagctgatcaagaagcatgaggaggaggaggccaaggccgagcgggagaagaaggagaaggagcagaaggagaaggacaagtag

SEQ ID NO: 165703 - DNA, 786 bp, Artificial Sequence; identical to SEQ ID NO: 165701
  Description of Artificial Sequence: Synthetic coding sequence

SEQ ID NO: 165704 - DNA, 666 bp, Artificial Sequence
  Description of Artificial Sequence: Synthetic coding sequence
atgagcagaagatatgacagcaggaccaccatcttcagccctgagggccgcctgtaccaggtggagtatgccatggaggccatcggccatgctggcacctgcctgggcatcctggccaatgatggagtgctgctggccgctgagaggaggaacatccacaagctgctggatgaggtgttcttcagcgagaagatctacaagctgaatgaagacatggcctgcagcgtggccggcatcaccagtgatgccaacgtgctgaccaatgagctgcggctgattgcccagcgctacctgctgcagtaccaggagcccatcccctgtgagcagctggtgacagccctgtgtgacatcaagcaggcctacacccagtttggaggcaagaggcccttcggcgtgtccctgctgtacatcggctgggacaagcactacggcttccagctgtaccagagcgaccccagcggcaactacggcggctggaaggccacctgcatcggcaacaacagcgctgctgctgtgtccatgctgaagcaggactacaaggagggggagatgaccctgaagagcgccctggccctggccatcaaggtgctgaacaagaccatggatgtgtccaagctgtctgctgagaaggtggagatcgccaccctgaccagagaaaatggatag

SEQ ID NO: 165705 - DNA, 630 bp, Artificial Sequence
  Description of Artificial Sequence: Synthetic coding sequence
atgagcagaagatatgacagcaggaccaccatcttcagccctgagggccgcctgtaccaggtggagtatgccatggaggccatcggccatgctggcacctgcctgggcatcctggccaatgatggagtgctgctggccgctgagaggaggaacatccacaagctgctggatgaggtgttcttcagcgagaagatctacaagctgaatgaagacatggcctgcagcgtggccggcatcaccagtgatgccaacgtgctgaccaatgagctgcggctgattgcccagcgctacctgctgcagtaccaggagcccatcccctgtgagcagctggtgacagccctgtgtgacatcaagcaggcctacacccagtttggaggcaagaggcccttcggcgtgtccctgctgtacatcggctgggacaagcactacggcttccagctgtaccagagcgaccccagcggcaactacggcggctggaaggccacctgcatcggcaacaacagcgctgctgctgtgtccatgctgaagcaggactacaaggagggggagatgaccctgaagagcgccctggccctggccatcaaggtgctgaacaagaccatggatgtgtccaagctgtctgctgagtag

SEQ ID NO: 165706 - DNA, 693 bp, Artificial Sequence
  Description of Artificial Sequence: Synthetic coding sequence
atgagcagaagatatgacagcaggaccaccatcttcagccctgaggccgagaggaggaacatccacaagctgctggatgaggtgttcttcagcgagaagatctacaagctgaatgaagacatggcctgcagcgtggccggcatcaccagtgatgccaacgtgctgaccaatgagctgcggctcatcgcccagcgctacctgctgcagtaccaggagcccatcccctgtgagcagctggtgacagccctgtgtgacatcaagcaggcctacacccagtttggaggcaagaggccctttggagtgtccctgctgtacatcggctgggacaagcactacggcttccagctgtaccagagcgaccccagcggcaactatggaggctggaaggccacctgcatcggcaacaacagcgctgctgctgtgtccatgctgaagcaggactacaaggagggggagatgaccctgaagagcgccctggccctggccatcaaggtgctgaacaagaccatggatgtgtccaagctgtctgctgagaaggtggagatcgccaccctgacccgggagaatggcaagacagtcatccgggtgctgaagcagaaggaggtggagcagctgatcaagaagcatgaggaggaggaggccaaggccgagcgggagaagaaggagaaggagcagaaggagaaggacaagtag

SEQ ID NO: 165707 - DNA, 711 bp, Artificial Sequence
  Description of Artificial Sequence: Synthetic coding sequence
atgagcagaagatatgacagcaggaccaccatcttcagccctgagggccgcctgtaccaggtggagtatgccatggaggccatcggccatgctggcacctgcctgggcatcctggccaatgatggagtgctgctggccgctgagaggaggaacatccacaagctgctggatgaggtgttcttcagcgagaagatctacaagctgaatgaagacatggcctgcagcgtggccggcatcaccagtgatgccaacgtgctgaccaatgagctgcggctgattgcccagcgctacctgctgcagtaccaggagcccatcccctgtgagcagctggtgacagccctgtgtgacatcaagcaggcctacacccagtttggaggcaagaggcccttcggcgtgtccctgctgtacatcggctgggacaagcactacggcttccagctgtaccagagcgaccccagcggcaactacggcggctggaaggccacctgcatcggcaacaacagcgctgctgctgtgtccatgctgaagcaggactacaaggagggggagatgaccctgaagagcgccctggccctggccatcaaggtgctgaacaagaccatggatgtgtccaagctgtctgctgagaaggtggagatcgccaccctgaccagagaaaatggcaagacagtcatccgggtgctgaagcagaaggaggtggagcagctgtag

SEQ ID NO: 165708 - DNA, 726 bp, Artificial Sequence
  Description of Artificial Sequence: Synthetic coding sequence
atgttcctgaccaggagtgaatatgacagaggagtgaacaccttcagccctgagggccgcctcttccaggtggagtatgccatcgaggccatcaagctgggcagcacagccatcggcatccagaccagcgagggcgtgtgcctggccgtggagaagaggatcaccagccccctgatggagcccagcagcattgagaagatcgtggagattgatgcccacatcggctgtgccatgagcggcctgattgctgatgccaagaccctgattgacaaggcccgggtggagacccagaaccactggttcacctacaatgagaccatgacagtggagagcgtgacccaggccgtgagcaacctggccctgcagtttggagaggaggatgctgaccccggggccatgagccggccctttggagtggccctgctgtttggaggagtggatgagaagggcccccagctgttccacatggaccccagcggcacctttgtgcagtgtgatgcccgggccatcggcagcgccagcgagggcgcccagagcagcctgcaggaggtgtaccacaagtccatgaccctgaaggaggccatcaagagcagcctcatcatcctgaagcaggtgatggaggagaagctgaatgccaccaacatcgagctggccaccgtgcagcccggccagaacttccacatgttcaccaaggaggagctggaggaggtgatcaaggacatctag

SEQ ID NO: 165709 - DNA, 552 bp, Artificial Sequence
  Description of Artificial Sequence: Synthetic coding sequence
atggagcccagcagcattgagaagatcgtggagattgatgcccacatcggctgtgccatgagcggcctgattgctgatgccaagaccctgattgacaaggcccgggtggagacccagaaccactggttcacctacaatgagaccatgacagtggagagcgtgacccaggccgtgagcaacctggccctgcagtttggagaggaggatgctgaccccggggccatgagccggccctttggagtggccctgctgtttggaggagtggatgagaagggcccccagctgttccacatggaccccagcggcacctttgtgcagtgtgatgcccgggccatcggcagcgccagcgagggcgcccagagcagcctgcaggaggtgtaccacaagtccatgaccctgaaggaggccatcaagagcagcctcatcatcctgaagcaggtgatggaggagaagctgaatgccaccaacatcgagctggccaccgtgcagcccggccagaacttccacatgttcaccaaggaggagctggaggaggtgatcaaggacatctag

SEQ ID NO: 165710 - DNA, 741 bp, Artificial Sequence
  Description of Artificial Sequence: Synthetic coding sequence
atgagccggggcagcagcgctggctttgacagacacatcaccatcttcagccctgagggccgcctgtaccaggtggagtatgccttcaaggccatcaaccagggcggcctgacctctgtggccgtgcggggcaaggactgtgccgtcatcgtgacccagaagaaggtgcctgacaagctgctggacagcagcacagtgacccacctgttcaagatcacagagaacatcggctgtgtgatgacaggcatgacagctgacagccgcagccaggtgcagagggcccgctatgaggccgccaactggaagtacaagtatggctatgagatccctgtggacatgctgtgcaagagaattgctgacatcagccaggtgtacacccagaatgctgagatgaggcccctgggctgctgcatgatcctgattggaattgatgaggagcagggcccccaggtgtacaagtgtgaccctgctggctactactgcggcttcaaggccacagctgctggggtgaagcagacagagagcaccagcttcctggagaagaaggtgaagaagaagtttgactggacctttgagcagacagtggagacagccatcacctgcctgagcacagtgctgagcattgacttcaagcccagcgagattgaggtgggcgtggtgacagtggagaaccccaagttccgcatcctgacagaagctgagattgatgcccacctggtggccctggccgagcgggactag

SEQ ID NO: 165711 - DNA, 684 bp, Artificial Sequence
  Description of Artificial Sequence: Synthetic coding sequence
atggccggcctgcggcgggagtatgccttcaaggccatcaaccagggcggcctgacctctgtggccgtgcggggcaaggactgtgctgtgattgtgacccagaagaaggtgcctgacaagctgctggacagcagcacagtgacccacctgttcaagatcacagaaaatattggctgtgtgatgacaggcatgacagctgacagccgcagccaggtgcagagggcccgctatgaagctgccaactggaagtacaagtatggctatgagatccctgtggacatgctgtgcaagagaattgctgacatcagccaggtgtacacccagaatgctgagatgaggcccctgggctgctgcatgatcctgattggaattgatgaggagcagggcccccaggtgtacaagtgtgaccctgctggctactactgcggcttcaaggccacagctgctggggtgaagcagacagagagcaccagcttcctggagaagaaggtgaagaagaagtttgactggacctttgagcagacagtggagacagccatcacctgcctgagcacagtgctgagcattgacttcaagcccagcgagattgaggtgggcgtggtgacagtggagaaccccaagttccgcatcctgacagaggccgagattgatgcccacctggtggccctggccgagcgggactag

SEQ ID NO: 165712 - DNA, 759 bp, Artificial Sequence
  Description of Artificial Sequence: Synthetic coding sequence
atgagccggggcagcagcgctggctttgacagacacatcaccatcttcagccctgagggccgcctgtaccaggtggagtatgccttcaaggccatcaaccagggcggcctgacctctgtggccgtgcggggcaaggactgtgccgtcatcgtgacccagaagaaggtgcctgacaagctgctggacagcagcacagtgacccacctgttcaagatcacagagaacatcggctgtgtgatgacaggcatgacagctgacagccgcagccaggtgcagagggcccgctatgaggccgccaactggaagtacaagtatggctatgagatccctgtggacatgctgtgcaagagaattgctgacatcagccaggtgtacacccagaatgctgagatgaggcccctgggctgctggagcttcctgttcctgggcatgatcctgattggaattgatgaggagcagggcccccaggtgtacaagtgtgaccctgctggctactactgcggcttcaaggccacagctgctggggtgaagcagacagagagcaccagcttcctggagaagaaggtgaagaagaagtttgactggacctttgagcagacagtggagacagccatcacctgcctgagcacagtgctgagcattgacttcaagcccagcgagattgaggtgggcgtggtgacagtggagaaccccaagttccgcatcctgacagaagctgagattgatgcccacctggtggccctggccgagcgggactag

SEQ ID NO: 165713 - DNA, 324 bp, Artificial Sequence
  Description of Artificial Sequence: Synthetic coding sequence
atgagccggggcagcagcgctggctttgacagacacatcaccatcttcagccctgagggccgcctgtaccaggtggagtatgccttcaaggccatcaaccagggcggcctgacctctgtggccgtgcggggcaaggactgtgccgtcatcgtgacccagaagaaggtgcctgacaagctgctggacagcagcacagtgacccacctgttcaagatcacagagaacatcggctgtgtgatgacaggcatgacagtgtccctgtgccggcccggctgcagcgcctcctgggtgcaggccatcctggtgccccagcccccaagatag

SEQ ID NO: 165714 - DNA, 447 bp, Artificial Sequence
  Description of Artificial Sequence: Synthetic coding sequence
atgagccggggcagcagcgctggctttgacagacacatcaccatcttcagccctgagggccgcctgtaccaggtggagtatgccttcaaggccatcaaccagggcggcctgacctctgtggccgtgcggggcaaggactgtgccgtcatcgtgacccagaagaaggtgcctgacaagctgctggacagcagcacagtgacccacctgttcaagatcacagagaacatcggctgtgtgatgacaggcatgacagctgacagccgcagccaggtgcagagggcccgctatgaggccgccaactggaagtacaagtatggctatgagatccctgtggacatgctgtgcaagagaattgctgacatcagccaggtgtacacccagaatgctgagatgaggcccctgggctgctactgcaactacatgcctgtgtactgcagcatcaactag

SEQ ID NO: 165715 - DNA, 504 bp, Artificial Sequence
  Description of Artificial Sequence: Synthetic coding sequence
atgacaggcatgacagctgacagccgcagccaggtgcagagggcccgctatgaagctgccaactggaagtacaagtatggctatgagatccctgtggacatgctgtgcaagagaattgctgacatcagccaggtgtacacccagaatgctgagatgaggcccctgggctgctgcatgatcctgattggaattgatgaggagcagggcccccaggtgtacaagtgtgaccctgctggctactactgcggcttcaaggccacagctgctggggtgaagcagacagagagcaccagcttcctggagaagaaggtgaagaagaagtttgactggacctttgagcagacagtggagacagccatcacctgcctgagcacagtgctgagcattgacttcaagcccagcgagattgaggtgggcgtggtgacagtggagaaccccaagttccgcatcctgacagaggccgagattgatgcccacctggtggccctggccgagcgggactag

SEQ ID NO: 165716 - DNA, 612 bp, Artificial Sequence
  Description of Artificial Sequence: Synthetic coding sequence
atgagccggggcagcagcgctggctttgacagacacatcaccatcttcagccctgagggccgcctgtaccaggtggagtatgccttcaaggccatcaaccagggcggcctgacctctgtggccgtgcggggcaaggactgtgccgtcatcgtgacccagaagaaggtgcctgacaagctgctggacagcagcacagtgacccacctgttcaagatcacagagaacatcggctgtgtgatgacaggcatgacagctgacagccgcagccaggtgcagagggcccgctatgaggccgccaactggaagtacaagtatggctatgagatccctgtggacatgctgtgcaagagaattgctgacatcagccaggtgtacacccagaatgctgagatgaggcccctgggctgctgcatgatcctgattggaattgatgaggagcagggcccccaggtgtacaagtgtgaccctgctggctactactgcggcttcaaggccacagctgctggggtgaagcagacagagagcaccagcttcctggagaagaaggtgaagaagaagtttgactggacctttgagcagacagtggaggacagctaccgcagccgggactag

SEQ ID NO: 165717 - DNA, 450 bp, Artificial Sequence
  Description of Artificial Sequence: Synthetic coding sequence
atgtcctatgaccgggccatcaccgtcttctccccagatggccacctgttccaggtggagtatgcccaggaggccgtgaagaagggcagcacagctgtgggcgtgcggggccgggacatcgtggtgctgggcgtggagaagaagtctgtggccaagctgcaggatgagaggacagtgaggaagatctgtgccctggatgacaacgtgtgcatggcctttgctggcctgacagcagatgcccgcatcgtcatcaacagagcccgggtggagtgccagagccaccggctgactgtggaggaccctgtgacagtggagtacatcacccgctacatcgccagcctgaagcaggtgggcgcctgccccctggcctgcagccccctggccgccggccagagccggctgcggcacggcggcagctgccacgtgaccagcggggagagcgagaactag

SEQ ID NO: 165718 - DNA, 537 bp, Artificial Sequence
  Description of Artificial Sequence: Synthetic coding sequence
atggcctttgctggcctgacagcagatgcccgcatcgtcatcaacagagcccgggtggagtgccagagccaccggctgactgtggaggaccctgtgacagtggagtacatcacccgctacatcgccagcctgaagcagcgctacacccagagcaatggccggcggcccttcggcatcagcgccctgattgtgggctttgattttgatggcaccccccggctgtaccagacagaccccagcggcacctaccacgcctggaaggccaatgccatcggccgcggggccaagtctgtgcgggagttcctggagaagaactacacagatgaggccattgaaacagatgacctgaccatcaagctggtgatcaaggccctgctggaggtggtgcagagcggcggcaagaacatcgagctggccgtgatgaggcgggaccagagcctgaagatcctgaaccctgaggagattgagaagtatgtggccgagattgagaaggagaaggaggagaatgagaagaagaagcagaagaaggccagctag

SEQ ID NO: 165719 - DNA, 747 bp, Artificial Sequence
  Description of Artificial Sequence: Synthetic coding sequence
atgtcctatgaccgggccatcaccgtcttctccccagatggccacctgttccaggtggagtatgcccaggaggccgtgaagaagggcagcacagctgtgggcgtgcggggccgggacatcgtggtgctgggcgtggagaagaagtctgtggccaagctgcaggatgagaggacagtgaggaagatctgtgccctggatgacaacgtgtgcatggcctttgctggcctgacagcagatgcccgcatcgtcatcaacagagcccgggtggagtgccagagccaccggctgactgtggaggaccctgtgacagtggagtacatcacccgctacatcgccagcctgaagcagcgctacacccagagcaatggccggcggcccttcggcatcagcgccctgattgtgggctttgattttgatggcaccccccggctgtaccagacagaccccagcggcacctaccacgcctggaaggccaatgccatcggccgcggggccaagtctgtgcgggagttcctggagaagaactacacagatgaggccattgaaacagatgacctgaccatcaagctggtgatcaaggccctgctggaggtggtgcagagcggcggcaagaacatcgagctggccgtgatgaggcgggaccagagcctgaagatcctgaaccctgaggagattgagaagtatgtggccgagattgagaaggagaaggaggagaatgagaagaagaagcagaagaaggccagctag

SEQ ID NO: 165720 - DNA, 564 bp, Artificial Sequence
  Description of Artificial Sequence: Synthetic coding sequence
tgactgacagcagatgcccgcatcgtcatcaacagagcccgggtggagtgccagagccaccggctgactgtggaggaccctgtgacagtggagtacatcacccgctacatcgccagcctgaagcagcgctacacccagagcaatggccggcggcccttcggcatcagcgccctgattgtgggctttgattttgatggcaccccccggctgtaccagacagaccccagcggcacctaccacgcctggaaggccaatgccatcggccgcggggccaagtctgtgcgggagttcctggagaagaactacacagatgaggccattgaaacagatgacctgaccatcaagctggtgatcaaggccctgctggagggcaaggtggtgaatgcccctgtgttctgccccttcaaggtggtgcagagcggcggcaagaacatcgagctggccgtgatgagaagagaccagagcctgaagatcctgaaccctgaggagattgagaagtatgtggccgagattgagaaggagaaggaggagaatgagaagaagaagcagaagaaggccagctag

SEQ ID NO: 165721 - DNA, 726 bp, Artificial Sequence
  Description of Artificial Sequence: Synthetic coding sequence
atgctgagcagcacagccatgtacagcgcccctggccgggacctgggcatggagccccacagagctgctggccccctgcagctgcgcttcagcccctacgtgttcaacggcggcaccatcctggccatcgccggggaggactttgccatcgtggccagtgacacccggctgtctgagggcttcagcatccacacccgggacagccccaagtgctacaagctgacagacaagacagtcatcggctgcagcggcttccacggggactgcctgaccctgaccaagatcatcgaggcccggctgaagatgtacaagcacagcaacaacaaggccatgaccactggagccatcgccgccatgctgagcaccatcctgtacagccgccgcttcttcccctactacgtgtacaacatcatcggcggcctggatgaggagggcaaaggagctgtgtacagctttgatcctgtgggcagctaccagagggacagcttcaaggccggcggcagcgccagcgccatgctgcagcccctgctggacaaccaggtgggcttcaagaacatgcagaatgtggagcacgtgcccctgagcctggaccgggccatgaggctggtgaaggatgtgttcatctctgctgctgagagagatgtgtacacaggagatgccctgcgcatctgcatcgtgaccaaggagggcatccgggaggagaccgtgtccctgaggaaggactag

SEQ ID NO: 165722 - DNA, 591 bp, Artificial Sequence
  Description of Artificial Sequence: Synthetic coding sequence
agaagaagccgggccatgctgagcagcacagccatgtacagcgcccctggccgggacctgggcatggagccccacagagctgctggccccctgcagctgcgcttcagcccctacgtgttcaatggaggcaccatcctggccatcgctggagaagattttgccatcgtggccagtgacacccggctgtctgagggcttcagcatccacacccgggacagccccaagtgctacaagctgacagacaagacagtgattggctgcagcggcttccatggagactgcctgaccctgaccaagatcatcgaggcccggctgaagatgtacaagcacagcaacaacaaggccatgaccaccggggccatcgccgccatgctgagcaccatcctgtacagccgccgcttcttcccctactacgtgtacaacatcattggaggcctggatgaggagggcaaaggagctgtgtacagctttgatcctgtgggcagctaccagagggacagcttcaaggccggcggcagcgccagcgccatgctgcagcccctgctggacaaccagtacatcagcagcaacagcgtgtccctgtgtgtgtag

SEQ ID NO: 165723 - DNA, 822 bp, Artificial Sequence
  Description of Artificial Sequence: Synthetic coding sequence
atgctgaagccagccctggagccccggggcggcttctcctttgagaactgccagagaaatgccagcctggagcgggtgctgcccggcctgaaggtgccccacgccaggaagacaggcaccaccatcgccggcctggtgttccaggatggagtcatcctgggcgctgacacccgggccaccaatgattctgtggtggccgacaagagctgtgagaagatccacttcatcgcccccaagatctactgctgcggggccggcgtggccgcagatgctgagatgaccaccaggatggtggccagcaagatggagctgcacgccctgagcacaggccgggagccccgggtggccaccgtgacccgcatcctgcggcagaccctcttccgctaccagggccacgtgggcgccagcctcatcgtgggcggcgtggacctgaccggcccccagctgtatggagtgcacccccacggcagctacagccggctgcccttcaccgccctgggcagcggccaggatgctgccctggccgtgctggaggaccgcttccagcccaacatgaccctggaggccgcccagggcctgctggtggaggccgtgacagctggcatcctgggggacctgggcagcggcggcaatgtggatgcctgtgtgatcaccaagacaggagccaagctgctgcggaccctgagcagccccacagagcctgtgaagaggagcggccgctaccactttgtgcccggcaccacagctgtgctgacccagacagtgaagcccctgaccctggagctggtggaggagaccgtgcaggccatggaggtggagtag

SEQ ID NO: 165724 - DNA, 903 bp, Artificial Sequence
  Description of Artificial Sequence: Synthetic coding sequence
atggccctgcaggatgtgtgcaagtggcagagcccagacacccagggccccagcccccacctgccccgggccggcggctgggccgtgccccggggctgtgacccccagaccttcctgcagatccacggcccccggctggcccacggcaccaccaccctggccttccgcttcagacatggagtgattgctgctgctgacaccaggagcagctgtggcagctatgtggcctgcccagccagctgcaaggtgattcctgtgcaccagcacctgctgggcaccaccagcggcaccagcgctgactgtgccacctggtacagagtgctgcagcgggagctgcggctgcgggagctgcgggagggccagctgcccagcgtggccagcgctgccaagctgctgagcgccatgatgagccagtaccggggcctggacctgtgtgtggccacagccctgtgtggctgggacaggagcggccctgagctgttctacgtgtacagtgatggcacccggctgcagggcgacatcttctctgtgggcagcggcagcccctatgcctatggagtgctggaccggggctaccgctatgacatgagcacccaggaggcctatgccctggcccgctgtgctgtggcccacgccacccacagagatgcctacagcggcggctctgtggacctcttccacgtgcgggagagcggctgggagcacgtgtccagaagtgatgcctgtgtgctgtatgtggagctgcagaagctgctggagcctgagcctgaggaggatgccagccacgcccaccctgagcccgccacagcccacagagctgctgaagatcgggagctgtctgtgggccctggagaggtgacccctggggacagcaggatgcctgctggaacagaaacagtgtag

SEQ ID NO: 165725 - DNA, 606 bp, Artificial Sequence
  Description of Artificial Sequence: Synthetic coding sequence
atggagtacctgattggcatccagggccctgactatgtgctggtggccagtgacagagtggccgccagcaacatcgtgcagatgaaggatgaccatgacaagatgttcaagatgtctgagaagatcctgctgctgtgtgtgggggaggccggggacacagtgcagtttgctgagtacatccagaagaatgtgcagctgtacaagatgagaaatggctatgagctgagccccacagctgctgccaacttcaccaggaggaacctggccgactgcctgcggagcaggaccccctaccacgtgaacctgctgctggccggctatgatgagcacgagggccctgccctgtactacatggactacctggccgccctggccaaggccccctttgctgcccacggctacggggccttcctgaccctgagcatcctggaccgctactacacccccaccatcagccgggagagagctgtggagctgctgaggaagtgcctggaggagctgcagaagcgcttcatcctgaacctgcccaccttctctgtgcgcatcatcgacaagaatggcatccatgacctggacaacatctccttccccaagcagggcagctag

SEQ ID NO: 165726 - DNA, 468 bp, Artificial Sequence
  Description of Artificial Sequence: Synthetic coding sequence
atggccagcctgaagtgcagcacagtggtgtgtgtgatctgcctggagaagcccaagtaccgctgcccagcctgccgggtgccctactgcagcgtggtgtgcttcaggaagcacaaggagcagtgcaaccctgagaccaggcctgtggagaagaagatccgcagcgccctgcccaccaagacagtgaagcctgtggagaacaaggatgatgatgacagcattgctgacttcctgaacagtgatgaggaggaggacagagtgtccctgcagaacctgaagaacctgggggagagcgccaccctgcggagcctgctgctgaacccccacctgcggcagctgatggtgaacctggaccagggcgaggacaaggccaagctgatgagggcctacatgcaggagcccctgtttgtggagtttgctgactgctgcctgggcatcgtggagcccagccagaatgaggagagctag

SEQ ID NO: 165727 - DNA, 795 bp, Artificial Sequence
  Description of Artificial Sequence: Synthetic coding sequence
atggaggccttcctgggcagccgcagcggcctgtgggccggcggccctgcccctggccagttctaccgcatccccagcaccccagacagcttcatggaccctgccagcgccctgtaccggggccccatcaccaggacccagaaccccatggtgacaggcacctctgtgctgggcgtgaagtttgaaggaggagtggtgattgctgctgacatgctgggcagctatggcagcctggcccgcttcaggaacatcagccgcatcatgagggtgaacaacagcaccatgctgggcgccagcggggactatgctgacttccagtacctgaagcaggtgctgggccagatggtgattgatgaggagctgctgggagatggccacagctacagcccccgggccatccacagctggctgacccgggccatgtacagccgccgcagcaagatgaaccccctgtggaacaccatggtgattggaggctatgcagatggagagagcttcctgggctacgtggacatgctgggcgtggcctatgaggcccccagcctggccaccggctacggggcctacctggcccagcccctgctgcgggaggtgctggagaagcagcctgtgctgagccagacagaggcccgggacctggtggagcgctgcatgagggtgctgtactacagagatgcccggagctacaaccgcttccagatcgccaccgtgacagagaagggcgtggagattgagggccccctgagcacagagaccaactgggacatcgcccacatgatcagcggctttgaatag

SEQ ID NO: 165728 - DNA, 792 bp, Artificial Sequence
  Description of Artificial Sequence: Synthetic coding sequence
atggccctggcctctgtgctggagcggcccctgcctgtgaaccagaggggcttcttcggcctgggcggccgggctgacctgctggacctgggccctggcagcctgagtgatggcctgagcctggccgcccctggctggggcgtgcctgaggagcccggcatcgagatgctgcacggcaccaccaccctggccttcaagttcagacatggagtcatcgtggccgctgacagccgggccacagctggggcctacatcgccagccagacagtgaagaaggtgattgagatcaacccctacctgctgggcaccatggccggcggcgctgctgactgcagcttctgggagcggctgctggcccggcagtgccgcatctatgagctgaggaacaaggagcgcatctctgtggccgccgccagcaagctgctggccaacatggtgtaccagtacaagggcatgggcctgtccatgggcaccatgatctgtggctgggacaagaggggccctggcctgtactacgtggacagcgagggcaaccgcatcagcggggccaccttctctgtgggcagcggctctgtgtatgcctatggagtgatggaccggggctacagctatgacctggaggtggagcaggcctatgacctggcccggcgggccatctaccaggccacctacagagatgcctacagcggcggcgctgtgaacctgtaccacgtgcgggaggatggctggatccgggtgtccagtgacaacgtggccgacctgcacgagaagtacagcggcagcaccccctag

SEQ ID NO: 165729 - DNA, 483 bp, Artificial Sequence
  Description of Artificial Sequence: Synthetic coding sequence
atggccggcggcgctgctgactgcagcttctgggagcggctgctggcccggcagtgccgcatctatgagctgaggaacaaggagcgcatctctgtggccgccgccagcaagctgctggccaacatggtgtaccagtacaagggcatgggcctgtccatgggcaccatgatctgtggctgggacaagaggggccctggcctgtactacgtggacagcgagggcaaccgcatcagcggggccaccttctctgtgggcagcggctctgtgtatgcctacggcgtgatggaccggggctacagctatgacctggaggtggagcaggcctatgacctggcccggcgggccatctaccaggccacctacagagatgcctacagcggcggcgctgtgaacctgtaccacgtgagagaagatggctggatccgggtgtccagtgacaacgtggccgacctgcacgagaagtacagcggcagcaccccctag

SEQ ID NO: 165730 - DNA, 612 bp, Artificial Sequence
  Description of Artificial Sequence: Synthetic coding sequence
atggccctggcctctgtgctggagcggcccctgcctgtgaaccagaggggcttcttcggcctgggcggccgggctgacctgctggacctgggccctggcagcctgagtgatggcctgagcctggccgcccctggctggggcgtgcctgaggagcccggcatcgagatgctgcacggcaccaccaccctggccttcaagttcagacatggagtcatcgtggccgctgacagccgggccacagctggggcctacatcgccagccagacagtgaagaaggtgattgagatcaacccctacctgctgggcaccatggccggcggcgctgctgactgcagcttctgggagcggctgctggcccggcagtgccgcatctatgagctgaggaacaaggagcgcatctctgtggccgccgccagcaagctgctggccaacatggtgtaccagtacaagggcatgggcctgtccatgggcaccatgatctgtggctgggacaagaggggccctgtgtctgaggtgctgtgcctgaagcccaagagctttggcatgtacctgttctgtggctgtgccgagcgcatcggcaacatggcccggcccctgctgcggggccagtag

SEQ ID NO: 165731 - DNA, 834 bp, Artificial Sequence
  Description of Artificial Sequence: Synthetic coding sequence
atggctgctgtgtctgtgtatgcccctcctgtgggcggcttctcctttgacaactgcagaagaaatgctgtgctggaggccgactttgccaagaggggctacaagctgcccaaggtgaggaagacaggcaccaccatcgccggcgtggtgtacaaggatggcatcgtgctgggcgctgacacccgggccacagagggcatggtggtggccgacaagaactgcagcaagatccacttcatcagccccaacatctactgctgcggggccggcacagctgctgacacagacatgaccacccagctgatcagcagcaacctggagctgcacagcctgagcacaggccgcctgccccgggtggtgacagccaacaggatgctgaagcagatgctgttccgctaccagggctacatcggggccgccctggtgctgggcggcgtggatgtgacaggcccccacctgtacagcatctacccccacggcagcacagacaagctgccctacgtgaccatgggcagcggcagcctggccgccatggctgtgtttgaggacaagttccggccagacatggaggaggaggaggccaagaacctggtgtctgaggccatcgccgccggcatcttcaatgacctgggcagcggcagcaacatcgacctgtgtgtgatcagcaagaacaagctggacttcctgcggccctacacagtgcccaacaagaagggcacccggctgggccgctaccgctgtgagaagggcaccacagctgtgctgacagagaagatcacccccctggagattgaggtgctggaggagaccgtgcagaccatggacaccagctag

SEQ ID NO: 165732 - DNA, 633 bp, Artificial Sequence
  Description of Artificial Sequence: Synthetic coding sequence
atggctgctgtgtctgtgtatgcccctcctgtgggcggcttctcctttgacaactgcagaagaaatgctgtgctggaggccgactttgccaagaggggctacaagctgcccaaggtgaggaagacaggcaccaccatcgccggcgtggtgtacaaggatggcatcgtgctgggcgctgacacccgggccacagagggcatggtggtggccgacaagaactgcagcaagatccacttcatcagccccaacatctactgctgcggggccggcacagctgctgacacagacatgaccacccagctgatcagcagcaacctggagctgcacagcctgagcacaggccgcctgccccgggtggtgacagccaacaggatgctgaagcagatgctgttccgctaccagggctacatcggggccgccctggtgctgggcggcgtggatgtgacaggcccccacctgtacagcatctacccccacggcagcacagacaagctgccctacgtgaccatggtgcactgtgaggaggagctgttcacagagaacctcttcttcatccggcaggccgaggtggtgtctgaggaggcctggggccccagctttgccatcagcctggccgtgttcctggtggcctag

SEQ ID NO: 165733 - DNA, 429 bp, Artificial Sequence
  Description of Artificial Sequence: Synthetic coding sequence
atggctgctgtgtctgtgtatgcccctcctgtgggcggcttctcctttgacaactgcagaagaaatgctgtgctggaggccgactttgccaagaggggctacaagctgcccaaggtgaggaagacaggcaccaccatcgccggcgtggtgtacaaggatggcatcgtgctgggcgctgacacccgggccacagagggcatggtggtggccgacaagaactgcagcaagatccacttcatcagccccaacatctactgctgcggggccggcacagctgctgacacagacatgaccacccagctgatcagcagcaacctggagctgcacagcctgagcacaggccgcctgccccgggtggtgacagccaacaggatgctgaagcagatgctgttccgcttctggctgctgggcagcaatggctgcatctag

SEQ ID NO: 165734 - DNA, 819 bp, Artificial Sequence
  Description of Artificial Sequence: Synthetic coding sequence
atgctgattggcacccccaccccccgggacaccacccccagctcctggctgaccagcagcctgctggtggaggccgcccccctggatgacaccaccctgcccacccctgtgagcagcggctgccccggcctggagcccacagagttcttccagagcctgggcggagatggagagagaaatgtgcagatcgagatggcccacggcaccaccaccctggccttcaagttccagcacggcgtgattgctgctgtggacagccgggccagcgctggcagctacatcagcgccctgcgggtgaacaaggtgattgagatcaacccctacctgctgggcaccatgagcggctgtgccgctgactgccagtactgggagcggctgctggccaaggagtgccgcctgtactacctgagaaatggagagcgcatctctgtgtctgctgccagcaagctgctgagcaacatgatgtgccagtaccggggcatgggcctgtccatgggctccatgatctgtggctgggacaagaagggccctggcctgtactacgtggatgaacatggcacccggctgagcggcaacatgttcagcacaggcagcggcaacacctacgcctacggcgtgatggattctggctaccggcccaacctgagccctgaggaggcctatgacctgggcagaagagccatcgcctatgccacccaccgggacagctacagcggcggcgtggtgaacatgtaccacatgaaggaggatggctgggtgaaggtggagagcacagatgtgtctgacctgctgcaccagtaccgggaggccaaccagtag

SEQ ID NO: 165735 - DNA, 831 bp, Artificial Sequence
  Description of Artificial Sequence: Synthetic coding sequence
atggccctgctggatgtgtgtggggccccccggggccagaggcctgagagcgccctgcctgtggccggcagcggccgccgcagtgaccccggccactacagcttctccatgaggagccctgagctggccctgccccggggcatgcagcccacagagttcttccagagcctgggcggagatggagagagaaatgtgcagatcgagatggcccacggcaccaccaccctggccttcaagttccagcacggcgtgattgctgctgtggacagccgggccagcgctggcagctacatcagcgccctgcgggtgaacaaggtgattgagatcaacccctacctgctgggcaccatgagcggctgtgccgctgactgccagtactgggagcggctgctggccaaggagtgccgcctgtactacctgagaaatggagagcgcatctctgtgtctgctgccagcaagctgctgagcaacatgatgtgccagtaccggggcatgggcctgtccatgggctccatgatctgtggctgggacaagaagggccctggcctgtactacgtggatgaacatggcacccggctgagcggcaacatgttcagcacaggcagcggcaacacctacgcctacggcgtgatggattctggctaccggcccaacctgagccctgaggaggcctatgacctgggcagaagagccatcgcctatgccacccaccgggacagctacagcggcggcgtggtgaacatgtaccacatgaaggaggatggctgggtgaaggtggagagcacagatgtgtctgacctgctgcaccagtaccgggaggccaaccagtag

SEQ ID NO: 165736 - DNA, 831 bp, Artificial Sequence; identical to SEQ ID NO: 165735
  Description of Artificial Sequence: Synthetic coding sequence

SEQ ID NO: 165737 - DNA, 819 bp, Artificial Sequence; identical to SEQ ID NO: 165734
  Description of Artificial Sequence: Synthetic coding sequence

SEQ ID NO: 165738 - DNA, 759 bp, Artificial Sequence
  Description of Artificial Sequence: Synthetic coding sequence
atggccctgctggatgtgtgtggggccccccggggccagaggcctgagagcgccctgcctgtggccggcagcggccgccgcagtgaccccggccactacagcttctccatgaggagccctgagctggccctgccccggggcatgcagcccacagagttcttccagagcctgggcggagatggagagagaaatgtgcagatcgagatggcccacggcaccaccaccctggccttcaagttccagcacggcgtgattgctgctgtggacagccgggccagcgctggcagctacatcaactgccagtactgggagcggctgctggccaaggagtgccgcctgtactacctgagaaatggagagcgcatctctgtgtctgctgccagcaagctgctgagcaacatgatgtgccagtaccggggcatgggcctgtccatgggctccatgatctgtggctgggacaagaagggccctggcctgtactacgtggatgaacatggcacccggctgagcggcaacatgttcagcacaggcagcggcaacacctacgcctacggcgtgatggattctggctaccggcccaacctgagccctgaggaggcctatgacctgggcagaagagccatcgcctatgccacccaccgggacagctacagcggcggcgtggtgaacatgtaccacatgaaggaggatggctgggtgaaggtggagagcacagatgtgtctgacctgctgcaccagtaccgggaggccaaccagtag

SEQ ID NO: 165739 - DNA, 759 bp, Artificial Sequence; identical to SEQ ID NO: 165738
  Description of Artificial Sequence: Synthetic coding sequence

SEQ ID NO: 165740 - DNA, 819 bp, Artificial Sequence; identical to SEQ ID NO: 165734
  Description of Artificial Sequence: Synthetic coding sequence

SEQ ID NO: 165741 - DNA, 819 bp, Artificial Sequence; identical to SEQ ID NO: 165734
  Description of Artificial Sequence: Synthetic coding sequence

SEQ ID NO: 165742 - DNA, 831 bp, Artificial Sequence; identical to SEQ ID NO: 165735
  Description of Artificial Sequence: Synthetic coding sequence

SEQ ID NO: 165743 - DNA, 759 bp, Artificial Sequence; identical to SEQ ID NO: 165738
  Description of Artificial Sequence: Synthetic coding sequence

SEQ ID NO: 165744 - DNA, 759 bp, Artificial Sequence; identical to SEQ ID NO: 165738
  Description of Artificial Sequence: Synthetic coding sequence

SEQ ID NO: 165745 - DNA, 831 bp, Artificial Sequence; identical to SEQ ID NO: 165735
  Description of Artificial Sequence: Synthetic coding sequence

SEQ ID NO: 165746 - DNA, 819 bp, Artificial Sequence; identical to SEQ ID NO: 165734
  Description of Artificial Sequence: Synthetic coding sequence

SEQ ID NO: 165747 - DNA, 819 bp, Artificial Sequence; identical to SEQ ID NO: 165734
  Description of Artificial Sequence: Synthetic coding sequence

SEQ ID NO: 165748 - DNA, 831 bp, Artificial Sequence; identical to SEQ ID NO: 165735
  Description of Artificial Sequence: Synthetic coding sequence

SEQ ID NO: 165749 - DNA, 819 bp, Artificial Sequence; identical to SEQ ID NO: 165734
  Description of Artificial Sequence: Synthetic coding sequence

SEQ ID NO: 165750 - DNA, 831 bp, Artificial Sequence
  Description of Artificial Sequence: Synthetic coding sequence
atggccctgctggatgtgtgtggggccccccggggccagaggcctgagagcgccctgcctgtggccggcagcggccgccgcagtgaccccggccactacagcttctccatgaggagccctgagctggccctgccccggggcatgaagcccacagagttcttccagagcctgggcggagatggagagagaaatgtgcagatcgagatggcccacggcaccaccaccctggccttcaagttccagcacggcgtgattgctgctgtggacagccgggccagcgctggcagctacatcagcgccctgcgggtgaacaaggtgattgagatcaacccctacctgctgggcaccatgagcggctgtgccgctgactgccagtactgggagcggctgctggccaaggagtgccgcctgtactacctgagaaatggagagcgcatctctgtgtctgctgccagcaagctgctgagcaacatgatgtgccagtaccggggcatgggcctgtccatgggctccatgatctgtggctgggacaagaagggccctggcctgtactacgtggatgaacatggcacccggctgagcggcaacatgttcagcacaggcagcggcaacacctacgcctacggcgtgatggattctggctaccggcccaacctgagccctgaggaggcctatgacctgggcagaagagccatcgcctatgccacccaccgggacagctacagcggcggcgtggtgaacatgtaccacatgaaggaggatggctgggtgaaggtggagagcacagatgtgtctgacctgctgcaccagtaccgggaggccaaccagtag

SEQ ID NO: 165751 - DNA, 759 bp, Artificial Sequence; identical to SEQ ID NO: 165738
  Description of Artificial Sequence: Synthetic coding sequence

SEQ ID NO: 165752 - DNA, 759 bp, Artificial Sequence; identical to SEQ ID NO: 165738
  Description of Artificial Sequence: Synthetic coding sequence

SEQ ID NO: 165753 - DNA, 759 bp, Artificial Sequence
  Description of Artificial Sequence: Synthetic coding sequence
atggccctgctggatgtgtgtggggccccccggggccagaggcctgagagcgccctgcctgtggccggcagcggccgccgcagtgaccccggccactacagcttctccatgaggagccctgagctggccctgccccggggcatgaagcccacagagttcttccagagcctgggcggagatggagagagaaatgtgcagatcgagatggcccacggcaccaccaccctggccttcaagttccagcacggcgtgattgctgctgtggacagccgggccagcgctggcagctacatcaactgccagtactgggagcggctgctggccaaggagtgccgcctgtactacctgagaaatggagagcgcatctctgtgtctgctgccagcaagctgctgagcaacatgatgtgccagtaccggggcatgggcctgtccatgggctccatgatctgtggctgggacaagaagggccctggcctgtactacgtggatgaacatggcacccggctgagcggcaacatgttcagcacaggcagcggcaacacctacgcctacggcgtgatggattctggctaccggcccaacctgagccctgaggaggcctatgacctgggcagaagagccatcgcctatgccacccaccgggacagctacagcggcggcgtggtgaacatgtaccacatgaaggaggatggctgggtgaaggtggagagcacagatgtgtctgacctgctgcaccagtaccgggaggccaaccagtag

SEQ ID NO: 165754 - DNA, 819 bp, Artificial Sequence; identical to SEQ ID NO: 165734
  Description of Artificial Sequence: Synthetic coding sequence

SEQ ID NO: 165755 - DNA, 831 bp, Artificial Sequence; identical to SEQ ID NO: 165735
  Description of Artificial Sequence: Synthetic coding sequence

SEQ ID NO: 165756 - DNA, 831 bp, Artificial Sequence; identical to SEQ ID NO: 165735
  Description of Artificial Sequence: Synthetic coding sequence

SEQ ID NO: 165757 - DNA, 759 bp, Artificial Sequence; identical to SEQ ID NO: 165738
  Description of Artificial Sequence: Synthetic coding sequence

SEQ ID NO: 165758 - DNA, 831 bp, Artificial Sequence; identical to SEQ ID NO: 165735
  Description of Artificial Sequence: Synthetic coding sequence

SEQ ID NO: 165759 - DNA, 660 bp, Artificial Sequence
  Description of Artificial Sequence: Synthetic coding sequence
atgctgcgggccggggcccccaccggggacctgccccgggccggggaggtgcacacaggcaccaccatcatggctgtggagtttgatggaggagtggtgatgggcagtgacagccgggtgtctgctggggaggccgtggtgaacagagtgtttgacaagctgagccccctgcacgagcgcatctactgtgccctgagcggcagcgctgctgatgcccaggccgtggccgacatggccgcctaccagctggagctgcacggcatcgagctggaggagccccccctggtgctggccgccgccaacgtggtgaggaacatctcctacaagtaccgggaggacctgagcgcccacctgatggtggccggctgggaccagcgggagggcggccaggtgtatggcaccctgggcggcatgctgacccggcagccctttgccatcggcggcagcggcagcaccttcatctacggctacgtggatgctgcctacaagccaggcatgagccctgaggagtgccgccgcttcaccacagatgccatcgccctggccatgagcagagatggcagcagtggaggagtcatctacctggtgaccatcacagctgctggggtggaccacagggtcatcctgggcaatgagctgcccaagttctatgatgaatag

SEQ ID NO: 165760 - DNA, 660 bp, Artificial Sequence; identical to SEQ ID NO: 165759
  Description of Artificial Sequence: Synthetic coding sequence

SEQ ID NO: 165761 - DNA, 660 bp, Artificial Sequence; identical to SEQ ID NO: 165759
  Description of Artificial Sequence: Synthetic coding sequence

SEQ ID NO: 165762 - DNA, 591 bp, Artificial Sequence
  Description of Artificial Sequence: Synthetic coding sequence
atggctgtggagtttgatggcggcgtggtgatgggcagtgacagccgggtgtctgctggggaggccgtggtgaacagagtgtttgacaagctgagccccctgcacgagcgcatctactgtgccctgagcggcagcgctgctgatgcccaggccgtggccgacatggccgcctaccagctggagctgcatggaattgagctggaggagccccccctggtgctggccgccgccaacgtggtgaggaacatctcctacaagtaccgggaggacctgagcgcccacctgatggtggccggctgggaccagcgggagggcggccaggtgtatggcaccctgggcggcatgctgacccggcagccctttgccatcggcggcagcggcagcaccttcatctacggctacgtggatgctgcctacaagccaggcatgagcccagaagaatgtcgccgcttcaccacagatgccatcgccctggccatgagcagagatggcagcagcggcggcgtcatctacctggtgaccatcacagctgctggggtggaccacagggtcatcctgggcaatgagctgcccaagttctatgatgaatag

SEQ ID NO: 165763 - DNA, 537 bp, Artificial Sequence
  Description of Artificial Sequence: Synthetic coding sequence
atgctgcgggccggggcccccaccggggacctgccccgggccggggaggtgcacacaggcaccaccatcatggctgtggagtttgatggaggagtggtgatgggcagtgacagccgggtgtctgctggcatcgagctggaggagccccccctggtgctggccgccgccaacgtggtgaggaacatctcctacaagtaccgggaggacctgagcgcccacctgatggtggccggctgggaccagcgggagggcggccaggtgtatggcaccctgggcggcatgctgacccggcagccctttgccatcggcggcagcggcagcaccttcatctacggctacgtggatgctgcctacaagccaggcatgagccctgaggagtgccgccgcttcaccacagatgccaccagcaccaagagaagagtgtgtggctacttcctgcggacccagaagcgggagaaccagaaccagagggtgcatgagtacatgtgcaccggggagaggagcctgagcagcagccccctgctgagctgcagctag

SEQ ID NO: 165764 - DNA, 591 bp, Artificial Sequence; identical to SEQ ID NO: 165762
  Description of Artificial Sequence: Synthetic coding sequence

SEQ ID NO: 165765 - DNA, 537 bp, Artificial Sequence; identical to SEQ ID NO: 165763
  Description of Artificial Sequence: Synthetic coding sequence

SEQ ID NO: 165766 - DNA, 591 bp, Artificial Sequence; identical to SEQ ID NO: 165762
  Description of Artificial Sequence: Synthetic coding sequence

SEQ ID NO: 165767 - DNA, 537 bp, Artificial Sequence; identical to SEQ ID NO: 165763
  Description of Artificial Sequence: Synthetic coding sequence

SEQ ID NO: 165768 - DNA, 396 bp, Artificial Sequence
  Description of Artificial Sequence: Synthetic coding sequence
atggctgtggagtttgatggcggcgtggtgatgggcagtgacagccgggtgtctgctggggaggccgtggtgaacagagtgtttgacaagctgagccccctgcacgagcgcatctactgtgccctgagcggcagcgctgctgatgcccaggccgtggccgacatggccgcctaccagctggagctgcatggaattgagctggaggagccccccctggtgctggccgccgccaacgtggtgaggaacatctcctacaagtaccgggaggacctgagcgcccacctgatggtggccggctgggaccagcgggagggcggccaggtgtatggcaccctgggcggcatgctgacccggcagccctttgccatcggcggcagcggcagcaccttcatctag

SEQ ID NO: 165769 - DNA, 396 bp, Artificial Sequence; identical to SEQ ID NO: 165768
  Description of Artificial Sequence: Synthetic coding sequence

SEQ ID NO: 165770 - DNA, 396 bp, Artificial Sequence; identical to SEQ ID NO: 165768
  Description of Artificial Sequence: Synthetic coding sequence

SEQ ID NO: 165771 - DNA, 396 bp, Artificial Sequence; identical to SEQ ID NO: 165768
  Description of Artificial Sequence: Synthetic coding sequence

SEQ ID NO: 165772 - DNA, 537 bp, Artificial Sequence
  Description of Artificial Sequence: Synthetic coding sequence
atgctgcgggccggggcccccaccggggacctgccccgggccggggaggtgcacacaggcaccaccatcatggctgtggagtttgatggaggagtggtgatgggcagtgacagccgggtgtctgctggcatcgagctggaggagccccccctggtgctggccgccgccaacgtggtgaggaacatctcctacaagtaccgggaggacctgagcgcccacctgatggtggccggctgggaccagcgggagggcggccaggtgtatggcaccctgggcggcatgctgacccggcagccctttgccatcggcggcagcggcagcaccttcatctacggctacgtggatgctgcctacaagccaggcatgagccctgaggagtgccgccgcttcaccacagatgccaccagcaccaagagaagagtgtgtggctacttcctgcggacccagaagcgggagaaccagaaccagagggtgcatgagtacatgtgcaccagcgagaggagcctgagcagcagccccctgctgagctgcagctag

SEQ ID NO: 165773 - DNA, 396 bp, Artificial Sequence
  Description of Artificial Sequence: Synthetic coding sequence
atggctgtggagtttgatggcggcgtggtgatgggcagtgacagccgggtgtctgctggggaggccgtggtgaacagagtgtttgacaagctgagccccctgcacgagcacatctactgtgccctgagcggcagcgctgctgatgcccaggccgtggccgacatggccgcctaccagctggagctgcatggaattgagctggaggagccccccctggtgctggccgccgccaacgtggtgaggaacatctcctacaagtaccgggaggacctgagcgcccacctgatggtggccggctgggaccagcgggagggcggccaggtgtatggcaccctgggcggcatgctgacccggcagccctttgccatcggcggcagcggcagcaccttcatctag

SEQ ID NO: 165774 - DNA, 591 bp, Artificial Sequence; identical to SEQ ID NO: 165762
  Description of Artificial Sequence: Synthetic coding sequence

SEQ ID NO: 165775 - DNA, 660 bp, Artificial Sequence; identical to SEQ ID NO: 165759
  Description of Artificial Sequence: Synthetic coding sequence

SEQ ID NO: 165776 - DNA, 591 bp, Artificial Sequence
  Description of Artificial Sequence: Synthetic coding sequence
atggctgtggagtttgatggcggcgtggtgatgggcagtgacagccgggtgtctgctggggaggccgtggtgaacagagtgtttgacaagctgagccccctgcacgagcacatctactgtgccctgagcggcagcgctgctgatgcccaggccgtggccgacatggccgcctaccagctggagctgcatggaattgagctggaggagccccccctggtgctggccgccgccaacgtggtgaggaacatctcctacaagtaccgggaggacctgagcgcccacctgatggtggccggctgggaccagcgggagggcggccaggtgtatggcaccctgggcggcatgctgacccggcagccctttgccatcggcggcagcggcagcaccttcatctacggctacgtggatgctgcctacaagccaggcatgagcccagaagaatgtcgccgcttcaccacagatgccatcgccctggccatgagcagagatggcagcagcggcggcgtcatctacctggtgaccatcacagctgctggggtggaccacagggtcatcctgggcaatgagctgcccaagttctatgatgaatag

SEQ ID NO: 165777 - DNA, 537 bp, Artificial Sequence; identical to SEQ ID NO: 165772
  Description of Artificial Sequence: Synthetic coding sequence

SEQ ID NO: 165778 - DNA, 537 bp, Artificial Sequence; identical to SEQ ID NO: 165772
  Description of Artificial Sequence: Synthetic coding sequence

SEQ ID NO: 165779 - DNA, 660 bp, Artificial Sequence
  Description of Artificial Sequence: Synthetic coding sequence
atgctgcgggccggggcccccaccggggacctgccccgggccggggaggtgcacacaggcaccaccatcatggctgtggagtttgatggaggagtggtgatgggcagtgacagccgggtgtctgctggggaggccgtggtgaacagagtgtttgacaagctgagccccctgcacgagcacatctactgtgccctgagcggcagcgctgctgatgcccaggccgtggccgacatggccgcctaccagctggagctgcacggcatcgagctggaggagccccccctggtgctggccgccgccaacgtggtgaggaacatctcctacaagtaccgggaggacctgagcgcccacctgatggtggccggctgggaccagcgggagggcggccaggtgtatggcaccctgggcggcatgctgacccggcagccctttgccatcggcggcagcggcagcaccttcatctacggctacgtggatgctgcctacaagccaggcatgagccctgaggagtgccgccgcttcaccacagatgccatcgccctggccatgagcagagatggcagcagtggaggagtcatctacctggtgaccatcacagctgctggggtggaccacagggtcatcctgggcaatgagctgcccaagttctatgatgaatag

SEQ ID NO: 165780 - DNA, 591 bp, Artificial Sequence; identical to SEQ ID NO: 165776
  Description of Artificial Sequence: Synthetic coding sequence

SEQ ID NO: 165781 - DNA, 660 bp, Artificial Sequence; identical to SEQ ID NO: 165779
  Description of Artificial Sequence: Synthetic coding sequence

SEQ ID NO: 165782 - DNA, 396 bp, Artificial Sequence; identical to SEQ ID NO: 165768
  Description of Artificial Sequence: Synthetic coding sequence

SEQ ID NO: 165783 - DNA, 396 bp, Artificial Sequence; identical to SEQ ID NO: 165773
  Description of Artificial Sequence: Synthetic coding sequence

SEQ ID NO: 165784 - DNA, 591 bp, Artificial Sequence; identical to SEQ ID NO: 165776
  Description of Artificial Sequence: Synthetic coding sequence

SEQ ID NO: 165785 - DNA, 660 bp, Artificial Sequence; identical to SEQ ID NO: 165759
  Description of Artificial Sequence: Synthetic coding sequence

SEQ ID NO: 165786 - DNA, 537 bp, Artificial Sequence; identical to SEQ ID NO: 165763
  Description of Artificial Sequence: Synthetic coding sequence

SEQ ID NO: 165787 - DNA, 537 bp, Artificial Sequence; identical to SEQ ID NO: 165763
  Description of Artificial Sequence: Synthetic coding sequence

SEQ ID NO: 165788 - DNA, 591 bp, Artificial Sequence; identical to SEQ ID NO: 165762
  Description of Artificial Sequence: Synthetic coding sequence

SEQ ID NO: 165789 - DNA, 660 bp, Artificial Sequence; identical to SEQ ID NO: 165779
  Description of Artificial Sequence: Synthetic coding sequence

SEQ ID NO: 165790 - DNA, 465 bp, Artificial Sequence
  Description of Artificial Sequence: Synthetic coding sequence
atgctgcgggccggggcccccaccggggacctgccccgggccggggaggtgcacacaggcaccaccatcatggctgtggagtttgatggaggagtggtgatgggcagtgacagccgggtgtctgctggcatcgagctggaggagccccccctggtgctggccgccgccaacgtggtgaggaacatctcctacaagtaccgggaggacctgagcgcccacctgatggtggccggctgggaccagcgggagggcggccaggtgtatggcaccctgggcggcatgctgacccggcagccctttgccatcggcggcagcggcagcaccttcatctacggctacgtggatgctgcctacaagccaggcatgagccctgaggagtgccgccgcttcaccacagatggcaaccagcccagcggccgggtgcctggagagggctttgagacctgggagggcagccggctgtag

SEQ ID NO: 165791 - DNA, 396 bp, Artificial Sequence; identical to SEQ ID NO: 165773
  Description of Artificial Sequence: Synthetic coding sequence

SEQ ID NO: 165792 - DNA, 465 bp, Artificial Sequence; identical to SEQ ID NO: 165790
  Description of Artificial Sequence: Synthetic coding sequence

SEQ ID NO: 165793 - DNA, 465 bp, Artificial Sequence; identical to SEQ ID NO: 165790
  Description of Artificial Sequence: Synthetic coding sequence

SEQ ID NO: 165794 - DNA, 465 bp, Artificial Sequence; identical to SEQ ID NO: 165790
  Description of Artificial Sequence: Synthetic coding sequence

SEQ ID NO: 165795 - DNA, 465 bp, Artificial Sequence; identical to SEQ ID NO: 165790
  Description of Artificial Sequence: Synthetic coding sequence

SEQ ID NO: 165796 - DNA, 465 bp, Artificial Sequence; identical to SEQ ID NO: 165790
  Description of Artificial Sequence: Synthetic coding sequence

SEQ ID NO: 165797 - DNA, 465 bp, Artificial Sequence; identical to SEQ ID NO: 165790
  Description of Artificial Sequence: Synthetic coding sequence

SEQ ID NO: 165798 - DNA, 465 bp, Artificial Sequence; identical to SEQ ID NO: 165790
  Description of Artificial Sequence: Synthetic coding sequence

SEQ ID NO: 165799 - DNA, 426 bp, Artificial Sequence
  Description of Artificial Sequence: Synthetic coding sequence
atgaatgcccggggcctgggcagcgagctgaaggacagcatccctgtgacagagctgagcgccagcggcccctttgagagccatgacctgctgaggaagggcttcagctgtgtgaagaatgagctgctgcccagccaccccctggagctgtctgagaagaacttccagctgaaccaggacaagatgaacttcagcaccctgaggaacatccagggcctgtttgcccccctgaagctgcagatggagttcaaggctgtgcagcaggtgcagaggctgcccttcctgagcagcagcaacctgagcctggatgtgctgcggggaaatgatgagaccatcggctttgaggacatcctgaatgaccccagccagagcgaggtgatgggagagccccacctgatggtggagtacaagctgggcctgctgtag

SEQ ID NO: 165800 - DNA, 471 bp, Artificial Sequence
  Description of Artificial Sequence: Synthetic coding sequence
atgcccatggccggcctgctgaagggcctggtgcggcagctggagcgcttctctgtgcagcagcaggccagcaagatgccacccaagggcaagagcggcagcggcaaggccgggaaaggaggagctgccagcggcagtgacagcgctgacaagaaggcccagggccccaagggcggcggcaatgctgtgaaggtgcgccacatcctgtgtgagaagcacggcaagatcatggaggccatggagaagctgaagagcggcatgaggttcaatgaggtggccgcccagtacagcgaggacaaggcccggcagggcggggacctgggctggatgacccggggctccatggtgggccccttccaggaggccgcctttgccctgcctgtgtctggcatggacaagcctgtgttcacagatcctcctgtgaagaccaagtttggctaccacatcatcatggtggagggcaggaagtag

SEQ ID NO: 165801 - DNA, 402 bp, Artificial Sequence
  Description of Artificial Sequence: Synthetic coding sequence
atgcccatggccggcctgctgaagggcctggtgcggcagctggagcgcttctctgtgcagcagcaggccagcaagatgccacccaagggcaagagcggcagcggcaaggccgggaaaggaggagctgccagcggcagtgacagcgctgacaagaaggcccagggccccaagggcggcggcaatgctgtgaaggtgcgccacatcctgtgtgagaagcacggcaagatcatggaggccatggagaagctgaagagcggcatgaggttcaatgaggtggccgcccagtacagcgaggacaaggcccggcagggcatccccagcctgcagcagcacgccggccaccaccgggacctgcggagcaccctcatcagcctggtgtcctacctgcagaccaccccctag

SEQ ID NO: 165802 - DNA, 1062 bp, Artificial Sequence
  Description of Artificial Sequence: Synthetic coding sequence
atggctgctgctgaggccgccaactgcatcatggaggtgtcctgtggccaggccgagagcagcgagaagcccaatgctgaggacatgaccagcaaggactactactttgacagctatgcccacttcggcatccacgaggagatgctgaaggatgaggtgaggaccctgacctacagaaattccatgttccacaacagacacctgttcaaggacaaggtggtgctggatgtgggcagcggcaccggcatcctgtgcatgtttgctgccaaggccggggccaggaaggtgattggaattgagtgcagcagcatcagtgactatgctgtgaagatcgtgaaggccaacaagctggaccacgtggtgaccatcatcaagggcaaggtggaggaggtggagctgcctgtggagaaggtggacatcatcatcagcgagtggatgggctactgcctcttctatgagagcatgctgaacacagtgctgtatgcccgggacaagtggctggccccagatggcctcatcttcccagaccgggccaccctgtatgtgacagccatcgaggaccggcagtacaaggactacaagatccactggtgggagaatgtgtatggctttgacatgagctgcatcaaggatgtggccatcaaggagcccctggtggatgtggtggaccccaagcagctggtgaccaatgcctgcctgatcaaggaggtggacatctacacagtgaaggtggaggacctgaccttcaccagccccttctgcctgcaggtgaagagaaatgactatgtgcacgccctggtggcctacttcaacatcgagttcacccgctgccacaagaggacaggcttcagcaccagccctgagagcccctacacccactggaagcagacagtgttctacatggaggactacctgactgtgaagacaggagaggagatcttcggcaccatcggcatgaggcccaatgccaagaacaacagagacctggacttcaccatcgacctggacttcaagggccagctgtgtgagctgagctgcagcacagactacaggatgaggtag

SEQ ID NO: 165803 - DNA, 882 bp, Artificial Sequence
  Description of Artificial Sequence: Synthetic coding sequence
atggtgggcgtggccgaggtgtcctgtggccaggccgagagcagcgagaagcccaatgctgaggacatgaccagcaaggactactactttgacagctatgcccacttcggcatccacgaggagatgctgaaggatgaggtgaggaccctgacctacagaaattccatgttccacaacagacacctgttcaaggacaaggtggtgctggatgtgggcagcggcaccggcatcctgtgcatgtttgctgccaaggccggggccaggaaggtgattggaattgagtgcagcagcatcagtgactatgctgtgaagatcgtgaaggccaacaagctggaccacgtggtgaccatcatcaagggcaaggtggaggaggtggagctgcctgtggagaaggtggacatcatcatcagcgagtggatgggctactgcctcttctatgagagcatgctgaacacagtgctgtatgcccgggacaagtggctggccccagatggcctcatcttcccagaccgggccaccctgtatgtgacagccatcgaggaccggcagtacaaggactacaagatccactggtgggagaatgtgtatggctttgacatgagctgcatcaaggatgtggccatcaaggagcccctggtggatgtggtggaccccaagcagctggtgaccaatgcctgcctgatcaaggtgcggggctgggcctggccaggggccccctgggtggagaccaaggagcggcccagccctggccctggcatgggcctgtggggccctgagtgctggccagaggtgtctgagccagacctgcctgcccggggcggggcccggggccctgggaagaccctgcggcccctgaacatctttgtgtctgctgctgtgtag

SEQ ID NO: 165804 - DNA, 1116 bp, Artificial Sequence
  Description of Artificial Sequence: Synthetic coding sequence
atggctgctgctgaggccgccaactgcatcatggagaactttgtggccaccctggccaacggcatgagcctgcagccccccctggaggaggtgtcctgtggccaggccgagagcagcgagaagcccaatgctgaggacatgaccagcaaggactactactttgacagctatgcccacttcggcatccacgaggagatgctgaaggatgaggtgaggaccctgacctacagaaattccatgttccacaacagacacctgttcaaggacaaggtggtgctggatgtgggcagcggcaccggcatcctgtgcatgtttgctgccaaggccggggccaggaaggtgattggaattgagtgcagcagcatcagtgactatgctgtgaagatcgtgaaggccaacaagctggaccacgtggtgaccatcatcaagggcaaggtggaggaggtggagctgcctgtggagaaggtggacatcatcatcagcgagtggatgggctactgcctcttctatgagagcatgctgaacacagtgctgtatgcccgggacaagtggctggccccagatggcctcatcttcccagaccgggccaccctgtatgtgacagccatcgaggaccggcagtacaaggactacaagatccactggtgggagaatgtgtatggctttgacatgagctgcatcaaggatgtggccatcaaggagcccctggtggatgtggtggaccccaagcagctggtgaccaatgcctgcctgatcaaggaggtggacatctacacagtgaaggtggaggacctgaccttcaccagccccttctgcctgcaggtgaagagaaatgactatgtgcacgccctggtggcctacttcaacatcgagttcacccgctgccacaagaggacaggcttcagcaccagccctgagagcccctacacccactggaagcagacagtgttctacatggaggactacctgactgtgaagacaggagaggagatcttcggcaccatcggcatgaggcccaatgccaagaacaacagagacctggacttcaccatcgacctggacttcaagggccagctgtgtgagctgagctgcagcacagactacaggatgaggtag

SEQ ID NO: 165805 - DNA, 483 bp, Artificial Sequence
  Description of Artificial Sequence: Synthetic coding sequence
atgaccagcaaggactactactttgacagctatgcccacttcggcatccacgaggagatgctgaaggatgaggtgaggaccctgacctacagaaattccatgttccacaacagacacctgttcaaggacaaggtggtgctggatgtgggcagcggcaccggcatcctgtgcatgtttgctgccaaggccggggccaggaaggtgattggaattgagtgcagcagcatcagtgactatgctgtgaagatcgtgaaggccaacaagctggaccacgtggtgaccatcatcaagggcaaggtggaggaggtggagctgcctgtggagaaggtggacatcatcatcagcgagtggatgggctactgcctcttctatgagagcatgctgaacacagtgctgtatgcccgggacaagtggctggccccagatggcctcatcttcccagaccgggccaccctgtatgtgacagccatcgaggacagatag

SEQ ID NO: 165806 - DNA, 618 bp, Artificial Sequence
  Description of Artificial Sequence: Synthetic coding sequence
atgaccagcaaggactactactttgacagctatgcccacttcggcatccacgaggagatgctgaaggatgaggtgaggaccctgacctacagaaattccatgttccacaacagacacctgttcaaggacaaggtggtgctggatgtgggcagcggcaccggcatcctgtgcatgtttgctgccaaggccggggccaggaaggtgattggaattgagtgcagcagcatcagtgactatgctgtgaagatcgtgaaggccaacaagctggaccacgtggtgaccatcatcaagggcaaggtggaggaggtggagctgcctgtggagaaggtggacatcatcatcagcgagtggatgggctactgcctcttctatgagagcatgctgaacacagtgctgtatgcccgggacaagtggctggccccagatggcctcatcttcccagaccgggccaccctgtatgtgacagccatcgaggaccggcagtacaaggactacaagatccactggtgggagaatgtgtatggctttgacatgagctgcatcaaggatgtggccatcaaggagcccctggtggatgtggtggaccccaagcagctggtgaccaatgcctgcctgtag

SEQ ID NO: 165807 - DNA, 483 bp, Artificial Sequence; identical to SEQ ID NO: 165805
  Description of Artificial Sequence: Synthetic coding sequence

SEQ ID NO: 165808 - DNA, 630 bp, Artificial Sequence
  Description of Artificial Sequence: Synthetic coding sequence
atgaccagcaaggactactactttgacagctatgcccacttcggcatccacgaggagatgctgaaggatgaggtgaggaccctgacctacagaaattccatgttccacaacagacacctgttcaaggacaaggtggtgctggatgtgggcagcggcaccggcatcctgtgcatgtttgctgccaaggccggggccaggaaggtgattggaattgagtgcagcagcatcagtgactatgctgtgaagatcgtgaaggccaacaagctggaccacgtggtgaccatcatcaagggcaaggtggaggaggtggagctgcctgtggagaaggtggacatcatcatcagcgagtggatgggctactgcctcttctatgagagcatgctgaacacagtgctgtatgcccgggacaagtggctggccccagatggcctcatcttcccagaccgggccaccctgtatgtgacagccatcgaggaccggcagtacaaggactacaagatccactggtgggagaatgtgtatggctttgacatgagctgcatcaaggatgtggccatcaaggagcccctggtggatgtggtggaccccaagcagctggtgaccaatgcctgcctgatcaaggtgaggtag

SEQ ID NO: 165809 - DNA, 687 bp, Artificial Sequence
  Description of Artificial Sequence: Synthetic coding sequence
atggccaccagcggggactgccccaggtctgagagccagggcgaggagccagcagaatgttctgaggccggcctgctgcaggagggcgtgcagcctgaggagtttgtggccatcgctgactatgctgccacagatgagacccagctgtccttcctgcggggggagaagatcctgatcctgcggcagaccacagctgactggtggtggggcgagagagctggctgctgcggctacatcccagccaaccacgtgggcaagcacgtggatgaatatgaccctgaggacacctggcaggatgaggagtacttcggcagctatggcaccctgaagctgcacctggagatgctggccgaccagcccaggaccaccaagtaccacagcgtcatcctgcagaacaaggagagcctgacagacaaggtgatcctggatgtgggctgcggcaccggcatcatcagcctcttctgtgcccactacgcccggcccagggctgtgtatgctgtggaggccagcgagatggcccagcacacaggccagctggtgctgcagaatggatttgctgacatcatcaccgtgtaccagcagaaggtggaggatgtggtgctgcctgagaaggtggatgtgctggtgtctgagtggatgggcacctgcctgctggtgggggagaaggtgttccccatctggaggtag

SEQ ID NO: 165810 - DNA, 855 bp, Artificial Sequence
  Description of Artificial Sequence: Synthetic coding sequence
atggccaccagcggggactgccccaggtctgagagccagggcgaggagccagcagaatgttctgaggccggcctgctgcaggagggcgtgcagcctgaggagtttgtggccatcgctgactatgctgccacagatgagacccagctgtccttcctgcggggggagaagatcctgatcctgcggcagaccacagctgactggtggtggggcgagagagctggctgctgcggctacatcccagccaaccacgtgggcaagcacgtggatgaatatgaccctgaggacacctggcaggatgaggagtacttcggcagctatggcaccctgaagctgcacctggagatgctggccgaccagcccaggaccaccaagtaccacagcgtcatcctgcagaacaaggagagcctgacagacaaggtgatcctggatgtgggctgcggcaccggcatcatcagcctcttctgtgcccactacgcccggcccagggctgtgtatgctgtggaggccagcgagatggcccagcacacaggccagctggtgctgcagaatggatttgctgacatcatcaccgtgtaccagcagaaggtggaggatgtggtgctgcctgagaaggtggatgtgctggtgtctgagtggatgggcacctgcctgctggccgcccccctgctgagctgccgcatcctgccctgcacctgtgccagcggccccctgcacgtgctgctggcctgctgcctgcccctgccctgcacctgtgcctctgtgcccctgcacgtgctgctggcctgctgcctgcctgtgctgcgggccccccagcccagcggcctgcacctgtcctggcccatcttcctgctgtag

SEQ ID NO: 165811 - DNA, 1302 bp, Artificial Sequence
  Description of Artificial Sequence: Synthetic coding sequence
atggccaccagcggggactgccccaggtctgagagccagggcgaggagccagcagaatgttctgaggccggcctgctgcaggagggcgtgcagcctgaggagtttgtggccatcgctgactatgctgccacagatgagacccagctgtccttcctgcggggggagaagatcctgatcctgcggcagaccacagctgactggtggtggggcgagagagctggctgctgcggctacatcccagccaaccacgtgggcaagcacgtggatgaatatgaccctgaggacacctggcaggatgaggagtacttcggcagctatggcaccctgaagctgcacctggagatgctggccgaccagcccaggaccaccaagtaccacagcgtcatcctgcagaacaaggagagcctgacagacaaggtgatcctggatgtgggctgcggcaccggcatcatcagcctcttctgtgcccactacgcccggcccagggctgtgtatgctgtggaggccagcgagatggcccagcacacaggccagctggtgctgcagaatggatttgctgacatcatcaccgtgtaccagcagaaggtggaggatgtggtgctgcctgagaaggtggatgtgctggtgtctgagtggatgggcacctgcctgctgtttgagttcatgattgagagcatcctgtatgccagagatgcctggctgaaggaggatggagtcatctggcccaccatggccgccctgcacctggtgccctgcagcgctgacaaggactaccgcagcaaggtgctcttctgggacaatgcctatgagttcaacctgagcgccctgaagagcctggccgtgaaggagttcttcagcaagcccaagtacaaccacatcctgaagccagaggactgcctgtctgagccctgcaccatcctgcagctggacatgaggacagtgcagatcagtgacctggagaccctgcggggggagctgcgctttgacatcaggaaggccggcaccctgcacggcttcaccgcctggttctctgtgcacttccagagcctgcaggagggccagcccccccaggtgctgagcacaggccccttccaccccaccacccactggaagcagaccctcttcatgatggatgatcctgtgcctgtgcacactggagatgtggtgacaggctctgtggtgctgcagagaaatcctgtgtggaggaggcacatgtctgtggccctgtcctgggccgtgaccagccggcaggaccccaccagccagaaggtgggggagaaggtgttccccatctggaggtag

SEQ ID NO: 165812 - DNA, 486 bp, Artificial Sequence
  Description of Artificial Sequence: Synthetic coding sequence
atgctggccgaccagcccaggaccaccaagtaccacagcgtcatcctgcagaacaaggagagcctgcgcatcaagagctcctggacctgggccgtgggcctgggcagctctgtgtcctctgtgcacaccatgaggggcctggagcgggtgtatgctgtggaggccagcgagatggcccagcacacaggccagctggtgctgcagaatggatttgctgacatcatcaccgtgtaccagcagaaggtggaggatgtggtgctgcctgagaaggtggatgtgctggtgtctgagtggatgggcacctgcctgctgtttgagttcatgattgagagcatcctgtatgccagagatgcctggctgaaggagaccggcagctttggccccccctggctgcgctgcaccctgtgcccagctgtgctgatccgcatcatcgtggcccgctgcagcagcggcaccaccaggaccagcagcaccagcgccctgtag

SEQ ID NO: 165813 - DNA, 1302 bp, Artificial Sequence; identical to SEQ ID NO: 165811
  Description of Artificial Sequence: Synthetic coding sequence

SEQ ID NO: 165814 - DNA, 1302 bp, Artificial Sequence; identical to SEQ ID NO: 165811
  Description of Artificial Sequence: Synthetic coding sequence

SEQ ID NO: 165815 - DNA, 996 bp, Artificial Sequence
  Description of Artificial Sequence: Synthetic coding sequence
atggccaccagcggggactgccccaggtctgagagccagggcgaggagccagcagaatgttctgaggccggcctgctgcaggagggcgtgcagcctgaggagtttgtggccatcgctgactatgctgccacagatgagacccagctgtccttcctgcggggggagaagatcctgatcctgcggcagaccacagctgactggtggtggggcgagagagctggctgctgcggctacatcccagccaaccacgtgggcaagcacgtggatgaatatgaccctgaggacacctggcaggatgaggagtacttcggcagctatggcaccctgaagctgcacctggagatgctggccgaccagcccaggaccaccaagtaccacagcgtcatcctgcagaacaaggagagcctgacagacaaggtgatcctggatgtgggctgcggcaccggcatcatcagcctcttctgtgcccactacgcccggcccagggctgtgtatgctgtggaggccagcgagatggcccagcacacaggccagctggtgctgcagaatggatttgctgacatcatcaccgtgtaccagcagaaggtggaggatgtggtgctgcctgagaaggtggatgtgctggtgtctgagtggatgggcacctgcctgctgaccctgcggggggagctgcgctttgacatcaggaaggccggcaccctgcacggcttcaccgcctggttctctgtgcacttccagagcctgcaggagggccagcccccccaggtgctgagcacaggccccttccaccccaccacccactggaagcagaccctcttcatgatggatgatcctgtgcctgtgcacactggagatgtggtgacaggctctgtggtgctgcagagaaatcctgtgtggaggaggcacatgtctgtggccctgtcctgggccgtgaccagccggcaggaccccaccagccagaaggtgggggagaaggtgttccccatctggaggtag

SEQ ID NO: 165816 - DNA, 870 bp, Artificial Sequence
  Description of Artificial Sequence: Synthetic coding sequence
atggccaccagcggggactgccccaggtctgagagccagggcgaggagccagcagaatgttctgaggccggcctgctgcaggagggcgtgcagcctgaggagtttgtggccatcgctgactatgctgccacagatgagacccagctgtccttcctgcggggggagaagatcctgatcctgcggcagaccacagctgactggtggtggggcgagagagctggctgctgcggctacatcccagccaaccacgtgggcaagcacgtggatgaatatgaccctgaggacacctggcaggatgaggagtacttcggcagctatggcaccctgaagctgcacctggagatgctggccgaccagcccaggaccaccaagtaccacagcgtcatcctgcagaacaaggagagcctgacagacaaggtgatcctggatgtgggctgcggcaccggcatcatcagcctcttctgtgcccactacgcccggcccagggctgtgtatgctgtggaggccagcgagatggcccagcacacaggccagctggtgctgcagaatggatttgctgacatcatcaccgtgtaccagcagaaggtggaggatgtggtgctgcctgagaaggtggatgtgctggtgtctgagtggatgggcacctgcctgctgtttgagttcatgattgagagcatcctgtatgccagagatgcctggctgaaggaggatggagtcatctggcccaccatggccgccctgcacctggtgccctgcagcgctgacaaggactaccgcagcaaggtgctcttctgggacaatgcctatgagttcaacctgagcgccctgaagctggagaagaagagcagccccagcggagatgacagctag

SEQ ID NO: 165817 - DNA, 906 bp, Artificial Sequence
  Description of Artificial Sequence: Synthetic coding sequence
atggccaccagcggggactgccccaggtctgagagccagggcgaggagccagcagaatgttctgaggccggcctgctgcaggagggcgtgcagcctgaggagtttgtggccatcgctgactatgctgccacagatgagacccagctgtccttcctgcggggggagaagatcctgatcctgcggcagaccacagctgactggtggtggggcgagagagctggctgctgcggctacatcccagccaaccacgtgggcaagcacgtggatgaatatgaccctgaggacacctggcaggatgaggagtacttcggcagctatggcaccctgaagctgcacctggagatgctggccgaccagcccaggaccaccaagtaccacagcgtcatcctgcagaacaaggagagcctgacagacaaggtgatcctggatgtgggctgcggcaccggcatcatcagcctcttctgtgcccactacgcccggcccagggctgtgtatgctgtggaggccagcgagatggcccagcacacaggccagctggtgctgcagaatggatttgctgacatcatcaccgtgtaccagcagaaggtggaggatgtggtgctgcctgagaaggtggatgtgctggtgtctgagtggatgggcacctgcctgctgcaccacaccctggaggctgatgctgtgcatgatggccggcccagcccctgcccctacagaagaagaggccacggcttcagctgtgtggccgagaagcccagcgtggagaaggcccacgtgtgtggcagcgagctgggctgccacttccagacccggccccacatcagcaagtcctggaggaagagcctgccccacctggagatgacagtggatgccctgtttgggaagcagtgtgcctacctggagggctag

SEQ ID NO: 165818 - DNA, 951 bp, Artificial Sequence
  Description of Artificial Sequence: Synthetic coding sequence
atgattgctgacagagtgaggacagatgcctaccgcctgggcatcctgaggaactgggccgccctgcggggcaagacagtgctggatgtgggcgccggcaccggcatcctgagcatcttctgtgcccaggccggggccaggagagtgtatgctgtggaggccagcgccatctggcagcaggcccgggaggtggtgcgcttcaacggcctggaggacagagtgcacgtgctgcccggccctgtggagaccgtggagctgcctgagcaggtggatgccatcgtgtctgagtggatgggctacggcctgctgcacgagagcatgctgagctctgtgctgcacgcccggaccaagtggctgaaggagggcggcctgctgctgcctgccagcgctgagctgttcatcgcccccatcagtgaccagatgctggagtggaggctgggcttctggagccaggtgaagcagcactacggcgtggacatgagctgcctggagggctttgccacccgctgcctgatgggccacagcgagatcgtggtgcagggcctgtctggagaagatgtgctggcccggccccagagatttgcccagctggagctgagccgggccggcctggagcaggagctggaggccggcgtgggcggccgcttccgctgcagctgctacggcagcgcccccatgcacggctttgccatctggttccaggtgaccttccctggaggagagagcgagaagcccctggtgctgagcaccagccccttccacccagccacccactggaagcaggccctgctgtacctgaatgaacctgtgcaggtggagcaggacacagatgtgtctggagagatcaccctgctgcccagccgggacaacccccggcggctgcgggtgctgctgcgctacaaggtgggggaccaggaggagaagaccaaggactttgccatggaggactag

SEQ ID NO: 165819 - DNA, 1128 bp, Artificial Sequence
  Description of Artificial Sequence: Synthetic coding sequence
atgagccagcccaagaagaggaagctggagagcggcggcggcggggagggcggggagggcacagaggaggaggatggagctgagcgggaggccgccctggagcggcccaggaggaccaagcgggagcgggaccagctgtactatgagtgctacagtgatgtgtctgtgcatgaggagatgattgctgacagagtgaggacagatgcctaccgcctgggcatcctgaggaactgggccgccctgcggggcaagacagtgctggatgtgggcgccggcaccggcatcctgagcatcttctgtgcccaggccggggcccggcgggtgtatgctgtggaggccagcgccatctggcagcaggcccgggaggtggtgcgcttcaacggcctggaggacagagtgcacgtgctgcccggccctgtggagaccgtggagctgcctgagcaggtggatgccatcgtgtctgagtggatgggctacggcctgctgcacgagagcatgctgagctctgtgctgcacgcccggaccaagtggctgaaggagggcggcctgctgctgcctgccagcgctgagctgttcatcgcccccatcagtgaccagatgctggagtggaggctgggcttctggagccaggtgaagcagcactatggagtggacatgagctgcctggagggctttgccacccgctgcctgatgggccacagcgagatcgtggtgcagggcctgagcggggaggatgtgctggcccggccccagagatttgcccagctggagctgagcagagctggcctggagcaggagctggaggccggcgtgggcggccgcttccgctgcagctgctacggcagcgcccccatgcacggctttgccatctggttccaggtgaccttccctggaggagagagcgagaagcccctggtgctgagcaccagccccttccacccagccacccactggaagcaggccctgctgtacctgaatgaacctgtgcaggtggagcaggacacagatgtgtctggagagatcaccctgctgcccagccgggacaacccccggcggctgcgggtgctgctgcgctacaaggtgggggaccaggaggagaagaccaaggactttgccatggaggactag

SEQ ID NO: 165820 - DNA, 936 bp, Artificial Sequence
  Description of Artificial Sequence: Synthetic coding sequence
atggcccggagcggccggcggccctggagcgaccccggcggcctgagcggggctgtgcagagagctgggggccctggggcccggcctgctggcaccagcggggactgccgggtggccggcactggaggctgccaccgggagcgggtggatggcctgcggaccccagcccgggtgcacgccgagctgcggcccccccgggccaaccaggtggccgagggcggccgcagcagccctgctggcctgcggcgggccctgcacagcccccaccagaggccagatgctggcatggcccctggcctgctggagcctggagaggccgccctgtggtgtggccacgagctgcccggcggcctgcggcatgccctgagccacggccccctgggggacagatgtgccggcatcgtgcggcggggccgggccggccctgctgctgccctgtgcagcgcccgggccctgccccggcggctgggcgctggggccggcggccgcagcggccgggccctgcccctgcagctgctgtggctgggcgcccacgcctggctgtgccacctggtgcctggggacctgccctggaggggcgtgggggagaccccaggagctgtgcacctggccttcagccctggccacagcctggagactggagcccccctgcctgagagagctggggccagcggggcccggcacggccgcttccggcgggaccacgccgccgccctgcccggccagccccccagccctgcccgggccgccgccctgcagagcggccggcctggaggagaggaccagaggctgtgccacggcggcctgtctgtggccttcagccccagctacctgcccaagcagcctgacctgcggggccggggcgtggcccggtctgagggcaagggccgcagccacgtgcaggtgggcggcatcagcccccccttccccagctag

SEQ ID NO: 165821 - DNA, 2532 bp, Artificial Sequence
  Description of Artificial Sequence: Synthetic coding sequence
atggccaagcccctgacagacagcgagaagaggaagcagatctctgtgcggggcctggccggcctgggagatgtggccgaggtgaggaagagcttcaacagacacctgcacttcaccctggtgaaggacagaaatgtggccaccccccgggactacttctttgccctggcccacacagtgcgggaccacctggtgggccgctggatccgcacccagcagcactactatgaaagagaccccaagaggatctactacctgagcctggagttctacatgggccgcaccctgcagaacaccatggtgaacctgggcctgcagaatgcctgtgatgaggccatctaccagctgggcctggacctggaggagctggaggagattgaggaggatgctggcctgggcaatggaggcctgggccgcctggccgcctgcttcctggacagcatggccaccctgggcctggccgcctacggctacggcatccgctatgaatttggcatcttcaaccagaagatcgtgaatggctggcaggtggaggaggctgatgactggctgcgctatggcaacccctgggagaaggcccggcctgagtacatgctgcctgtgcacttctacggccgggtggagcacaccccagatggagtgaagtggctggacacccaggtggtgctggccatgccctatgacacccctgtgcccggctacaagaacaacacagtgaacaccatgaggctgtggagcgccaaggccccaaatgacttcaagctgcaggacttcaacgtgggggactacatcgaggccgtgctggacaggaacctggccgagaacatcagccgggtgctgtacccaaatgacaacttctttgagggcaaggagctgcggctgaagcaggagtactttgtggtggccgccaccctgcaggacatcatccgccgcttcaagagcagcaagtttggctgccgggaccctgtgaggacctgctttgagaccttcccagacaaggtggccatccagctgaatgacacccacccagccctgagcatccctgagctgatgaggatcctggtggatgtggagaaggtggactgggacaaggcctgggagatcaccaagaagacctgtgcctacaccaaccacacagtgctgcctgaggccctggagcgctggcctgtgtccatgtttgagaagctgctgcccaggcacctggagatcatctatgccatcaaccagaggcacctggaccacgtggccgccctcttccctggagatgtggaccggctgcggaggatgtctgtcatcgaggagggggactgcaagaggatcaacatggcccacctgtgtgtgattggcagccatgctgtgaatggagtggcccgcatccacagcgagatcgtgaagcagagcgtcttcaaggacttctatgagctggagcctgagaagttccagaacaagaccaacggcatcaccccccggcgctggctgctgctgtgcaaccctggcctggccgacaccatcgtggagaagatcggggaggagttcctgacagacctgagccagctgaagaagctgctgcccctggtgtctgatgaggtgttcatcagagatgtggccaaggtgaagcaggagaacaagctgaagttcagcgccttcctggagaaggagtacaaggtgaagatcaaccccagctccatgtttgatgtgcacgtgaagaggatccacgagtacaagaggcagctgctgaactgcctgcacgtggtgaccctgtacaaccgcatcaagagggaccctgccaaggcctttgtgcccaggacagtgatgattggaggcaaggccgcccctggctaccacatggccaagctgatcatcaagctggtgaccagcattggagatgtggtgaaccacgaccctgtggtgggggaccggctgaaggtgatcttcctggagaactacagagtgtccctggccgagaaggtgatcccagctgctgacctgagccagcagatcagcacagctggaacagaggccagcggcactggaaacatgaagttcatgctgaatggagccctgaccatcggcaccatggatggagccaacgtggagatggccgaggaggccggggctgaaaatctcttcatcttcggcctgcgggtggaggatgtggaggccctggacaggaagggctacaatgcccgggagtactatgaccacctgcctgagctgaagcaggccgtggaccagatcagcagcggcttcttcagccccaaggagccagactgcttcaaggacatcgtgaacatgctgatgcaccacgaccgcttcaaggtgtttgctgactatgaggcctacatgcagtgccaggcccaggtggaccagctgtacagaaaccccaaggagtggaccaagaaggtgatccggaacatcgcctgcagcggcaagttcagcagtgacaggaccatcacagaatatgcccgggagatctggggcgtggagcccagcgacctgcagatccccccacccaacatcccccgggactag

SEQ ID NO: 165822 - DNA, 717 bp, Artificial Sequence
  Description of Artificial Sequence: Synthetic coding sequence
atgctgaccaccctgctgcccatcctgctgctgagcggctgggccttctgcagccaggatgccagtgatggcctgcagaggctgcacatgctgcagatctcctacttccgggacccctaccacgtgtggtaccagggcaatgccagcctgggcggccacctgacccacgtgctggagggccctgacaccaacaccaccatcatccagctgcagcccctgcaggagcctgagagctgggcccggacccagagcggcctgcagagctacctgctgcagttccacggcctggtgcggctggtgcaccaggagaggaccctggccttccccctgaccatccgctgcttcctgggctgtgagctgcccccagagggcagccgggcccacgtgttctttgaggtggccgtgaatggcagcagctttgtgtccttccggcctgagcgggccctgtggcaggccgacacccaggtgaccagcggcgtggtgaccttcaccctgcagcagctgaatgcctacaacagaaccaggtatgagctgcgggagttcctggaggacacctgtgtgcagtatgtgcagaagcacatctctgctgagaacaccaagggcagccagaccagccgcagctacaccagcctggtgctgggcgtgctggtgggcagcttcatcatcgccggcgtggccgtgggcatcttcctgtgcacaggaggccgccgctgctag

SEQ ID NO: 165823 - DNA, 4551 bp, Artificial Sequence
  Description of Artificial Sequence: Synthetic coding sequence
atggacaaccagcaggacaaggccatcgtggccagcgccaacggggagaacaccctcatcaatggagtgaaggaaaatgacagcgaggaccaggatgtggccatgaagagctttgctgccctggaggccgccgcccccatccagcccacccctgtggcccagaaggagaccctgatgtacccccggggcctgctgcccctgcccagcaagaagccctgcatgcagagcccccccagccccctgggcctcatcgaggcccctgagcacgccgccaacagcgcctctgtgaatgccatcagcctgaccagcggcatcgccaagggcctgaacacctggagcctgcccaatgaatgtgagaaggccccctttgccatcatggagcctgctggcatgtctgccctgaatggagactgcctgatgcagcccagcaggacctgcctgggctgcttcatggagagcaaggatgctgtggaccctgagcccggcatcagcctgaaggtgggggacctgaacagagattatgagacctgtgctgtgtctgacatcggcatccagtgcatcaatgctggggagaacatgaagtatggagagcagctgctgagtgaccagctgctgggcttccccctgcacaagagccgggccggggacagaagagaaacagagaagccagacatcgacctggaggaccctgcccagaagagctactatgaggccctgctgctggacaagtgcaacacagaggaggccctgctggccaacagcaaccaggactggggctactttgagaccttcatcagcgagagcaagattgagctgctggacctgtgcagcaagaatgagctgtctgtgaacctcttctctgaagaagatgtggacaactacatgtttgatgatgatgagagcaccctgggcagtgatgtgtgcagcctgaagatccgctatgagagcttccaggacaacgtgcgggacaagaccaccctgctgatgcaggaggatgcccagttcaacttcttccccagcgtcttcaccacctgccccaagcgggagagcaagagcggggccctgaagcagagcagtgacttcagccagttcaaggtgcctgatgtgtccatcatctggggcgaggaggacaagaacctggacaagaagaagggcaaggaggagggccaggaggacaagggcgtggagaagaaggatggcaaggacaatggagagaagccagccctgaacaagccctgcagcggcacagaggtggagcagctgaagaaccccaagcagggccacctggccaacagcctggagaccagcggcagcttcagtgatgacagcagcttcatcgagatctcctatgatgccatgggagagatcaaggactgcagccgctacatggcccgggacaccaacagcggcagcagcagcagccagcagaactacggcctgcgggccaagaggaaggtgcgctacagcgaggactacctgtatgatgtggacagcctggagggggagaaggtgaatgaaaggaaggagtggctgcctgtgggcagcaaggaggaggatgatgatgagtggtgccccaagaagaggaggaaggtgaccaggaaggagccccctgtgatcatcaagtacatcatcatcaaccgcttcaagggggagaagaacatgctggtgaagctgggcaaggtggatgccagcgagaccaccgtgaacctgtctgagaaccagctgaacaagtatgccaagctggcccccctgaagggcttctggcagaagaagaagaagcagaggaacaccaacacagacagcatcaagacccccttcagccagaagcagagctttgagcccggcagctttgaggtgtccttcctgcccccagccaggaagaggaagagcaagctgggcaacagacaccgcatccagaggatccccagcattgagatcagcgccagcagcaagcagatcagcctgtgcaatgaccagagacatgccagcaaccacaaggaggatggcggcctgaagggcaccctgaagagcgcccccctgggcgcccccagctgtgccaacggcagccacctgaatgacatcactggaccagattctgtgaaggtgaaggcccaggacacagagttcaagggccctgagaggaaggtgctgaacaagatcaagttcaagtctgaggcccggctgaagagcaagaaggtgaaggccgccggccaggagagcaagcccatcgtgcagatgagccccctgctggagaaccagagcagcaaggccaacctgaagaatgaagtcatccctggcaccagcaacagcagccggctgtctgagttccacgaggccaaggccgccaagagcagcaccttcctgcccaccacctgcagcagcgagatgcccctgagcagcgccaacgtgaccaccaacatccctgtgattcctgggggctacctgcagaccctgctggatgccagtgacctgagcaacaacaccagcatctcctacttcagccaccacagccctgagcagaatgaaggcagcctgacccagacagagaagagctttgtgcccctgcagcccacccaggactgtgtgctgaccagcagcagtgacagcgagctgcagcagagcagccacaacttcaagatggagagcagcaactacagaaatgtgtggcccaacaaggccaccagcggcacccaggagttcatggccgaggtgtcccgggagatcgcccccacccagagcagcgagtttggagccagccaggtggtgtccatggagaacaacctgacccccaccacctacaaccccatctgcctgaacagcggcggcagcaactgcaacaaggtgctgtatgacagcatgcaggacacccagctgcccagtgatgacagctaccagctgtgccacttcaacaatggagagatctgcttccccttccagcagggccctgtgaacatggatgatggccgcctcttctcctttgacagcatggcccccctgtctgtgagcagcagcaactactgcagcctgagcctgaagagctgtgagaaggatggagatgatgacatcacagatgacttcctggcccactgcagccccaagctggtgatccagcagagcattgatgaaattgcccccctgaaggagagcacagacctgctggacatcagcaacttcaccccagacaagttccgccacagcagcctgtctgagatgagccccccagacacccccagcctgagcccccagatcacccgctgtgagagcatgaagaccctgggcaccctgaagggcttccaggagggcgtgcccggccccctggacagcgtggagaagatcaagtgggactgcagcaccctgagccggcaggtgcagatggaggatggcttcaccctgaacaaccaccagttccagttccacatgtttaatgatgaggacagcgtgtccctgctgcagaagaacccctgcctgagcaccttcaatgaccccagcggccagatcagcaccaacaacaaggtgtccaagagcaggaagaagagcagccccagcaagagcggggccatgaaccagagcagcagccagaagaacaccaggaagaagagcctgaagggcaacaacaagggcatcgagaagcccccaggcaagaacagccggcaggtgcccaagagcaccaagaagggcaagtacatggccgccatcaatggagagaagatgcagattggaattggccggggcggcagccagaccaacaccatcagcagcacaggcaagaccctggccgagtgcatccagcacggcggccccatggcctccatgaagatgcccagccagaagggcctgagcggggactgggccctgggcaaggagagcagccctggctggagcgacatgtccatgggcaccaacaccaacagcctgctggatgatgaccagcgggagttccaggagcccagctacatcctgagcaacatcgccagcggcatggctgatgtgcagcgcttcatgatggccagcattgagcccctgtgggagcccatggagcaccacggggaccccaacatcttctacagccctgagagcaacagcctgaagctgaagaccctgaagatcctggccggcaccccccaggagagcaagaagaagatcaacagcggcagccagggcgccaccaagaaccacaggagcatcaagggcgtgtccaagagcaatggcaagacagccatcggggaccccggccgggccaacatgcctggctacaatgaagacagccgcagcaccttctttgacaagaagtacagcaacatgagcaccctgggcaacaacggccccacccacaagaagctgtaccgccacaagagcagcagcaaggccctgagagatgagaagtgcaagggcaagcacatggagcgggagcaggtgcacaaggatgaaagtggcacagccagctttgagaagctgcgggacagcgactacaacctgctgaaggccgagaccaccttctgggtgctgcctgtgtttgaggaggagacccgcatcttccagaaggacatctag

SEQ ID NO: 165824 - DNA, 1008 bp, Artificial Sequence
  Description of Artificial Sequence: Synthetic coding sequence
atgtgggccaccctgcccctgctgtgtgccggggcctggctgctgggcgtgcctgtgtgtggggctgctgagctgtgtgtgaacagcctggagaagttccacttcaagtcctggatgagcaagcacaggaagacctacagcacagaggagtaccaccaccggctgcagacctttgccagcaactggaggaagatcaatgcccacaacaacggcaaccacaccttcaagatggccctgaaccagttcagtgacatgagctttgctgagatcaagcacaagtacctgtggagcgagccccagaactgcagcgccaccaagagcaactacctgcggggcaccggcccctacccaccttctgtggactggaggaagaagggcaactttgtgtcccctgtgaagaaccagggcgcctgtggcagctgctggaccttcagcaccactggagccctggagagcgccatcgccatcgccaccgggaagatgctgagcctggccgagcagcagctggtggactgtgcccaggacttcaacaaccacggctgccagggcggcctgcccagccaggcctttgagtacatcctgtacaacaagggcatcatgggagaggacacctacccctaccagggcaaggatggctactgcaagttccagcccgggaaggccatcggctttgtgaaggatgtggccaacatcaccatctatgatgaggaggccatggtggaggccgtggccctgtacaaccctgtgtcctttgcctttgaggtgacccaggacttcatgatgtacagaacaggcatctacagcagcaccagctgccacaagaccccagacaaggtgaaccacgctgtgctggccgtgggctacggggagaagaatggcatcccctactggatcgtgaagaacagctggggcccccagtggggcatgaatggctacttcctgattgagcggggcaagaacatgtgtggcctggccgcctgtgccagctaccccatccccctggtgtag

SEQ ID NO: 165825 - DNA, 5655 bp, Artificial Sequence
  Description of Artificial Sequence: Synthetic coding sequence
atgcactgcaccaacccagccctgatcttcctgattgatgagctgagccctgagcagcacaacctgagcctgtacagcatggagctggtgctgaagaagagcacaggccacagcgctgcccaggtggccctgacagaaacagcccctggcagccagcacagcagccccctgcacgtgacagccccacccagcgccaccacctttgacacagccttcttcaaccagggcaagcagaccaagagcacagctgaccccagcatctttgtggccacctacgtgtctgtgaccagcaaggaggtggccgtgaatgatgatgagatggacaacttcctgcctgacacccactggaccacccccaggatggtgagccccatccagtacatcaccgtgagccccccaggcctgccccgggaggccctggagcccatgctgacccccagcctgcccatggtgtccctgcaggatgaggaggtgaccagcggctggcagaacaccacccggcagcctgctgcctatgcagagagcgccagccacttccacaccttccgcagcgccttccgcaccagcgagggcatcgtgcccaccccaggcaggaacctggtgctgtaccccacagatgcctacagccacctgagcagcaggaccctgcctgagatcgtggccagcctgacagagggcgtggagaccaccctcttcctgagcagccgcagcctgatgccccagcccctgggagatggcatcaccatccccctgcccagcctgggggaggtgtcccagcccccagaggaggtgtgggccaccagcgctgaccgctacacagatgtgaccaccgtgctgagccagagcctggaggagaccatcagccccaggacctaccccaccgtgacagccagccacgccgccctggccttcagcaggacccacagccccctgctgagcacccccctggcctttgccagcagcgccagccccacagatgtgagcagcaaccccttcctgcccagcgacagcagcaagaccagcgagctgcacagcaacagcgccctgcccggccctgtggacaacacccacatcctgagccctgtgagcagcttccggccctacacctggtgtgccgcctgcaccgtgcccagcccccagcaggtgctggccaccagcctgatggagaaggatgtgggcagcggagatggagctgagaccctgtgcatgacagtgctggaggagagcagcatcagcctgatgagctctgtggtggccgacttcagcgagtttgaggaggacccccaggtgttcaacaccctcttccccagccggcccatcgtgcccctgagcagccgctccatggagatcagcgagacctctgtgggcatctctgctgaggtggacatgagctctgtgaccaccacccaggtgcccccagcccacggccgcctgtctgtgcctgccagcctggaccccacagctggcagcctgtctgtggccgagacccaggtgacccccagctctgtgaccacagccttcttcagcgtcatcaccagcatcctgctggacagcagcttctctgtgattgccaacaagaacacccccagcctggccgtgcgggaccccagcgtcttcaccccctacagcctggtgcccagcgtggagagcagcctcttcagtgaccaggagaggagcagcttcagcgagcacaagcccaggggggccctggactttgccagcagcttcttcagcaccccacccctggagctgagcggcagcatcagcagccccagcgaggccccagccagcctgagcctgatgcccagcgacctgagccccttcaccagccagagcttcagccccctggtggagaccttcaccctgtttgacagcagtgacctgcagagcagccagctgagcctgcccagcagcaccaacctggagttcagccagctgcagcccagcagcgagctgcccctgaacaccatcatgctgctgcccagccgctctgaggtgagcccctggagcagcttccccagcgacagcctggagtttgtggaggccagcacagtgtccctgacagacagcgaggcccacttcaccagcgccttcatcgagaccaccagctacctggagagcagcctcatcagccatgagagcgctgtgacagccctggtgcccccaggcagcgagagctttgacatcctgacagctggcatccaggccaccagccccctgaccaccgtgcacaccacccccatcctgacagagagcagcctcttcagcaccctgaccccaccagatgaccagatcagcgccctggatggccacgtgtctgtgctggccagcttcagcaaggccatccccaccggcaccgtgctgatcacagatgcctacctgcccagcggcagcagctttgtgtctgaggccacccccttccccctgcccacagagctgactgtggtgggccccagcctgacccccacagaggtgcccctgaacaccagcacagaggtgtccaccaccagcactggagctgccaccggcggccccctggacagcaccctgatgggagatgctgccagccagagccccccagagagcagcgctgccccacccctgcccagcctgcggcctgtgacagccttcaccctggaggccaccgtggacacccccaccctggccacagccaagccaccctacgtgtgtgacatcaccgtgcctgatgcctacctgatcaccaccgtgctggccaggagagctgtgcaggagtacatcatcacagccatcaaggaggtgctgcgcatccacttcaacagagctgtggagctgaaggtgtatgagctgttcacagacttcaccttcctggtgaccagcggcccctttgtgtacacagccatcagcgtcatcaacgtgctgatcaacagcaagctggtgcgggaccagacccccctcatcctgtctgtgaagcccagcttcctggtgcctgagagccgcttccaggtgcagacagtgctgcagtttgtgccccccagcgtggacaccggcttctgcaacttcacccagagaattgagaagggcctgatgacagccctgtttgaggtgaggaagcaccaccagggcacctacaacctgactgtgcagatcctgaacatcaccatcagcagcagccgggtgaccccccggcggggccctgtgaacatcatctttgctgtgaagagcacccagggcttcctgaatggcagcgaggtgtctgagctgctgaggaacctgtctgtggtggagttctccttctacctgggctaccctgtgctgcagattgctgagcccttccagtacccccagctgaacctgagccagctgctgaagagctcctgggtgaggacagtgctgctgggcgtgatggagaagcagctgcagaatgaggtgttccaggccgagatggagaggaagctggcccagctgctgtctgaggtgtccaccaggaggaggatgtggaggcgggccaccgtggccgccggcaacagcgtggtgcaggtggtgaatgtgtcccggctggagggagatgacaaccctgtgcagctgatctactttgtggaggaccaggatggagagcggctgtctgctgtgaagagcagtgacctgatcaacaagatggacctgcagagagctgccatcatcctgggctaccgcatccagggcgtcatcgcccagcctgtggacagagtgaagaggcccagccctgagagccagagcaacaacctgtgggtgattgtgggcgtggtgattcctgtgctggtggtgatggtgattgtggtgatcctgtactggaagctgtgcaggacagacaagctggacttccagcctgacacagtggccaacatccagcagaggcagaagctgcagatccccagcgtgaagggctttgattttgccaagcagcacctgggccagcacaacaaggatgacatcctgatcatccacgagcccgcccccctgcccggccccctgaaggaccacaccacccccagtgaaaatggagatgtgcccagccccaagagcaagatccccagcaagaatgtgcgccaccggggccgggtgagccccagtgatgctgacagcacagtgtctgaggagagcagcgagagagatgctggggacaagaccccaggagctgtgaatgatggccgcagccaccgggccccccagagcggcccccccctgcccagcagtggaaatgagcagcacagcagcgccagcatctttgagcacgtggaccgcatcagcaggcctcctgaggccagccggcgggtgcccagcaagatccagctgattgccatgcagcccatcccagcccctcctgtgcagaggcccagccctgctgacagagtggccgagagcaacaagatcaacaaggagatccagacagccctgcggcacaagtcagaaattgagcaccacaggaacaagatccggctgcgggccaagagaagaggccactatgagttccctgtggtggatgacctgagcagcggggacaccaaggagcggcaccgggtgtaccgccgggcccagatgcagattgacaagatcctggaccccacagcctctgtgcccagcgtcttcatcgagcccaggaagagcagccgcatcaagaggagccccaagcccaggaggaagcaccaggtgaatggctgcccagcagatgctgagaaggacaggctcatcaccacagacagtgatggcacctacagaagacctcctggggtgcacaacagcgcctacatcggctgccccagcgaccctgacctgcctgcagatgtgcagacccccagctctgtggagctgggccgctacccagccctgcccttccctgccagccagtacatccccccccagcccagcattgaggaggcccggcagaccatgcacagcctgctggatgatgcctttgccctggtggcccccagcagccagcctgccagcacagctggggtgggccctggggtgcccccaggcctgcctgccaacagcacccccagccaggaggagcggcgggccacccagtggggcagcttctacagccctgcccagacagccaacaacccctgcagccgctatgaggactatggcatgaccccacccaccggccccctgccccggcccggcttcggccctggcctgctgcagagcacagagctggtgcccccagacccccagcagccccaggccagcgctgaggccccctttgctgcccggggcatctacagcgaggagatgcccagcgtggcccggcccaggcctgtgggcggcaccaccggcagccagatccagcacctgacccaggtgggcatcgccagcagaattggagcccagcctgtggagatcccccccagccggggcagccagtatggaggccctggctggcccagctatggagaagatgaagctggaagaagagaggccgtgcccaggaccagcggccgggagcccagcgcccccagcggcaacctgccccaccggggcctgcagggccctggcctgggctaccccaccagcagcacagaggacctgcagcccggccacagcagcgccagcctcatcaaggccatccgggaggagctgctgcggctgagccagaagcagagcacagtgcagaacttccacagctag

SEQ ID NO: 165826 - DNA, 1236 bp, Artificial Sequence
  Description of Artificial Sequence: Synthetic coding sequence
atggagaccccagaggtgcctgtgggcagcctgattgactttggacctgaggcccccaccagcagccccctggaggcccctcctcctgtgctgcaggatggagatggcagcctgggagatggagccagcgagagcgagaccacagagagcgctgacagtgaaaatgacatgggagagagccccagccaccccagctgggaccaggaccggcgcagcagcagcaatgaaagcttcagcagcaaccagagcacagagagcacccaggatgaggagaccctggccctgcgggacttcatgaggggctacgtggagaagatcttctctggaggagaggacctggaccaggaggagaaggccaagtttggagagtactgcagcagtgaaaatggcaagggccgggagtggtttgcccgctacgtgtctgcccagcgctgcaacagcaaatgtgtgtctgaggccaccttctaccgcctggtgcagagctttgctgtggtgctgtttgagtgccaccagatggatgactttggacctgccaagaacctgatgaccatgtgcttcacctactaccacatcggcaagccccagctgctgcccccagagagccgggagaagccagctggcagcattgacagctacctgaagagcgccaacagctggctggccgagaagaaggacattgctgagcggctgctgaagaacaccagcgccaggacagaaaatgtgaagggcttctttggaggcctggagaccaagctgaagggccccctggccaggagaaatgaggaggatgagaacaagccccaggagaagaggcccagggctgtgacagcctacagcccagaagatgagaagaagggggagaagatctacctgtacacccacctgaagcagcagcccatctggcacaccctgcgcttctggaatgctgccttctttgatgctgtgcactgtgagaggaccaagaggagccccaccaccagaggagatgctggggaggaggaggagaagcgggagaagtggtgccacatgacccaggaggagagagatgacagcctgcgcttcaatgaaaacatcaccttcggccagctgggcaccttcacccacaacatgctggccttcggcctgaacaagaagctgtgcaatgacttcctgaagaagcaggccgtcatcggcaacctggatgaggagcagtacaagctgctgagtgaccacatcgagcagatggccacagaatag

SEQ ID NO: 165827 - DNA, 15018 bp, Artificial Sequence
  Description of Artificial Sequence: Synthetic coding sequence
atggaccagaggaagaatgaaagcatcgtgcccagcatcacccagctggaggacttcctgacagagcacaacagcaatgtggtgtggctgctggtggccaccatcctgagctgtggctggatcatctacctgacctactacaacagcagaaatgtgggcctcatcctgaccctggtgctgaacagactctacaagcacggctacatccacatcggcagcttctccttctctgtgctgagcggcaaggtgatggtgcgggagatctactacatcacagaggacatgagcatccgcatccaggacggcttcatcatcttccgctggtggaagatgtacaaccccaagcagaagcagcacgaccccaaggccgagacccggctgtacatcaccgtgaatgactttgagttccacgtgtacaacagaagtgacctgtatggccgcctgcaggagctgtttggcctggagcccaccatcatcccccccaagaaggatgatgacaagacccgggagattggaagaaccaggacccagagcaagattgaaagagtgaaggtgaagacagagagccaggaccccaccagctcctggaggagcctcatccctgtgatcaaggtgaatgtgtccacaggccgcctggccttcggcaaccactaccagccccagaccctgtgcatcaactttgatgatgccttcctgacctacaccaccaagccacccagcagccacctggaccagttcatgcacatcgtgaagggcaagctggagaatgtgcgggtgatgctggtgcccagccccaggtatgtgggcctgcagaatgatgagcccccccggctgatgggagagggctttgtggtgatgcagagcaatgatgtggacatctactactacatggatgagcccggcctggtgcctgaggagacagaagaaaatattgaaggagagatgagcagcgaggactgcaagctgcaggacctgcccccctgctggggcctggacatcgtgtgtgggaaaggaacagacttcaactacggcccctgggccgaccggcagagggactgcctgtggaagttcttcttccccccagactaccaggtgctgaaggtgtctgaaattgcccagcccggccggccccggcagatcctggcctttgagctgaggatgaacatcatcgcagatgccaccatcgacctgctcttcaccaagaaccgggagaccaatgctgtgcacgtgaatgtgggcgccggcagctacctggagatcaacatccccatgacagtggaggagaatggctacaccccagccatcaagggccagctgctgcacgtggatgccaccacctccatgcagtaccgcaccctgctggaggccgagatgctggccttccacatcaatgccagctacccccgcatctggaacatgccccagacctggcagtgtgagctggaggtgtacaaggccacctaccacttcatctttgcccagaagaacttcttcacagacctgatccaggactggagcagtgacagccccccagacatcttctcctttgtgccctacacctggaacttcaagatcatgttccaccagtttgagatgatctgggccgccaaccagcacaactggattgactgcagcaccaagcagcaggagaatgtgtacctggccgcctgtggggagaccctgaacatcgacttcagcctgcccttcacagactttgtgcctgccacctgcaacaccaagttcagcctgcggggggaggatgtggacctgcacctgttcctgcctgactgccaccccagcaagtacagcctcttcatgctggtgaagaactgccaccccaacaagatgattcatgacaccggcatcccagctgagtgccagagcggccagaagacagtgaagcccaagtggagaaatgtgacccaggagaagagcggctgggtggagtgctggacagtgcccagcgtgatgctgaccatcgactacacctggcaccccatctacccccagaaggcagatgagcagctgaagcagagcctgtctgagatggaggagaccatgctgtctgtgctgcggcccagccagaagaccagtgacagagtggtgagcagccccagcaccagcagcaggcctcccatcgaccccagcgagctgcccccagacaagctgcacgtggagatggagctgagcccagacagccagatcaccctgtatggccccctgctgaatgccttcctgtgcatcaaggagaactactttggagaagatgacatgtacatggactttgaggaggtgatcagcagccctgtgctgagcctgagcaccagcagcagcagcggctggacagctgtgggcatggagaatgacaagaaggaaaatgaaggcagcgccaagagcatccaccccctggccctgcggccctgggacatcaccgtgctggtgaacctgtacaaggtgcacggccgcctgcctgtgcacggcaccacagatggcccagaatgtcccacagccttcctggagcggctgtgctttgagatgaagaagggcttccgggagaccatgctgcagctgatcctgagccccctgaatgtgtttgtgtctgacaactaccagcagaggcctcctgtggatgaggtgctgcgggagggccacatcaacctgagcggcctgcagctgcgggcccacgccatgttttctgctgagggcctgcccctgggcagtgacagcctggagtatgcctggctgattgatgtgcaggccggcagcctgacagccaaggtgacagccccccagctggcctgcctgctggagtggggccagacctttgtgttccacgtggtgtgccgggagtatgagctggagcggcccaagagcgtcatcatctgccagcacggcatcgaccggcgcttctgtgagagcaagctgagctgcatccctggcccctgccccaccagtgatgacctgaagtacaccatgatccggctggccgtggatggagctgacatctacatcgtggagcacggctgtgccaccaacatcaagatgggcgccatccgggtggccaactgcaacctgcacaaccagagcgtgggggagggcatctctgctgccatccaggacttccaggtgcggcagtacatcgagcagctgaacaactgcagaattggcctgcagcctgctgtgctgcggcgggcctactggctggaggccggcagcgccaacctgggcctcatcaccgtggacatcgccctggccgctgaccaccacagcaagcatgaggcccagaggcacttcctggagacccatgatgcccggaccaagaggctgtggttcctgtggccagatgacatcctgaagaacaagcgctgcaggaacaagtgtggctgcctgggcggctgccgcttcttcggcggcaccgtgacaggcctggacttcttcaagctggaggagctgacccccagcagcagcagcgccttcagcagcaccagcgctgagagtgacatgtactacggccagagcctgctgcagcctggagagtggatcatcaccaaggagatccccaagatcattgatggaaatgtgaatggcatgaagaggaaggagtgggagaacaagtctgtgggcatcgaggtggagaggaagacccagcacctgagcctgcaggtgcccctgcggagccacagcagcagcagcagcagcgaggagaacagcagcagcagcgctgcccagcccctgctggccggggagaaggagagccccagctctgtggctgatgaccacctggtgcagaaggagttcctgcacggcaccaagagagatgatggccaggccagcatccccacagagatcagcggcaacagccctgtgagccccaacacccaggacaagtctgtgggccagagccccctgcggagccccctgaagaggcaggcctctgtgtgcagcacccggctgggcagcaccaagagcctgacagctgccttctatggagacaagcagcctgtgacagtgggcgtgcagttcagcagtgatgtgtccagaagtgatgaaaatgtgctggacagccccaagcagaggaggagctttggcagcttcccctacacccccagcgctgacagcaacagcttccaccagtaccgctccatggacagctccatgtccatggctgacagcgaggcctacttctctgctgctgaggagtttgagcccatcagcagtgatgagggccctggcacctacccaggcaggaagaagaagaagaagcagacccagcagattgactacagccggggcagcatctaccacagcgtggagggccccctgaccggccacggggagagcatccaggacagcaggaccctgcccttcaagacccaccccagccaggccagctttgtgtctgccctgggcggggaggatgatgtgattgagcacctgtacatcgtggagggggagaagacagtggagagcgagcagatcaccccccagcagcctgtgatgaactgctaccagacctacctgacccagttccaggtgatcaactggagcgtgaagcaccccaccaacaagaggaccagcaagagcagcctgcaccggcccctggacctggacacccccaccagcgaggagagcagcagcagctttgagcagctgtctgtgcccaccttcaaggtgatcaagcagggcctgacagccaacagcctgctggaccggggcatgcagctgagcggcagcaccagcaacaccccctacacccccctggagaagaagctggccgacaacacagatgatgagaccctgacagaggagtggaccctggaccagcctgtgtcccagaccaggaccacagccatcgtggaggtgaagggcaccgtggacatcgtgctgacccccctggtggccgaggccctggaccgctacatcgaggccatggtgcactgtgccagcaccaggcaccctgctgccatcgtggatgacctgcacgccaaggtgctgcgggaggccgtgcagaacagcaagaccaccttcagcgagaacctgagcagcaagcaggacatccggggcaccaagacagagcagagcaccatcggcaccaccaaccagggccaggcccagaccaacctgaccatgaagcaggacaacgtgaccatcaagggcctgcagaccaacgtgtccatccccaaggtgaacctgtgcctgctgcaggcctctgtggaggagagccccaccacagcccccagccgctctgtgacccacgtgtccctggtggccctgtgctttgacagaattgccacccaggtgaggatgaacagaggagtggtggaggagaccagcaacaatgctgagcccggccgcaccagcaactttgaccgctacgtgcacgccaccaagatgcagccccagagcagcggcagcctgcggagcaatgctggagctgagaagggcaaggagattgctgccaagctgaacatccaccgggtgcacggccagctgcggggcctggacaccacagacatcggcacctgtgccatcacagccatcccctttgagaagagcaaggtgctcttcaccctggaggagctggatgagttcacctttgtggatgaaacagaccagcaggccgtgcctgatgtgaccagaattggccccagccaggagaagtggggctggatcatgtttgaatgtggcctggagaacctgaccatcaagggcggccggcagagcggggctgtgctgtacaacagctttggcatcatgggcaaggccagtgacacagagcggggcggcgtgctgaccagcaacaacagcagtgacagccccactggaagtggctacaacacagatgtgtctgatgacaacctgccctgtgacaggaccagccccagcagtgacctgaatggaaattctgtgtctgatgagcaggatgaaggagtggagagtgatgacctgaagaaggacctgcccctgatgcctcctcctccagacagctgcagcatgaagctgaccatcaaggagatctggttctcctttgctgcccccaccaacgtgcgcagccacacccacgccttcagccggcagctgaacctgctgagcacagccaccccagctgtgggcgcctggctggtgcccatcgaccagctgaagagcagcctgaacaagctggagacagagggcaccctgcgcatctgtgctgtgatgggctgcatcatgacagaggccctggagaacaagtctgtgcacttccccctgcggagcaagtacaaccggctgaccaaggtggcccgcttcctgcaggagaaccccagctgcctgctgtgcaacatcctgcaccactacctgcaccaggccaactacagcatcattgatgatgccaccatgtctgatggcctgcctgccctggtgaccctgaagaagggcctggtggccctggcccggcagtggatgaagttcatcgtggtgaccccagccttcaagggcgtgtccctgcacaggcctgcccagcccctgaagccccagatcgccatggaccatgaacatgaagatggcctgggcctggacaatggaggcggcctgcagagcgacaccagcgcagatggagctgagtttgaatttgatgctgccaccgtgtctgagcacaccatgctgctggagggcacagccaacagacctcctcctggcagcagcggccctgtgactggagctgagatcatgaggaagctgagcaagacccacacccacagcgacagcgccctgaagatcaagggcatccacccctaccacagcctgagctacaccagcggggacacagccacagacagccctgtgcacgtgggccgggccggcatgcctgtgaaggacagccccaggaaggagagcctgctgagctacctgaccggcagcttccccagcctgcacaacctgctggagggcaccccccagaggagcagcgctgctgtgaagagcagcagcctgaccaggactggaaacacagtggccacagacatgctgtctgagcaccccctgctgtctgagcccagctctgtgtccttctacaactggatgagcaatgctgtgggcaacagaggctctgtgctgcaggagagccctgtgaccaagagcggccacaacagcctgcccaccggggtggcccccaacctgcccaccatccccagcgccagtgacttcaacacagtgctgagcagtgaccagaacaccctggatggcacccacagccagcacagcaccagccaggatgatgtggccggcgtggaggaggccaaccagggcttccctgctgtgcagctggctgatgcccaggtggtgttcaagcccctgctgagccacacaggcatccagagccaggacaccatgcccttctgctacaggatgtactttggagagcacctgtccttcagcggcaccctggactgcctgcgggctgacatcgtggacagcgacacagccaaggagaggaagggcaagagggcccggcggcagggccacgtgaacctgccccccctggagttcaagccagccctgatgctgggcaccttcagcatctctgctgtggtgatggagaagtctgtgtgcaccccccagaacagcaccagcgccctgtccttccatgacctgagcaagcgctactacaacaccttccactgcaacttcaccatcagctgccagagcatcagccagcacgtggacatggccctggtgcggctcatccaccagttcagcaccatgattgatgacatcaaggccacccagacagacatcaagctgagccgctacacagctggcagcgccagccccacccccaccttcaagaccaggaagcaccgggacttccgcagcagtgacttcagccgcagcagccggggcagcctgaatggaggcaacagagtgaacaatgccaagaacaagaggaccaacaatgaaaacaacaagaaggagagcaggaacaagaacagcctgggccgctcagaaagaaggaccagcaaggtgtccaggaagggcagcaaggatgtggtggaccacatgaccatccacatggatgacagcgacagcatcaccgtgtctgagcagagcgagcccagcgctgagtgctggcagaacatgtacaagctgctgaacttctacagcctcatcagtgaccccaccggcatcctggagaagagcagcgagaccttcggccctgctggggtgcgcagccccacagagcccacctgcaaggtggtgtttgaaaatgagcaggacaacagcagcctgaccaagacccagaggaagaggagcctggtgaccagcgagccccagcacgtgaccctcatcgtgtttggcatcggcatggtgaacagaacccacctggaggccgacatcggcggcctgaccatggagagcgagctgaagagaattcatggcagcttcaccctgaaggagaagatgaaggatgtgctgcaccagaagatgacagagacctgtgccacagcccacatcggcggcgtgaacatcgtgctgctggagggcatcacccccaacatccagctggaggacttccccaccagccccaccagcacagccaagcaggagttcctgactgtggtgaagtgcagcatcgccaagagccaggccctgtacagcgcccagaggggcctgaagaccaacaatgctgctgtgttcaaggtgggcgccatcagcatcaacatcccccagcacccagccaccctgcacagcatgatggtgcgcagcagccaccagctgagcaagcagatcagtgacctgatccggcagcccagcacagccccccagcctgtgaaggaggacatcgccacccccctgcccagcgagaagacccccacctctgtgaaccagacccctgtggagaccaatgagttcccccagctgcctgagggcctggagaagaagcccatcgtgctgaagttcagcgccatgctggatggcatcgccatcggggccgccctgctgcccagcctgaaggccgagtacaagatgggccgcatgaggagccacggcatgaccggggcccagacccgcttcacctttgagctgcccaaccaccggctgcgcttcaccagcaaggtgtctgccacagacatgagcaccatcccccccagcgccagcctgaacctgccccctgtgaccatgtctgggaagtacatcatggaggagcatgacagctacagcgaccaggtgtggagcattgatgagctgcccagcaagcagggctactacctgcagggcaactacctgcgctgtgtggccgaggtgggcagctttgagcacaacctgaccacagacctgctgaaccacctggtgtttgtgcagaaggtgttcatgaaggaggtgaatgaggtgatccagaaggtgtctggaggagagcagcccatccccctgtggaatgaacatgatggaacagcagatggagacaagcccaagatcctgctgtacagcctgaacctgcagttcaagggcatccaggtgacagccaccacccccagcatgagagctgtgcgctttgagaccggcctgattgagctggagctgagcaaccggctgcagaccaaggccagccctggcagcagcagctacctgaagctgtttgggaagtgccaggtggacctgaacctggccctgggccagatcgtgaagcaccaggtgtatgaggaggccggcagtgacttccaccaggtggcctacttcaagaccagaattggcctgagaaatgccctgcgggaggagatcagcggcagcagtgaccgggaggccgtgctgatcaccctgaaccggcccatcgtgtatgcccagcctgtggcctttgacagagctgtgctcttctggctgaactacaaggccgcctatgacaactggaatgagcagaggatggccctgcacaaggacatccacatggccaccaaggaggtggtggacatgctgcccggcatccagcagaccagcgcccaggccttcggcaccctcttcctgcagctgactgtgaatgacctgggcatctgcctgcccatcaccaacacagcccagagcaaccacactggagacctggacaccggcagcgccctggtgctgaccatcgagagcaccctcatcacagcctgcagcagcgagagcctggtgtccaagggccacttcaagaacttctgcatccgctttgctgatggctttgagacctcctgggatgactggaagccagagatccacggggacctggtgatgaatgcctgtgtggtgcctgatggcacctatgaggtgtgcagcaggaccaccggccaggccgctgctgagagcagcagcgctggcacctggaccctgaatgtgctgtggaagatgtgtggcattgatgtgcacatggaccccaacatcggcaagaggctgaatgccctgggcaacaccctgaccaccctgactggagaggaggacattgatgacattgctgacctgaacagcgtgaacattgctgacctgagtgatgaagatgaggtggacaccatgagccccaccatccacacagaggccacagactaccgccggcaggccgccagcgccagccagcccggggagctgcggggcaggaagatcatgaagagaattgtggacatccgggagctgaatgagcaggccaaggtgattgatgacctgaagaagctgggcgccagcgagggcaccatcaaccaggagatccagcgctaccagcagctggagagcgtggccgtgaatgacatcagaagagatgtgaggaagaagctgcggcgcagctccatgagagctgccagcctgaaggacaagtggggcctgagctacaagcccagctacagccgcagcaagagcatcagcgccagcggccggccccccctgaagaggatggagcgggccagcagccgggtgggggagacagaggagctgcctgagatccgggtggatgctgccagccctggcccccgggtgaccttcaacatccaggacaccttccctgaggagacagagctggacctgctgtctgtgaccatcgagggccccagccactacagcagcaacagcgagggcagctgcagcgtcttcagcagccccaagacccctgggggcttcagccctggcatccccttccagacagaggagggcagaagagatgacagcctgagcagcaccagtgaagattctgagaaggatgagaaggatgaggaccacgagcgggagcgcttctacatctacaggaagcccagccacaccagcaggaagaaggccaccggctttgctgctgtgcaccagctgttcacagagcgctggcccaccacccctgtgaacagaagcctgtctggaacagccacagaaagaaatattgactttgagctggacatccgggtggagattgattctggaaaatgtgtgctgcaccccaccaccctgctgcaggagcatgatgacatcagcctgcggcgctcctatgacaggagcagccgcagcctggaccaggacagccccagcaagaagaagaagttccagaccaactatgccagcaccacccacctgatgaccgggaagaaggtgcccagcagcctgcagaccaagcccagcgacctggagaccaccgtcttctacatccctggggtggatgtgaagctgcactacaacagcaagaccctgaagacagagagccccaatgccagccggggcagcagcctgcccaggaccctgagcaaggagagcaagctgtatggcatgaaggacagcgccaccagcccccccagcccccccctgcccagcacagtgcagagcaagaccaacaccctgctgcccccccagcccccacccatcccagctgccaagggcaaaggaagtggaggagtgaagacagccaagctgtatgcctgggtggccctgcagagcctgcctgaggagatggtgatcagcccctgcctgctggacttcctggagaaggccctggagaccatccccatcacccctgtggagaggaactacacagctgtgagcagccaggatgaggacatgggccactttgagatcccagaccccatggaggagagcaccaccagcctggtgagcagcagcaccagcgcctacagcagcttccctgtggatgtggtggtgtatgtgcgggtgcagcccagccagatcaagttcagctgcctgcctgtgtcccgggtggagtgcatgctgaagctgcccagcctggacctggtgttcagcagcaacagaggagagctggagaccctgggcaccacctacccagctgagaccctgagccctggaggaaatgccacccagagcggcaccaagaccagcgccagcaagacaggcatccctggcagcagcggcctgggcagccccctgggccgcagccgccacagcagcagccagagcgacctgaccagcagcagcagcagcagcagcggcctgtccttcaccgcctgcatgtctgacttcagcctgtatgtgttccacccctatggagctgggaagcagaagacagctgtgtctggcctgaccccaggcagcggcggcctgggcaatgtggatgaggagcccacctctgtgactggaaggaaggacagcctgagcatcaacctggagtttgtgaaggtgtccctgagccgcatccgccgcagcggcggggccagcttctttgagagccagagcgtgtccaagagcgccagcaagatggacaccaccctcatcaacatctctgctgtgtgtgacatcggcagcgccagcttcaagtatgacatgaggcggctgtctgagatcctggccttcccccgggcctggtacagaagaagcatcgcccggcggctcttcctgggggaccagaccatcaacctgcccaccagcggccctggcaccccagacagcattgagggcgtgtcccagcacctgagccctgagagcagcaggaaggcctactgcaagacctgggagcagcccagccagagcgccagcttcacccacatgccccagagccccaacgtgttcaatgagcacatgaccaacagcaccatgagccctggcaccgtgggccagagcctgaagagccctgccagcatccgcagccgctctgtgtctgacagctctgtgccccggcgggacagcctgagcaagaccagcacccccttcaacaagagcaacaaggccgccagccagcagggcaccccctgggagaccctggtggtgtttgccatcaacctgaagcagctgaatgtgcagatgaacatgagcaatgtgatgggcaacaccacctggaccaccagcggcctgaagagccagggccgcctgtctgtgggcagcaacagagaccgggagatctccatgtctgtgggcctgggccgcagccagctggacagcaaaggaggagtggtgggcggcaccattgatgtgaatgccctggagatggtggcccacatcagcgagcaccccaaccagcagcccagccacaagatccagatcaccatgggcagcacagaggcccgggtggactacatgggcagcagcatcctgatgggcatcttcagcaatgctgacctgaagctgcaggatgagtggaaggtgaacctgtacaacaccctggacagcagcatcacagacaagtctgagatctttgtgcatggagacctgaagtgggacatcttccaggtgatgatcagccgcagcaccaccccagacctgatcaagattggcatgaagctgcaggagttcttcacccagcagtttgacaccagcaagagggccctgagcacctggggccctgtgccctacctgccccccaagaccatgaccagcaacctggagaagagcagccaggagcagctgctggatgctgcccaccaccgccactggccaggagtgctgaaggtggtgtctggctgccacatcagcctcttccagatccccctgcctgaagatggcatgcagtttggaggctccatgagcctgcacggcaaccacatgaccctggcctgcttccacggccccaacttccgcagcaagtcctgggccctcttccacctggaggagcccaacatcgccttctggacagaggcccagaagatctgggaggatggcagcagtgaccacagcacctacatcgtgcagaccctggacttccacctgggccacaacaccatggtgaccaagccctgtggggccctggagagccccatggccaccatcaccaagatcaccaggagaagacatgagaaccccccccacggcgtggcctctgtgaaggagtggttcaactacgtgacagccaccagaaatgaggagctgaacctgctgagaaatgtggatgccaacaacacagagaacagcaccaccgtgaagaacagcagcctgctgagcggcttccggggcggcagcagctacaaccacgagacagagaccatctttgccctgcccaggatgcagctggacttcaagagcatccacgtgcaggagccccaggagcccagcctgcaggatgccagcctgaagcccaaggtggagtgcagcgtggtgacagagttcacagaccacatctgtgtgaccatggatgctgagctgatcatgttcctgcatgacctggtgtctgcctacctgaaggagaaggagaaggccatcttccccccacgcatcctgagcacccggcccggccagaagagccccatcatcatccatgatgacaacagcagtgacaaggacagagaagattccatcacctacaccaccgtggactggagggacttcatgtgcaacacctggcacctggagcccaccctgcggctcatctcctggacaggcaggaagattgatcctgtgggcgtggactacatcctgcagaagctgggcttccaccacgcccggaccaccatccccaagtggctgcagaggggcgtgatggaccccctggacaaggtgctgtctgtgctgatcaagaagctgggcacagccctgcaggatgagaaggagaagaagggcaaggacaaggaggagcactag

SEQ ID NO: 165828 - DNA, 1287 bp, Artificial Sequence
  Description of Artificial Sequence: Synthetic coding sequence
atgggcggcctcttcagccgctggaggaccaagcccagcacagtggaggtgctggagagcattgacaaggagatccaggccctggaggagttccgggagaagaaccagaggctgcagaagctgtgggtgggccgcctcatcctgtacagctctgtgctgtacctgttcacctgcctgattgtgtacctgtggtacctgcctgatgagttcaccgcccggctggccatgaccctgcccttctttgccttccccctcatcatctggagcatccgcaccgtcatcatcttcttcttcagcaagaggacagagaggaacaatgaggccctggatgacctgaagagccagaggaagaagatcctggaggaggtgatggagaaggagacctacaagacagccaagctgatcctggagagatttgatcctgacagcaagaaggccaaggaatgtgagcccccatctgctggagctgctgtgacagcccggcccggccaggagatccggcagaggacagctgcccagaggaacctgagccccaccccagccagccccaaccagggccccccaccccaggtgcctgtgtccccaggcccccccaaggacagcagcgcccctgggggccccccagagaggacagtgaccccagccctgagcagcaatgtgctgcccaggcacctgggcagccctgccacctctgtgcccggcatgggcctgcaccccccaggcccccccctggcccggcccatcctgccccgggagcggggggccctggacagaattgtggagtacctggtgggagatggcccccagaacagatatgccctgatctgccagcagtgcttcagccacaacggcatggccctgaaggaggagtttgagtacatcgccttccgctgtgcctactgcttcttcctgaacccagccaggaagacccggccccaggccccccggctgcctgagttctcctttgagaagaggcaggtggtggagggcagcagctctgtgggccccctgcccagcggctctgtgctgagcagtgacaaccagttcaatgaggagagcctggagcatgatgtgctggatgacaacacagagcagacagatgacaagatcccagccacagagcagaccaaccaggtgattgagaaggccagtgacagcgaggagcctgaggagaagcaggagacagaaaatgaggaggcctctgtgattgagaccaacagcacagtgcctggagctgacagcatcccagaccctgagctgtctggagagagcctgacagctgagtag

SEQ ID NO: 165829 - DNA, 2718 bp, Artificial Sequence
  Description of Artificial Sequence: Synthetic coding sequence
atggacagcacagcctgcctgaagagcctgctgctgactgtgtcccagtacaaggctgtgaagtctgaggccaatgccacccagctgctgcggcacctggaggtgatcagcggccagaagctgaccaggctcttcaccagcaaccagatcctgaccagcgagtgcctgagctgcctggtggagctgctggaggaccccaacatcagcgccagcctcatcctgagcatcatcggcctgctgagccagctggccgtggacatcgagacccgggactgcctgcagaacacctacaacctgaacagcgtgctggccggcgtggtgtgccgcagcagccacacagattctgtgttcctgcagtgcatccagctgctgcagaagctgacctacaacgtgaagatcttctacagcggggccaacattgatgagctgatcaccttcctgattgaccacatccagagcagtgaagatgagctgaagatgccctgcctgggcctgctggccaacctgtgccgccacaacctgtctgtgcagacccacatcaagaccctgagcaatgtgaagagcttctaccgcaccctcatcaccctgctggcccacagcagcctgactgtggtggtgtttgccctgagcatcctgagcagcctgaccctgaatgaggaggtgggggagaagctgttccacgccaggaacatccaccagaccttccagctgatcttcaacatcctgatcaatggagatggcaccctgaccaggaagtacagcgtggacctgctgatggacctgctgaagaaccccaagattgctgactacctgaccaggtatgagcacttcagcagctgcctgcaccaggtgctgggcctgctgaatggcaaggaccctgacagcagcagcaaggtgctggagctgctgctggccttctgcagcgtgacccagctgcggcacatgctgacccagatgatgtttgagcagagccccccaggcagcgccaccctgggcagccacaccaagtgcctggagcccaccgtggccctgctgcgctggctgagccagcccctggatggcagcgagaactgcagcgtgctggccctggagctgttcaaggagatctttgaagatgtgattgatgctgccaactgcagcagcgctgacagatttgtgaccctgctgctgcccaccatcctggaccagctgcagttcacagagcagaacctggatgaggccctgaccaggaagaagtgtgagcgcatcgccaaggccatcgaggtgctgctgaccctgtgtggagatgacaccctgaagatgcacatcgccaagatcctgaccaccgtgaagtgcaccaccctgattgagcagcagttcacctacggcaagattgacctgggcttcggcaccaaggtggccgacagcgagctgtgcaagctggccgcagatgtgatcctgaagaccctggacctgatcaacaagctgaagcccctggtgcccggcatggaggtgtccttctacaagatcctgcaggaccccaggctcatcacccccctggcctttgccctgaccagtgacaaccgggagcaggtgcagagcggcctgcgcatcctgctggaggccgcccccctgcctgacttccctgccctggtgctgggggagagcattgctgccaacaatgcctaccggcagcaggagacagagcacatccccaggaagatgccctggcagagcagcaaccacagcttccccaccagcatcaagtgcctgaccccccacctgaaggatggagtgcccggcctgaacatcgaggagctgattgagaagctgcagagcggcatggtggtgaaggaccagatctgtgatgtgcgcatcagtgacatcatggatgtgtatgagatgaagctgagcaccctggccagcaaggagagccggctgcaggacctgctggagaccaaggccctggccctggcccaggccgacaggctcatcgcccagcaccgctgccagaggacccaggccgagacagaggcccggaccctggcctccatgctgcgggaggtggagaggaagaatgaggagctgtctgtgctgctgaaggcccagcaggtggagagcgagcgggcccagagcgacatcgagcacctgttccagcacaacaggaagctggagagcgtggccgaggagcacgagatcctgaccaagagctacatggagctgctgcagagaaatgaaagcacagagaagaagaacaaggacctgcagatcacctgtgacagcctgaacaagcagattgaaacagtgaagaagctgaatgaaagcctgaaggagcagaatgagaagagcatcgcccagctgattgagaaggaggagcagaggaaggaggtgcagaaccagctggtggaccgggagcacaagctggccaacctgcaccagaagaccaaggtgcaggaggagaagatcaagaccctgcagaaggagcgggaggacaaggaggagaccatcgacatcctgaggaaggagctgagcaggacagagcagatcaggaaggagctgagcatcaaggccagcagcctggaggtgcagaaggcccagctggagggccgcctggaggagaaggagagcctggtgaagctgcagcaggaggagctgaacaagcacagccacatgattgccatgatccacagcctgagcggcggcaagatcaaccctgagaccgtgaacctgagcatctag

SEQ ID NO: 165830 - DNA, 2370 bp, Artificial Sequence
  Description of Artificial Sequence: Synthetic coding sequence
atgctggagggcaactaccaggtgatgctgaagagcggcaccaacatcctgtactggaggaccaccggcatcctgatgggcagcaaggctgtgaagcctgtgctggtgaagaacatcaccattgaaggagtggcctacaccagcgagtgcttcccctgcaagccaggcaccttcagcaacaagccaggcagcttcaactgccaggtgtgccccaggaacacctacagcgagaagggggccaaggagtgcatccgctgcaaggatgacagccagttcagcgaggagggcagcagtgaatgtacagagcggcccccctgcaccaccaaggactacttccagatccacaccccctgtgatgaggagggcaagacccagatcatgtacaagtggattgagcccaagatctgccgggaggacctgacagatgccatccggctgcccccatctggagagaagaaggactgccccccctgcaaccctggcttctacaacaacggcagcagcagctgccacccctgccccccaggcaccttcagtgatggcaccaaggagtgccggccctgcccagctggaacagagcccgccctgggctttgagtacaagtggtggaatgtgctgcccggcaacatgaagaccagctgcttcaacgtgggcaacagcaaatgtgatggcatgaatggctgggaggtggccggggaccacatccagagcggggccggcggcagtgacaatgactacctgatcctgaacctgcacatccctggcttcaagccacccacctccatgactggagccaccggcagcgagctgggccgcatcacctttgtgtttgagaccctgtgcagcgctgactgtgtgctgtacttcatggtggacatcaacaggaagagcaccaacgtggtggagagctggggcggcaccaaggagaagcaggcctacacccacatcatcttcaagaatgccaccttcaccttcacctgggccttccagaggaccaaccagggccaggacaacagacgcttcatcaatgacatggtgaagatctacagcatcacagccaccaatgctgtggatggagtggccagcagctgccgggcctgtgccctgggcagcgagcagagcggcagcagctgtgtgccctgccccccaggccactacatcgagaaggagaccaaccagtgcaaggagtgccccccagacacctacctgagcatccaccaggtgtatggcaaggaggcctgcatcccctgtggccctggcagcaagaacaaccaggaccacagcgtgtgctacagcgactgcttcttctaccacgagaaggagaaccagagcctgcactatgacttcagcaacctgagctctgtgggcagcctgatgaatggccccagcttcaccagcaagggcaccaagtacttccacttcttcaacatcagcctgtgtggccacgagggcaagaagatggccctgtgcaccaacaacatcacagacttcaccgtgaaggagatcgtggccggcagtgatgactacaccaacctggtgggcgcctttgtgtgccagagcaccatcatccccagcgagagcaagggcttccgggccgccctgagcagccagagcatcatcctggccgacaccttcatcggcgtgacagtggagaccaccctgaagaacatcaacatcaaggaggacatgtttcctgtgcccaccagccagatcccagatgtgcacttcttctacaagagcagcacagccaccaccagctgcatcaatggccgcagcacagctgtgaagatgcgctgcaaccccaccaagagcggggccggggtcatctctgtgcccagcaagtgcccagctggcacctgtgatggctgcaccttctacttcctgtgggagagcgctgaggcctgccccctgtgcacagaacatgacttccacgagattgagggcgcctgcaagaggggcttccaggagaccctgtatgtgtggaatgagcccaagtggtgcatcaagggcatcagcctgcctgagaagaagctggccacctgtgaaacagtggacttctggctgaaggtgggcgctggggtgggcgccttcaccgctgtgctgctggtggccctgacctgctacttctggaagaagaaccagaagctggagtacaagtacagcaagctggtgatgaccaccaacagcaaagaatgtgagctgcctgctgctgacagctgtgccatcatggagggggaggacaatgaggaggaggtggtgtacagcaacaagcagagcctgctgggcaagctgaagagcctggccaccaaggagaaggaggaccactttgagagcgtgcagctgaagaccagccgcagccccaacatctag

SEQ ID NO: 165831 - DNA, 336 bp, Artificial Sequence
  Description of Artificial Sequence: Synthetic coding sequence
atggtgaggaccaaggctgacagcgtgcccggcacctacaggaaggtggtggccgcccgggcccccaggaaggtgctgggcagcagcaccagcgccaccaacagcacctctgtgagcagcaggaaggccgagaacaagtatgctgggggcaaccctgtgtgtgtgcggcccacccccaagtggcagaagggcattggagagttcttccggctgagccccaaggacagcgagaaggagaaccagatccctgaggaggccggcagcagcggcctgggcaaggccaagaggaaggcctgccccctgcagcctgaccacaccaatgatgagaaggagtag

SEQ ID NO: 165832 - DNA, 2772 bp, Artificial Sequence
  Description of Artificial Sequence: Synthetic coding sequence
atgagccagttcaagaggcagaggatcaaccccctgcccggcggcaggaacttctctggaacagccagcaccagcctgctgggccccccacctggcctgctgaccccacctgtggccacagagctgagccagaatgcccggcacctgcagggcggggagaagcagagggtcttcaccggcatcgtgaccagcctgcatgactactttggagtggtggatgaggaggtgttcttccagctgtctgtggtgaagggccgcctgccccagctgggggagaaggtgctggtgaaggccgcctacaaccctggccaggccgtgccctggaatgctgtgaaggtgcagaccctgagcaaccagcccctgctgaagagccctgccccacccctgctgcacgtggccgccctgggccagaagcagggcatcctgggcgcccagccccagctgatcttccagccccaccgcatccccccactcttcccccagaagcccctgagcctcttccagaccagccacaccctgcacctgagccacctgaaccgcttccctgcccggggcccccacggccgcctggaccagggccgcagtgatgattatgacagcaagaagaggaagcagagagctggaggagagccctggggcgccaagaagcccaggcatgacctgcccccctacagagtgcacctgaccccctacacagtggacagccccatctgtgacttcctggagctgcagaggcgctaccgcagcctgctggtgcccagcgacttcctgtctgtgcacctgtcctggctgagcgccttccccctgagccagcccttcagcctgcaccaccccagccgcatccaggtgtcctctgagaaggaggccgccccagatgctggagctgagcccatcacagctgacagcgaccctgcctacagcagcaaggtgctgctgctgagcagccctggcctggaggagctgtaccgctgctgcatgctgtttgtggatgacatggccgagccccgggagaccccagagcaccccctgaagcagatcaagttcctgctgggcaggaaggaggaggaggccgtgctggtgggcggggagtggagccccagcctggatggcctggacccccaggccgacccccaggtgctggtgaggacagccatccgctgtgcccaggcccagacaggcatcgacctgagcggctgcaccaagtggtggaggtttgctgagttccagtacctgcagcccggccccccccggcggctgcagacagtggtggtgtacctgcctgatgtgtggaccatcatgcccaccctggaggagtgggaggccctgtgccagcagaaggctgctgaggccgccccacccacccaggaggcccagggcgagacagagcccacagagcaggccccagatgccctggagcaggccgctgacaccagcagaagaaatgctgagaccccagaggccaccacccagcaggagacagacacagacctgcctgaggcccctcctccacccctggagcctgctgtgattgcccggcccggctgtgtgaacctgagcctgcatggaattgtggaggacagaagacccaaggagcgcatcagctttgaggtgatggtgctggccgagctgttcctggagatgctgcagagggactttggctacagagtgtacaagatgctgctgagcctgcctgagaaggtggtgagccccccagagcctgagaaggaggaggccgccaaggaggaggccaccaaggaggaggaggccatcaaggaggaggtggtgaaggagcccaaggatgaggcccagaatgaaggacctgccacagaaagtgaggcccccctgaaggaggatggcctgctgcccaagcccctgagcagtggaggagaggaggaggagaagcccagaggagaggccagcgaggacctgtgtgagatggccctggaccctgagctgctgctgctgagagatgatggagaggaggagtttgctggggccaagctggaggacagcgaggtgcgctctgtggccagcaaccagagcgagatggagttcagcagcctgcaggacatgcccaaggagctggaccccagcgctgtgctgcccctggactgcctgctggcctttgtgttctttgatgccaactggtgtggctacctgcaccggcgggacctggagcgcatcctgctgaccctgggcatccggctgtctgctgagcaggccaagcagctggtgtcccgggtggtgacccagaacatctgccagtaccgcagcctgcagtacagccggcaggagggcctggatggcggcctgcctgaggaggtgctgtttggaaacctggacctgctgcccccacctgggaagagcaccaagccaggggccgcccccacagagcacaaggccctggtgagccacaacggcagcctcatcaacgtgggcagcctgctgcagagagctgagcagcaggacagcggccgcctgtacctggagaacaagatccacaccctggagctgaagctggaggagagccacaaccgcttcagcgccacagaggtgaccaacaagaccctggccgctgagatgcaggagctgcgggtgcggctggccgaggccgaggagacagccaggacagctgagcggcagaagagccagctgcagaggctgctgcaggagctgcggcggcggctgacccccctgcagctggagatccagagggtggtggagaaggctgacagctgggtggagaaggaggagcccgcccccagcaactag

SEQ ID NO: 165833 - DNA, 3480 bp, Artificial Sequence
  Description of Artificial Sequence: Synthetic coding sequence
atgctggacttcctggccgagaacaacctgtgtggccaggccatcctgcgcatcgtgtcctgtggaaatgccatcatcgccgagctgctgcggctgtctgagttcatcccagctgtgttccggctgaaggacagagctgaccagcagaagtatggagacatcatctttgacttctcctacttcaagggccctgagctgtgggagagcaagctggatgccaagccagagctgcaggacctggatgaggagttccgggagaacaacattgaaattgtgacccgcttctacctggccttccagagcgtgcacaagtacatcgtggacctgaaccgctacctggatgacctgaatgaaggagtgtacatccagcagaccctggagaccgtgctgctgaatgaagatggcaagcagctgctgtgtgaggccctgtacctgtatggagtgatgctgctggtgattgaccagaagattgaaggagaggtgcgggagaggatgctggtgtcctactaccgctacagcgctgcccggagcagcgctgacagcaacatggatgacatctgcaagctgctgcggagcacaggctacagcagccagcccggggccaagaggcccagcaactacccagagagctacttccagagggtgcccatcaatgaaagcttcatctccatggtgattggccgcctgcggagtgatgacatctacaaccaggtgtctgcctaccccctgcctgagcacaggagcacagccctggccaaccaggccgccatgctgtatgtgatcctgtactttgagcccagcatcctgcacacccaccaggccaagatgagagaaattgtggacaagtacttcccagacaactgggtgatcagcatctacatgggcatcaccgtgaacctggtggatgcctgggagccctacaaggccgccaagacagccctgaacaacaccctggacctgagcaatgtgcgggagcaggccagccgctatgccaccgtgtctgagcgggtgcacgcccaggtgcagcagttcctgaaggagggctacctgcgggaggagatggtgctggacaacatccccaagctgctgaactgcctgcgggactgcaatgtggccatccgctggctgatgctgcacacagctgacagcgcctgtgaccccaacaacaagaggctgcggcagatcaaggaccagatcctgacagacagccgctacaacccccgcatcctcttccagctgctgctggacacagcccagtttgagttcatcctgaaggagatgttcaagcagatgctgtctgagaagcagaccaagtgggagcactacaagaaggagggcagcgagaggatgacagagctggctgatgtgttcagcggcgtgaagcccctgaccagggtggagaagaatgaaaacctgcaggcctggttccgggagatcagcaagcagatcctgagcctgaactatgatgacagcacagctgctggcaggaagacagtgcagctgatccaggccctggaggaggtgcaggagttccaccagctggagagcaacctgcaggtgtgccagttcctggccgacaccaggaagttcctgcaccagatgatccgcaccatcaacatcaaggaggaggtgctgatcaccatgcagatcgtgggggacctgagctttgcctggcagctgattgacagcttcaccagcatcatgcaggagagcatccgggtgaaccccagcatggtgaccaagctgcgggccaccttcctgaagctggccagcgccctggacctgcccctgctgcgcatcaaccaggccaacagcccagacctgctgtctgtgtcccagtactacagcggggagctggtgtcctatgtgaggaaggtgctgcagatcatccctgagagcatgttcaccagcctgctgaagatcatcaagctgcagacccatgacatcatcgaggtgcccacccggctggacaaggacaagctgcgggactatgcccagctgggccccaggtatgaggtggccaagctgacccacgccatcagcatcttcacagagggcatcctgatgatgaagaccaccctggtgggcatcatcaaggtggaccccaagcagctgctggaggatggcatcaggaaggagctggtgaagagggtggcctttgccctgcaccggggcctcatcttcaacccccgggccaagcccagcgagctgatgcccaagctgaaggagctgggcgccaccatggatggcttccacaggagctttgagtacatccaggactatgtgaacatctacggcctgaagatctggcaggaggaggtgagccgcatcatcaactacaacgtggagcaggagtgcaacaacttcctgcggaccaagatccaggactggcagagcatgtaccagagcacccacatccccatccccaagttcacccctgtggatgaatctgtgaccttcatcggccgcctgtgccgggagatcctgcgcatcacagaccccaagatgacctgccacatcgaccagctgaacacctggtatgacatgaagacccaccaggaggtgaccagcagccgcctcttcagcgagatccagaccaccctgggcaccttcggcctgaatggcctggaccggctgctgtgcttcatgattgtgaaggagctgcagaacttcctgtccatgttccagaagatcatcctgcgggacagaacagtgcaggacaccctgaagaccctgatgaatgctgtgagccccctgaagagcatcgtggccaacagcaacaagatctacttcagcgccatcgccaagacccagaagatctggacagcctacctggaggccatcatgaaggtgggccagatgcagatcctgcggcagcagatcgccaatgagctgaactacagctgccgctttgacagcaagcacctggccgccgccctggagaacctgaacaaggccctgctggccgacatcgaggcccactaccaggaccccagcctgccctaccccaaggaggacaacaccctgctgtatgagatcacagcctacctggaggccgccggcatccacaaccccctgaacaagatctacatcaccaccaagaggctgccctacttccccatcgtgaacttcctgttcctgattgcccagctgcccaagctgcagtacaacaagaacctgggcatggtgtgcaggaagcccacagatcctgtggactggccacccctggtgctgggcctgctgaccctgctgaagcagttccacagccgctacacagagcagttcctggccctgattggccagttcatctgcagcacagtggagcagtgcaccagccagaagatccctgagatcccagcagatgtggtgggcgccctgctcttcctggaggactatgtgcgctacaccaagctgccccggcgggtggccgaggcccacgtgcccaacttcatctttgatgagttcagaacagtgctgtag

SEQ ID NO: 165834 - DNA, 2424 bp, Artificial Sequence
  Description of Artificial Sequence: Synthetic coding sequence
atgttttctgctggagctgagagcctgctgcaccaggcccgggagatccaggatgaggagctgaagaagttctgcagccgcatctgcaagctgctgcaggccgaggacctgggccctgacaccctggacagcctgcagaggctcttcctgatcatcagcgccaccaagtacagccggcggctggagaagacctgtgtggacctgctgcaggccaccctgggcctgcctgcctgcccagagcagctgcaggtgctgtgtgccgccatcctgcgggagatgagccccagcgacagcctgagcctggcctgggaccacacccagaacagccggcagctgagcctggtggcctctgtgctgctggcccagggcgacagaaatgaggaggtgcgggctgtgggccagggcgtgctgcgggccctggagagccggcagcctgagggccccagcctgcggcacctgctgcctgtgatggccaaggtggtggtgctgagccctggcaccctgcaggaggaccaggccaccctgctgagcaagaggctggtggactggctgcgctatgccagcctgcagcagggcctgccccacagcggcggcttcttcagcaccccccgggcccggcagcccggccctgtgacagaggtggatggagctgtggccacagacttcttcaccgtgctgagcagcggccaccgcttcacagatgaccagtggctgaatgtgcaggccttctccatgctgcgggcctggctgctgcacagcggccctgagggccctggcaccctggacacagatgacagaagtgagcaggagggcagcaccctgagcgtcatcagcgccaccagcagcgctggccgcctgctgcccccccgggagcggctgcgggaggtggcctttgagtactgccagaggctgattgagcagagcaacagaagagccctgaggaaaggagacagcgacctgcagaaggcctgcctggtggaggccgtgctggtgctggatgtgctgtgccggcaggaccccagcttcctgtaccgcagcctgagctgcctgaaggccctgcacggccgggtgcggggggaccctgcctctgtgcgggtgctgctgcccctggcccacttcttcctgagccatggagaggccgctgctgtggacagcgaggccgtgtaccagcacctgttcacccgcatccctgtggagcagttccacagccccatgctggcctttgagttcatccagttctgccgggacaacctgcacctgttcagcggccacctgagcaccctgcggctgtccttccccaacctcttcaagttcctggcctggaacagcccccccctgaccagcgagtttgtggccctgctgcctgccctggtggatgctggaacagccctggagatgctgcacgccctgctggacctgccctgcctgacagctgtgctggacctgcagctgcggagcgccccagctgccagcgagcggcccctgtgggacaccagcctgcgggcccccagctgcctggaggccttccgggacccccagttccagggcctcttccagtacctgctgcggcccaaggccagcggggccacagagcggctggcccccctgcaccagctgctgcagcccatggccggctgtgcccgggtggcccagtgtgcccaggccgtgcccaccctgctgcaggccttcttctctgctgtgacccaggtggctgatggcagcctcatcaaccagctggccctgctgctgctgggccgcagtgacagcctgtacccagcccctggctatgctgctggggtgcacagcgtgctgagcagccagttcctggccctgtgcaccctgaagcccagcctggtggtggagctggcccgggacctgctggagttcctgggctctgtgaatggcctgtgcagccgggccagcctggtgacctctgtggtgtgggccatcggggagtacctgtctgtgacctatgaccggcgctgcaccgtggagcagatcaacaagttctttgaggccctggaggccctgctgtttgaggtgacccagtgccggcccagcgctgccctgccccgctgccccccccaggtggtgacagtgctgatgaccaccctgaccaagctggccagccgcagccaggacctgatcccccgggccagcctgctgctgagcaagatgaggaccctggcccacagccctgccaccagcagcacccacagcgaggagggcgctgaggccatccgcacccgggccacagagctgctgaccctgctgaagatgcccagcgtggcccagtttgtgctgacccccagcacagaggtgtgcagcccccgctaccacagagatgccaacacagccctgcccctggccctgaggacagtgtcccggctggtggagcgggaggccggcctgatgcctggatag

SEQ ID NO: 165835 - DNA, 4086 bp, Artificial Sequence; identical to SEQ ID NO: 151019
  Description of Artificial Sequence: Synthetic coding sequence

SEQ ID NO: 165836 - DNA, 1866 bp, Artificial Sequence
  Description of Artificial Sequence: Synthetic coding sequence
atggccaacgtgccctgggccgaggtgtgtgagaagttccaggccgccctggccctgagccgggtggagctgcacaagaaccctgagaaggagccctacaagagcaagtacagcgcccgggccctgctggaggaggtgaaggccctgctgggccctgccccagaagatgaagatgagaggcctgaggccgaggatggccctggagctggggaccacgccctgggcctgcctgctgaggtggtggagcctgagggccctgtggcccagagagctgtgcggctggccgtgattgagttccacctgggcgtgaaccacatcgacacagaggagctgtctgctggggaggagcacctggtgaagtgcctgcggctgctgcggcgctaccgcctgagccatgactgcatcagcctgtgcatccaggcccagaacaacctgggcatcctgtggagcgagcgggaggagattgaaacagcccaggcctacctggagagcagcgaggccctgtacaaccagtacatgaaggaggtgggcagcccccccctggaccccacagagcgcttcctgcctgaggaggagaagctgacagagcaggagaggagcaagagatttgagaaggtgtacacccacaacctgtactacctggcccaggtgtaccagcacctggagatgtttgagaaggccgcccactactgccacagcaccctgaagaggcagctggagcacaatgcctaccaccccatcgagtgggccatcaatgctgccaccctgagccagttctacatcaacaagctgtgcttcatggaggcccggcactgcctgtctgctgccaacgtcatcttcggccagacaggcaagatcagcgccacagaggacaccccagaggccgagggggaggtgcctgagctgtaccaccagaggaaaggagagatcgcccgctgctggatcaagtactgcctgaccctgatgcagaatgcccagctgtccatgcaggacaacattggagagctggacctggacaagcagagcgagctgcgggccctgaggaagaaggagctggatgaggaggagagcatcaggaagaaggctgtgcagtttggaactggagagctgtgtgatgccatctctgctgtggaggagaaggtgtcctacctgcggcccctggactttgaggaggcccgggagctgttcctgctgggccagcactacgtgtttgaggccaaggagttcttccagattgatggctacgtgacagaccacatcgaggtggtgcaggaccacagcgccctcttcaaggtgctggccttctttgaaacagacatggagcggcgctgcaagatgcacaagagaagaattgccatgctggagcccctgactgtggacctgaacccccagtactacctgctggtgaaccggcagatccagtttgaaattgcccacgcctactatgacatgatggacctgaaggtggccatcgctgaccggctgcgggaccctgacagccacatcgtgaagaagatcaacaacctgaacaagagcgccctgaagtactaccagctgttcctggacagcctgcgggaccccaacaaggtgtttcctgagcacatcggagaagatgtgctgcggcctgccatgctggccaagttccgggtggcccggctgtatggcaagatcatcacagctgaccccaagaaggagctggagaacctggccaccagcctggagcactacaagttcatcgtggactactgtgagaagcaccctgaggccgcccaggagattgaggtggagctggagctgagcaaggagatggtgtccctgctgcccaccaagatggagcgcttccgcaccaagatggccctgacctag

SEQ ID NO: 165837 - DNA, 4551 bp, Artificial Sequence; identical to SEQ ID NO: 165823
  Description of Artificial Sequence: Synthetic coding sequence

SEQ ID NO: 165838 - DNA, 4080 bp, Artificial Sequence
  Description of Artificial Sequence: Synthetic coding sequence
atgtacagcgtggaggacctgctgatcagccacggctacaagctgagccgggaccccccagccagccgggaggacaaccccaagggccggcaggccgccaggacaggcaccagggctggccagggcctgcagaatggacatgaagatggccctgctgccctggcccacaggaagaccagcgctggaaaaggacatgtgtctgattctgagagccgccgcagcaccccccggggccatggagagccccagagcaccagcgccagcaggaccagcgaggccggcttctgcaaccagcccccatctgcctggagcagccaccccccaactggaaatgaccaggcctacagaagaagaggccggcaggaggcccggagccagaagccccgggagcacgagaacctggaggcccggggcatggcccaggcccacagcctgcctgtgcacgtgcgggagggcccctgggaggtgggcggccgctctgagcacgtgatgaagaagcctgtgtgggaggaggagctgaggatgagcggccctgccaagtggcagaatgtgtccctggagagctggaaccagcccaggaagctgggccggcagatgtctgatggagatggagagcggctcttccaggacctgtaccccttcatccagggcgagcacgtgctgaacagccagaacaagggcaagagccgcagcctgccccgggtgctgagccctgagagcctgagctgcacagagatccccatccccctgaatgaaagacacagccccaagatgccaccctacccacccacctgtgcccccaacctggacagcaccagaaattctgagaagagcggctgcagcgcccccttcccccggcccaagtttggccggcccctgaagcccccatcctacagcagccaccagcagagccggggcggcgctgacagcagtgacagccaggacagccagcagatggatgcctacgtgcccaggcatgagctgtgcctgagtgaccccggcctggagccccctgtgtatgtgcccccacccagctaccgcagccccccccagaacatccccaacccctacctggaggacacagtgcccatcaacgtgtgtggcggccacagccagcagcagagccccacagagaaggccggggccagcggccagccccccagcggccccccaggcactggaaatgaatatggagtgagcccccggctgccccagggcctgcctgcccaccccaggcctgtgacagcctatgatggctttgtgcagtacatcccctttgatgacccccggctgcggcacttcaagctggcccagccccagggcttctgtgaggacatcaagctggatgacaagagctacaacagcagccctgtgacagcccaggagcccgcccatggaggcatgcagccagatggagccatctggaacccccagagcctcatcccccccagcggagatgagcggggcctggtgctggccgacagcagcccccgctggctgtggggccagcccccaggagatggagaaaattctggcctgcccaaccagagggacagatgtgtggcccggggccagtggccagatgtgcggggcagccagcacggccacacaggccggcaggtgagcagcccctacagccagggcgagagcacctgtgagacccagaccaagctgaagaagttccagacaggcaccaggaccaagaagagcagcaagaagaagatgaatgagaccatcttctgcctggtgtccatccctgtgaagtctgagagccacctgcctgaccgggacatggacaacaatgacctgaagcccagcgctgaccagaagaatggaagtgacaagagccctgccctgcaggagcagagcctgctgtccatgagcagcacagacctggagctgcaggccctgaccggctccatgggcggccgcacagagttccagaagcaggacctgggggagccagaagaagatcggcagaccaatgacctgtccttcatccacctgaccaagcaccgggagctgaagcacagcggctcctggccaggccaccgctacagagaccagcagacccagaccagcttcagcgaggagccccagagcagccagctgctgcccggggccaagctgggcggccccagccgggccgccctgagccccaagtgcagcgaccctgctgccagcgaggcccagacccacacagccttccccaccggggaccacaagcagaggcccagcgccaggaacctgaagggccacaggagcctgagccccagcagcaacagcgccttcagcaggaccagcctgtctgtggaccaggcccccacccccaaggccggccgcagccagccctgtgtggatgtgcacggcctgggcgcccaccctggccccaagcgggaggtggtgaagggggagcccaccggcccctgcaacagcaagcagctgtttggccagttcctgctgaagcctgtgtcccggcggccctgggacctgatcagccagctggagagcttcaacaaggagctgcaggaggaggaggagagcagcagcagcagcagcagcagcagcagcagcagcgaggagagcgaggccgagccccagcaggagaacagagcccactgccggcaggaggatgtgggcttccggggcaacagccctgagatgagggtggagccccagcccaggatgtgggtgcctgagagccctgtgtgccgcagcggccgcggggagagcaagtctgagagctggagcgaggagctgcagcccggccacccccgggcctggccacccagccctggccgcttccgggtggaggagggcggcggggcccccttctgcagcgcagatggcagcaccagcgctgagaagaggcacctggaggtgtccaatggcatggatgagctggccggcagccccttccctgtgaccaggatgagcagccgcagcagtgatgccaagcccctgcctgccagctacccagctgagccccgggagccccaggagagccccaagatcaccagcgccttcagctctgtgaagcccagcgaggccgtgcccaggaagtttgacagcggcggggagcggggggccggcctgcccctgagcctgagcaacaagaacagaggcctgagcgccccagacctgcggtctgtgggcctgaccccaggccaggagcagggcgccagcgagctggagggcagcctgggggaggccagcaccatcgagatccccccaggagagagcctgcaggcccgggccgcccgcatcctgggcatcgaggtggccgtggagagcctgctgcccggcatccggcgggccggccagaaccagcctgctgagccagatgccagcgcctgcaccccagagagcccccaggaggagctgctgagcaggcctgccccagcagatgtgccccgggtgtccacagatgccttctacggccgcaggaaatgtggctggaccaagagccccctgtttgtgggggaccgggacagcgcccggcgggccccccaggcctttgagcacagtgatgtggatggagtggtgaccagcacagatcctgtgcctgagcctgagcccagccccctggagagcaagttctttgagcagaaggatgtggagaccaagccacccttccgcagcaccctcttccactttgtggagaggaccccatctgtggccggcagcgagaagaggctgcggagccccagcaaggtgattgagagcctgcaggagaagctggccagccccccccggcgggctgaccctgaccggctgatgaggatgaaggaggtgtcctctgtgtccaggatgagggtgctgtccttcagaaatgctgacagccaggaggatgctgaggagctgaaggccaccacccggggccaggccggcctgcccggcggcctggtgtccccaggcagcggggaccgggcccagaggctgggccacagcctgtctgtgtccaaggacagcatcagccgggaggagaaggagcaccctgctgcccagaaggagaagtccatggaccaggacttctggtgcccagacagctatgaccccagccgggtggagcgggtgtag

SEQ ID NO: 165839 - DNA, 3219 bp, Artificial Sequence
  Description of Artificial Sequence: Synthetic coding sequence
atggcccccccaactggagtgctgagcagcctgctgctgctggtgaccatcgccggctgtgccaggaagcagtgcagcgagggccgcacctacagcaatgctgtgatcagccccaacctggagaccacccgcatcatgagggtgagccacaccttccctgtggtggactgcacagctgcctgctgtgacctgagcagctgtgacctggcctggtggtttgagggccgctgctacctggtgtcctgcccccacaaggagaactgtgagcccaagaagatgggccccatccgcagctacctgacctttgtgctgcggcctgtgcagaggcctgcccagctgctggactatggagacatgatgctgaacagaggcagccccagcggcatctggggagacagccctgaggacatcaggaaggacctgaccttcctgggcaaggactggggcctggaggagatgtctgagtacagtgatgactaccgggagctggagaaggacctgctgcagcccagcggcaagcaggagccccggggcagcgctgagtacacagactggggcctgctgcccggcagcgagggcgccttcaacagctctgtgggggacagccctgctgtgcctgctgagacccagcaggaccctgagctgcactacctgaatgaaagtgccagcaccccagcccccaagctgcctgagaggtctgtgctgctgcccctgcccaccacccccagcagcggggaggtgctggagaaggagaaggccagccagctgcaggagcagagcagcaacagcagcggcaaggaggtgctgatgcccagccacagcctgcccccagccagcctggagctgagctctgtgacagtggagaagagccctgtgctgactgtgaccccaggcagcacagagcacagcatccccaccccacccaccagcgctgcccccagcgagagcaccccatctgagctgcccatcagccccaccacagcccccaggacagtgaaggagctgactgtgtctgctggggacaacctgatcatcaccctgcctgacaatgaggtggagctgaaggcctttgtggccccagcccctcctgtggagaccacctacaactatgagtggaacctgatcagccaccccacagactaccagggcgagatcaagcagggccacaagcagaccctgaacctgagccagctgtctgtgggcctgtatgtgttcaaggtgacagtgtccagtgaaaatgcctttggagagggctttgtgaatgtgacagtgaagccagcccggcgggtgaacctgccccctgtggccgtggtgagcccccagctgcaggagctgaccctgcccctgaccagcgccctgattgatggcagccagagcacagatgacacagaaattgtgtcctaccactgggaggagatcaatggccccttcatcgaggagaagacctctgtggacagccctgtgctgcggctgagcaacctggaccccggcaactacagcttccggctgactgtgacagacagtgatggagccaccaacagcaccacagctgccctgattgtgaacaatgctgtggactacccacctgtggccaatgccggccccaaccacaccatcaccctgccccagaacagcatcaccctgaatggaaaccagagcagtgatgaccaccagatcgtgctgtatgagtggagcctgggccctggcagcgagggcaagcacgtggtgatgcagggcgtgcagaccccctacctgcacctgagcgccatgcaggagggggactacaccttccagctgaaggtgacagacagcagccggcagcagagcacagctgtggtgaccgtcatcgtgcagcctgagaacaaccggccccctgtggccgtggccggccctgacaaggagctgatcttccctgtggagagcgccaccctggatggcagcagcagcagtgatgaccatggaattgtgttctaccactgggagcacgtgcggggccccagcgctgtggagatggagaacatcgacaaggccatcgccaccgtgacaggcctgcaggtgggcacctaccacttccggctgactgtgaaggaccagcagggcctgagcagcaccagcaccctgactgtggccgtgaagaaggagaacaacagccccccccgggcccgggccggcggcagacatgtgctggtgctgcccaacaacagcatcaccctggatggcagccgcagcacagatgaccagagaattgtgtcctacctgtggatcagagatggccagagccctgctgctggagatgtgattgatggcagtgaccacagcgtggccctgcagctgaccaacctggtggagggcgtgtacaccttccacctgcgggtgacagacagccagggcgccagtgacacagacacagccaccgtggaggtgcagcctgaccccaggaagagcggcctggtggagctgaccctgcaggtgggcgtgggccagctgacagagcagaggaaggacaccctggtgcggcagctggccgtgctgctgaatgtgctggacagcgacatcaaggtgcagaagatccgggcccacagcgacctgagcacagtgattgtgttctacgtgcagagcaggcctcccttcaaggtgctgaaggctgctgaggtggccaggaacctgcacatgaggctgagcaaggagaaggctgacttcctgctcttcaaggtgctgcgggtggacacagctggctgcctgctgaagtgcagcggccacggccactgtgaccccctgaccaagcgctgcatctgcagccacctgtggatggagaacctgatccagcgctacatctgggatggagagagcaactgtgagtggagcatcttctacgtgacagtgctggccttcaccctgattgtgctgaccggcggcttcacctggctgtgcatctgctgctgcaagaggcagaagaggaccaagatcaggaagaagaccaagtacaccatcctggacaacatggatgagcaggagaggatggagctgcggcccaagtatggcatcaagcacaggagcacagagcacaacagcagcctgatggtgtctgagagcgagtttgacagcgaccaggacaccatcttcagccgggagaagatggagcggggcaaccccaaggtgtccatgaatggcagcatcagaaatggagccagcttctcctactgcagcaaggacagatag

SEQ ID NO: 165840 - DNA, 918 bp, Artificial Sequence
  Description of Artificial Sequence: Synthetic coding sequence
agccagctgcctgtgcgggcagaggagaggacagagagctgcctgtggggctgctgggccagcagccgggtgcggaggaccagtgatgcctgcagcagccccctggccaccagccgcagcgcccggagctgtggggtgctgacagcccctgtgaagggggccagcagcagcctggtggtgaagctggccgacacagaccgggagcgggccctgcggaggatgcagcagatggccggccacctgggcgccttccacccagcccccctgcccctgggcgcctgtggggcctacaccacagccatcctgcagcaccaggccgccctgctggccgccgcccagggccctggcctgggccctgtggccgctgtggccgcccagatgcagcacgtggccgccttcagcctggtggccgcccccctgctgcctgctgctgctgccaacagccccccaggcagcggccctggcaccctgcccggcctgcctgcccccatcggcgtgaatggatttggccccctgaccccccagaccaacggccagcccggcagtgacaccctgtacaacaacggcctgagcccctacccagcccagagccctggggtggccgaccccctgcagcaggcctatgccggcatgcaccactacgccggccctgagggctgcaacctcttcatctaccacctgccccaggagtttggagatgctgagctgatccagaccttcctgccctttggagctgtggtgtctgccaaggtgtttgtggaccgggccaccaaccagagcaaatgttttggatttgtgtcctttgacaaccccaccagcgcccagacagccatccaggccatgaatggcttccagatcggcatgaagaggctgaaggtgcagctgaagaggcccaaggatgccaaccggccctactag

SEQ ID NO: 165841 - DNA, 198 bp, Artificial Sequence
  Description of Artificial Sequence: Synthetic coding sequence
atggtgaggaccaaggctgacagcgtgcccggcacctacaggaaggtggtggccgcccgggcccccaggaaggtgctgggcagcagcaccagcgccaccaacagcacctctgtgagcagcaggaaggagcacgtgctgtgcaacctgatcacccagatgatgaagaagaacagaaccttctccttcatctttgaatag

SEQ ID NO: 165842 - DNA, 15018 bp, Artificial Sequence; identical to SEQ ID NO: 165827
  Description of Artificial Sequence: Synthetic coding sequence

SEQ ID NO: 165843 - DNA, 2772 bp, Artificial Sequence; identical to SEQ ID NO: 165832
  Description of Artificial Sequence: Synthetic coding sequence

SEQ ID NO: 165844 - DNA, 2982 bp, Artificial Sequence
  Description of Artificial Sequence: Synthetic coding sequence
atgggcgccgccggccggcaggacttcctgttcaaggccatgctgaccatctcctggctgaccctgacctgcttccctggggccaccagcacagtggccgccggctgcccagaccagagccctgagctgcagccctggaaccctggccatgaccaggaccaccacgtgcacatcggccagggcaagaccctgctgctgaccagcagcgccaccgtgtacagcatccacatcagcgagggcggcaagctggtgatcaaggaccatgatgagcccatcgtgctgcggaccaggcacatcctgattgacaatggaggagagctgcatgctggcagcgccctgtgccccttccagggcaacttcaccatcatcctgtatggccgggcagatgagggcatccagcctgacccctactacggcctgaagtacatcggcgtgggcaaaggaggagccctggagctgcacggccagaagaagctgtcctggaccttcctgaacaagaccctgcaccctgggggcatggccgagggcggctacttctttgagaggtcctggggccaccggggcgtcatcgtgcacgtgattgaccccaagagcggcaccgtcatccacagcgacagatttgacacctaccgcagcaagaaggagagcgagcggctggtgcagtacctgaatgctgtgcctgatggccgcatcctgtctgtggccgtgaatgatgagggcagcaggaacctggatgacatggccaggaaggccatgaccaagctgggcagcaagcacttcctgcacctgggcttccgccacccctggagcttcctgactgtgaagggcaaccccagcagctctgtggaggaccacatcgagtaccacggccaccggggcagcgctgctgcccgggtcttcaagctgttccagacagaacatggagagtacttcaacgtgtccctgagcagcgagtgggtgcaggatgtggagtggacagagtggtttgaccatgacaaggtgtcccagaccaagggcggggagaagatcagtgacctgtggaaggcccaccctgggaagatctgcaaccggcccatcgacatccaggccaccaccatggatggagtgaacctgagcacagaggtggtgtacaagaagggccaggactacagatttgcctgctatgaccggggccgggcctgccgcagctacagagtgcgcttcctgtgtgggaagcctgtgcggcccaagctgactgtgaccatcgacaccaacgtgaacagcaccatcctgaacctggaggacaacgtgcagagctggaagccaggggacaccctggtgattgccagcacagactacagcatgtaccaggccgaggagttccaggtgctgccctgccgcagctgtgcccccaaccaggtgaaggtggccggcaagcccatgtacctgcacatcggggaggagattgatggagtggacatgagagctgaggtgggcctgctgagcaggaacatcatcgtgatgggagagatggaggacaagtgctacccctacagaaaccacatctgcaacttctttgattttgacaccttcggcggccacatcaagtttgccctgggcttcaaggccgcccacctggagggcacagagctgaagcacatgggccagcagctggtgggccagtaccccatccacttccacctggccggagatgtggatgagcggggcggctatgacccccccacctacatccgggacctgagcatccaccacaccttcagccgctgtgtgacagtgcacggcagcaatggcctgctgatcaaggatgtggtgggctacaacagcctgggccactgcttcttcacagaagatggccctgaggagaggaacacctttgaccactgcctgggcctgctggtgaagagcggcaccctgctgcccagcgaccgggacagcaagatgtgcaagatgatcacagaagattcctacccaggctacatccccaagccccggcaggactgcaatgctgtgtccaccttctggatggccaaccccaacaacaacctgatcaactgtgccgccgccggcagcgaggagaccggcttctggttcatcttccaccacgtgcccaccggccccagcgtgggcatgtacagccctggctacagcgagcacatccccctgggcaagttctacaacaacagagcccacagcaactacagagctggcatgatcatcgacaatggagtgaagaccacagaggccagcgccaaggacaagaggcccttcctgagcatcatcagcgcccgctacagcccccaccaggatgctgaccccctgaagccccgggagcccgccatcatccgccacttcatcgcctacaagaaccaggaccacggggcctggctgcggggaggagatgtgtggctggacagctgccgctttgctgacaatggaattggcctgaccctggccagcggcggcaccttcccctatgatgatggcagcaagcaggagatcaagaacagcctgtttgtgggggagagcggaaatgtgggcacagagatgatggacaaccgcatctggggccctgggggcctggaccacagcggccgcaccctgcccatcggccagaacttccccatccggggcatccagctgtatgatggccccatcaacatccagaactgcaccttcaggaagtttgtggccctggagggccgccacaccagcgccctggccttccggctgaacaatgcctggcagagctgcccccacaacaacgtgactggaattgcctttgaagatgtgcccatcaccagcagggtcttcttcggggagcccggcccctggttcaaccagctggacatggatggagacaagaccagcgtcttccatgatgtggatggctctgtgtctgagtacccaggcagctacctgaccaagaatgacaacaagtggcacagcctggccagcaaggccgccagcggccccagcggctag

SEQ ID NO: 165845 - DNA, 4086 bp, Artificial Sequence; identical to SEQ ID NO: 151019
  Description of Artificial Sequence: Synthetic coding sequence

SEQ ID NO: 165846 - DNA, 1947 bp, Artificial Sequence
  Description of Artificial Sequence: Synthetic coding sequence
atggaggtgaagggcaagaagcagttcaccgggaagagcaccaagacagcccaggagaagaaccgcttccacaagaacagcgacagcggcagcagcaagaccttccccaccaggaaggtggccaaggagggcggccccaaggtgaccagcaggaactttgagaagagcatcaccaagctgggcaagaagggcgtgaagcagttcaagaacaagcagcagggcgacaagagccccaagaacaagttccagcctgccaacaagttcaacaagaagaggaagttccagccagatggccgcagtgatgaatctgctgccaagaagcccaagtgggatgacttcaagaagaagaagaaggagctgaagcagagccggcagctgagtgacaagaccaactatgacatcgtggtgcgggccaagcagatgtgggagatcctgcggaggaaggactgtgacaaggagaagagggtgaagctgatgtctgacctgcagaagctgatccagggcaagatcaagaccatcgcctttgcccatgacagcaccagggtcatccagtgctacatccagtatggaaatgaggagcagaggaagcaggcctttgaggagctgagagatgacctggtggagctgagcaaggccaagtacagcaggaacatcgtgaagaagttcctgatgtatggcagcaagccccagattgctgagatcatccgctccttcaagggccacgtgaggaagatgctgcggcatgctgaggccagcgccatcgtggagtatgcctacaatgacaaggccatcctggagcagaggaacatgctgacagaggagctgtatggcaacaccttccagctgtacaagtctgctgaccacaggaccctggacaaggtgctggaggtgcagcctgagaagctggagctgatcatggatgagatgaagcagatcctgacccccatggcccagaaggaggccgtcatcaagcacagcctggtgcacaaggtgttcctggacttcttcacctacgccccacccaagctgcggtctgagatgattgaggccatccgggaggccgtggtgtacctggcccacacccatgatggagcccgggtggccatgcactgcctgtggcacggcacccccaaggacaggaaggtgattgtgaagaccatgaagacctacgtggagaaggtggccaacggccagtacagccacctggtgctgctggccgcctttgactgcattgatgacaccaagctggtgaagcagatcatcatcagcgagatcatcagcagcctgcccagcatcgtgaatgacaagtatggcaggaaggtgctgctgtacctgctgagcccccgggaccctgcccacacagtgcgggagatcatcgaggtgctgcagaagggagatggaaatgcccacagcaagaaggacacagaggtgagaagaagagagctgctggagagcatcagccctgccctgctgagctacctgcaggagcacgcccaggaggtggtgctggacaagagcgcctgtgtgctggtgtctgacatcctgggcagcgccactggagatgtgcagcccaccatgaatgccatcgccagcctggccgccaccggcctgcaccctgggggcaaggatggagagctgcacatcgccgagcaccctgctggccacctggtgctgaagtggctgattgagcaggacaagaagatgaaggaaaatggccgggagggctgctttgccaagaccctggtggagcacgtgggcatgaagaacctgaagtcctgggcctctgtgaacagaggagccatcatcctgagcagcctgctgcagagctgtgacctggaggtggccaacaaggtgaaggccgccctgaagagcctcatccccaccctggagaagaccaagagcaccagcaaaggaattgagatcctgctggagaagctgagcacctag

SEQ ID NO: 165847 - DNA, 339 bp, Artificial Sequence
  Description of Artificial Sequence: Synthetic coding sequence
atgaagaaccaggtgtgcagcaaatgtggggagggcacctacagcctgggcagcggcatcaagtttgatgagtgggatgagctgcctgctggcttcagcaacatcgccaccttcatggacacagtggtgggccccagcgacagcaggccagatggctgcaacaacagctcctggatcccccggggcaactacatcgagagcaacagagatgactgcaccgtgtccctcatctatgctgtgcacctgaagaagagcggctacgtgttctttgagtaccagtatgtggacaacaacatcttctttgagttcttcatccagaatgaccagtgccaggagtag

SEQ ID NO: 165848 - DNA, 1842 bp, Artificial Sequence
  Description of Artificial Sequence: Synthetic coding sequence
atgttttctgctggagctgagagcctgctgcaccaggcccgggagatccaggatgaggagctgaagaagttctgcagccgcatctgcaagctgctgcaggccgaggacctgggccctgacaccctggacagcctgcagaggctcttcctgatcatcagcgccaccaagtacagccggcggctggagaagacctgtgtggacctgctgcaggccaccctgggcctgcctgcctgcccagagcagctgcaggtgctgtgtgccgccatcctgcgggagatgagccccagcgacagcctgagcctggcctgggaccacacccagaacagccggcagctgagcctggtggcctctgtgctgctggcccagggcgacagaaatgaggaggtgcgggctgtgggccagggcgtgctgcgggccctggagagccggcagcctgagggccccagcctgcggcacctgctgcctgtgatggccaaggtggtggtgctgagccctggcaccctgcaggaggaccaggccaccctgctgagcaagaggctggtggactggctgcgctatgccagcctgcagcagggcctgccccacagcggcggcttcttcagcaccccccgggcccggcagcccggccctgtgacagaggtggatggagctgtggccacagacttcttcaccgtgctgagcagcggccaccgcttcacagatgaccagtggctgaatgtgcaggccttctccatgctgcgggcctggctgctgcacagcggccctgagggccctggcaccctggacacagatgacagaagtgagcaggagggcagcaccctgagcgtcatcagcgccaccagcagcgctggccgcctgctgcccccccgggagcggctgcgggaggtggcctttgagtactgccagaggctgattgagcagagcaacagaagagccctgaggaaaggagacagcgacctgcagaaggcctgcctggtggaggccgtgctggtgctggatgtgctgtgccggcaggaccccagcttcctgtaccgcagcctgagctgcctgaaggccctgcacggccgggtgcggggggaccctgcctctgtgcgggtgctgctgcccctggcccacttcttcctgagccatggagaggccgctgctgtggacagcgaggccgtgtaccagcacctgttcacccgcatccctgtggagcagttccacagccccatgctggcctttgagttcatccagttctgccgggacaacctgcacctgttcagcggccacctgagcaccctgcggctgtccttccccaacctcttcaagttcctggcctggaacagcccccccctgaccagcgagtttgtggccctgctgcctgccctggtggatgctggaacagccctggagatgctgcacgccctgctggacctgccctgcctgacagctgtgctggacctgcagctgcggagcgccccagctgccagcgagcggcccctgtgggacaccagcctgcgggcccccagctgcctggaggccttccgggacccccagttccagggcctcttccagtacctgctgcggcccaaggccagcggggccacagagcggctggcccccctgcaccagctgctgcagcccatggccggctgtgcccgggtggcccagtgtgcccaggccgtgcccaccctgctgcaggccttcttctctgctgtgacccaggtggctgatggcagcctcatcaaccagctggccctgctgctgctgggccgcagtgacagcctgtacccagcccctggctatgctgctggggtgcacaggccagatgcctgccggcccatcctggtgcccctgtag

SEQ ID NO: 165849 - DNA, 918 bp, Artificial Sequence
  Description of Artificial Sequence: Synthetic coding sequence
atggagaaggagacctacaagacagccaagctgatcctggagagatttgatcctgacagcaagaaggccaaggaatgtgagccccccagcgctggagctgctgtgacagcccggcccggccaggagatccggcagaggacagctgcccagaggaacctgagccccaccccagccagccccaaccagggccccccaccccaggtgcctgtgtccccaggcccccccaaggacagcagcgcccctgggggccccccagagaggacagtgaccccagccctgagcagcaatgtgctgcccaggcacctgggcagccctgccacctctgtgcccggcatgggcctgcaccccccaggcccccccctggcccggcccatcctgccccgggagcggggggccctggaccgcatcgtggagtacctggtgggagatggcccccagaacagatatgccctgatctgccagcagtgcttcagccacaacggcatggccctgaaggaggagtttgagtacatcgccttccgctgtgcctactgcttcttcctgaacccagccaggaagacccggccccaggccccccggctgcctgagttctcctttgagaagaggcaggtggtggagggcagcagctctgtgggccccctgcccagcggctctgtgctgagcagtgacaaccagttcaatgaggagagcctggagcatgatgtgctggatgacaacacagagcagacagatgacaagatcccagccacagagcagaccaaccaggtgattgagaaggccagtgacagcgaggagcctgaggagaagcaggagacagaaaatgaggaggccagcgtcatcgagaccaacagcacagtgcctggagctgacagcatcccagaccctgagctgagcggggagagcctgacagctgagtag

SEQ ID NO: 165850 - DNA, 2589 bp, Artificial Sequence
  Description of Artificial Sequence: Synthetic coding sequence
atgcacagctcctggatcccccggggcaactacatcgagagcaacagagatgactgcaccgtgtccctcatctatgctgtgcacctgaagaagagcggctacgtgttctttgagtaccagtatgtggacaacaacatcttctttgagttcttcatccagaatgaccagtgccaggagatggacaccaccacagacaagtgggtgaagctgacagacaatggagagtggggcagccacagcgtgatgctgaagagcggcaccaacatcctgtactggaggaccaccggcatcctgatgggcagcaaggctgtgaagcctgtgctggtgaagaacatcaccatcgagggcgtggcctacaccagcgagtgcttcccctgcaagccaggcaccttcagcaacaagccaggcagcttcaactgccaggtgtgccccaggaacacctacagcgagaagggggccaaggagtgcatccgctgcaaggatgacagccagttcagcgaggagggcagcagcgagtgcacagagaggcctccctgcaccaccaaggactacttccagatccacaccccctgtgatgaggagggcaagacccagatcatgtacaagtggattgagcccaagatctgccgggaggacctgacagatgccatccggctgccccccagcggggagaagaaggactgccccccctgcaaccctggcttctacaacaacggcagcagcagctgccacccctgccccccaggcaccttcagtgatggcaccaaggaatgtcggccctgcccagctggaacagagcccgccctgggctttgagtacaagtggtggaatgtgctgcccggcaacatgaagaccagctgcttcaacgtgggcaacagcaaatgtgatggcatgaatggctgggaggtggccggggaccacatccagagcggggccggcggcagtgacaatgactacctgatcctgaacctgcacatccctggcttcaagccacccacctccatgaccggggccactggaagtgagctgggccgcatcacctttgtgtttgagaccctgtgcagcgctgactgtgtgctgtacttcatggtggacatcaacaggaagagcaccaacgtggtggagagctggggcggcaccaaggagaagcaggcctacacccacatcatcttcaagaatgccaccttcaccttcacctgggccttccagaggaccaaccagggccaggacaacagacgcttcatcaatgacatggtgaagatctacagcatcacagccaccaatgctgtggatggagtggccagcagctgccgggcctgtgccctgggcagcgagcagagcggcagcagctgtgtgccctgccccccaggccactacatcgagaaggagaccaaccagtgcaaggaatgtcctccagacacctacctgagcatccaccaggtgtatggcaaggaggcctgcatcccctgtggccctggcagcaagaacaaccaggaccacagcgtgtgctacagcgactgcttcttctaccacgagaaggagaaccagagcctgcactatgacttcagcaacctgagctctgtgggcagcctgatgaatggccccagcttcaccagcaagggcaccaagtacttccacttcttcaacatcagcctgtgtggccacgagggcaagaagatggccctgtgcaccaacaacatcacagacttcaccgtgaaggagatcgtggccggcagtgatgactacaccaacctggtgggcgcctttgtgtgccagagcaccatcatccccagcgagagcaagggcttccgggccgccctgagcagccagagcatcatcctggccgacaccttcatcggcgtgacagtggagaccaccctgaagaacatcaacatcaaggaggacatgtttcctgtgcccaccagccagatcccagatgtgcacttcttctacaagagcagcacagccaccaccagctgcatcaatggccgcagcacagctgtgaagatgcgctgcaaccccaccaagtctggagctggggtcatctctgtgcccagcaaatgtcctgctggcacctgtgatggctgcaccttctacttcctgtgggagagcgctgaggcctgccccctgtgcacagaacatgacttccatgaaattgaaggagcctgcaagaggggcttccaggagaccctgtatgtgtggaatgagcccaagtggtgcatcaagggcatcagcctgcctgagaagaagctggccacctgtgagaccgtggacttctggctgaaggtgggcgccggcgtgggcgccttcaccgctgtgctgctggtggccctgacctgctacttctggaagaagaaccagaagctggagtacaagtacagcaagctggtgatgaccaccaacagcaaagaatgtgagctgcctgctgctgacagctgtgccatcatggagggagaagataatgaggaggaggtggtgtacagcaacaagcagagcctgctgggcaagctgaagagcctggccaccaaggagaaggaggaccactttgaatctgtgcagctgaagaccagccgcagccccaacatctag

SEQ ID NO: 165851 - DNA, 5853 bp, Artificial Sequence
  Description of Artificial Sequence: Synthetic coding sequence
atgcctggggccaggagaagaagaagaggagctgccatggagggcaagcccagggctggggtggccctggcccctggccccagcggccggcggcccagcgcccgctgtgccaggagaagaagacctggcctgctgctgcccggcctgtggctgctgctgctggcccggcctgccagctgtgccccagatgagctgagccctgagcagcacaacctgagcctgtacagcatggagctggtgctgaagaagagcacaggccacagcgctgcccaggtggccctgacagaaacagcccctggcagccagcacagcagccccctgcacgtgacagccccacccagcgccaccacctttgacacagccttcttcaaccagggcaagcagaccaagagcacagctgaccccagcatctttgtggccacctacgtgtctgtgaccagcaaggaggtggccgtgaatgatgatgagatggacaacttcctgcctgacacccactggaccacccccaggatggtgagccccatccagtacatcaccgtgagccccccaggcctgccccgggaggccctggagcccatgctgacccccagcctgcccatggtgtccctgcaggatgaggaggtgaccagcggctggcagaacaccacccggcagcctgctgcctatgcagagagcgccagccacttccacaccttccgcagcgccttccgcaccagcgagggcatcgtgcccaccccaggcaggaacctggtgctgtaccccacagatgcctacagccacctgagcagcaggaccctgcctgagatcgtggccagcctgacagagggcgtggagaccaccctcttcctgagcagccgcagcctgatgccccagcccctgggagatggcatcaccatccccctgcccagcctgggggaggtgtcccagcccccagaggaggtgtgggccaccagcgctgaccgctacacagatgtgaccaccgtgctgagccagagcctggaggagaccatcagccccaggacctaccccaccgtgacagccagccacgccgccctggccttcagcaggacccacagccccctgctgagcacccccctggcctttgccagcagcgccagccccacagatgtgagcagcaaccccttcctgcccagcgacagcagcaagaccagcgagctgcacagcaacagcgccctgcccggccctgtggacaacacccacatcctgagccctgtgagcagcttccggccctacacctggtgtgccgcctgcaccgtgcccagcccccagcaggtgctggccaccagcctgatggagaaggatgtgggcagcggagatggagctgagaccctgtgcatgacagtgctggaggagagcagcatcagcctgatgagctctgtggtggccgacttcagcgagtttgaggaggacccccaggtgttcaacaccctcttccccagccggcccatcgtgcccctgagcagccgctccatggagatcagcgagacctctgtgggcatctctgctgaggtggacatgagctctgtgaccaccacccaggtgcccccagcccacggccgcctgtctgtgcctgccagcctggaccccacagctggcagcctgtctgtggccgagacccaggtgacccccagctctgtgaccacagccttcttcagcgtcatcaccagcatcctgctggacagcagcttctctgtgattgccaacaagaacacccccagcctggccgtgcgggaccccagcgtcttcaccccctacagcctggtgcccagcgtggagagcagcctcttcagtgaccaggagaggagcagcttcagcgagcacaagcccaggggggccctggactttgccagcagcttcttcagcaccccacccctggagctgagcggcagcatcagcagccccagcgaggccccagccagcctgagcctgatgcccagcgacctgagccccttcaccagccagagcttcagccccctggtggagaccttcaccctgtttgacagcagtgacctgcagagcagccagctgagcctgcccagcagcaccaacctggagttcagccagctgcagcccagcagcgagctgcccctgaacaccatcatgctgctgcccagccgctctgaggtgagcccctggagcagcttccccagcgacagcctggagtttgtggaggccagcacagtgtccctgacagacagcgaggcccacttcaccagcgccttcatcgagaccaccagctacctggagagcagcctcatcagccatgagagcgctgtgacagccctggtgcccccaggcagcgagagctttgacatcctgacagctggcatccaggccaccagccccctgaccaccgtgcacaccacccccatcctgacagagagcagcctcttcagcaccctgaccccaccagatgaccagatcagcgccctggatggccacgtgtctgtgctggccagcttcagcaaggccatccccaccggcaccgtgctgatcacagatgcctacctgcccagcggcagcagctttgtgtctgaggccacccccttccccctgcccacagagctgactgtggtgggccccagcctgacccccacagaggtgcccctgaacaccagcacagaggtgtccaccaccagcactggagctgccaccggcggccccctggacagcaccctgatgggagatgctgccagccagagccccccagagagcagcgctgccccacccctgcccagcctgcggcctgtgacagccttcaccctggaggccaccgtggacacccccaccctggccacagccaagccaccctacgtgtgtgacatcaccgtgcctgatgcctacctgatcaccaccgtgctggccaggagagctgtgcaggagtacatcatcacagccatcaaggaggtgctgcgcatccacttcaacagagctgtggagctgaaggtgtatgagctgttcacagacttcaccttcctggtgaccagcggcccctttgtgtacacagccatcagcgtcatcaacgtgctgatcaacagcaagctggtgcgggaccagacccccctcatcctgtctgtgaagcccagcttcctggtgcctgagagccgcttccaggtgcagacagtgctgcagtttgtgccccccagcgtggacaccggcttctgcaacttcacccagagaattgagaagggcctgatgacagccctgtttgaggtgaggaagcaccaccagggcacctacaacctgactgtgcagatcctgaacatcaccatcagcagcagccgggtgaccccccggcggggccctgtgaacatcatctttgctgtgaagagcacccagggcttcctgaatggcagcgaggtgtctgagctgctgaggaacctgtctgtggtggagttctccttctacctgggctaccctgtgctgcagattgctgagcccttccagtacccccagctgaacctgagccagctgctgaagagctcctgggtgaggacagtgctgctgggcgtgatggagaagcagctgcagaatgaggtgttccaggccgagatggagaggaagctggcccagctgctgtctgaggtgtccaccaggaggaggatgtggaggcgggccaccgtggccgccggcaacagcgtggtgcaggtggtgaatgtgtcccggctggagggagatgacaaccctgtgcagctgatctactttgtggaggaccaggatggagagcggctgtctgctgtgaagagcagtgacctgatcaacaagatggacctgcagagagctgccatcatcctgggctaccgcatccagggcgtcatcgcccagcctgtggacagagtgaagaggcccagccctgagagccagagcaacaacctgtgggtgattgtgggcgtggtgattcctgtgctggtggtgatggtgattgtggtgatcctgtactggaagctgtgcaggacagacaagctggacttccagcctgacacagtggccaacatccagcagaggcagaagctgcagatccccagcgtgaagggctttgattttgccaagcagcacctgggccagcacaacaaggatgacatcctgatcatccacgagcccgcccccctgcccggccccctgaaggaccacaccacccccagtgaaaatggagatgtgcccagccccaagagcaagatccccagcaagaatgtgcgccaccggggccgggtgagccccagtgatgctgacagcacagtgtctgaggagagcagcgagagagatgctggggacaagaccccaggagctgtgaatgatggccgcagccaccgggccccccagagcggcccccccctgcccagcagtggaaatgagcagcacagcagcgccagcatctttgagcacgtggaccgcatcagcaggcctcctgaggccagccggcgggtgcccagcaagatccagctgattgccatgcagcccatcccagcccctcctgtgcagaggcccagccctgctgacagagtggccgagagcaacaagatcaacaaggagatccagacagccctgcggcacaagtcagaaattgagcaccacaggaacaagatccggctgcgggccaagagaagaggccactatgagttccctgtggtggatgacctgagcagcggggacaccaaggagcggcaccgggtgtaccgccgggcccagatgcagattgacaagatcctggaccccacagcctctgtgcccagcgtcttcatcgagcccaggaagagcagccgcatcaagaggagccccaagcccaggaggaagcaccaggtgaatggctgcccagcagatgctgagaaggacaggctcatcaccacagacagtgatggcacctacagaagacctcctggggtgcacaacagcgcctacatcggctgccccagcgaccctgacctgcctgcagatgtgcagacccccagctctgtggagctgggccgctacccagccctgcccttccctgccagccagtacatccccccccagcccagcattgaggaggcccggcagaccatgcacagcctgctggatgatgcctttgccctggtggcccccagcagccagcctgccagcacagctggggtgggccctggggtgcccccaggcctgcctgccaacagcacccccagccaggaggagcggcgggccacccagtggggcagcttctacagccctgcccagacagccaacaacccctgcagccgctatgaggactatggcatgaccccacccaccggccccctgccccggcccggcttcggccctggcctgctgcagagcacagagctggtgcccccagacccccagcagccccaggccagcgctgaggccccctttgctgcccggggcatctacagcgaggagatgcccagcgtggcccggcccaggcctgtgggcggcaccaccggcagccagatccagcacctgacccaggtgggcatcgccagcagaattggagcccagcctgtggagatcccccccagccggggcagccagtatggaggccctggctggcccagctatggagaagatgaagctggaagaagagaggccacccacatgctgggccaccaggagtacagcagcagccccctcttccaggtgcccaggaccagcggccgggagcccagcgcccccagcggcaacctgccccaccggggcctgcagggccctggcctgggctaccccaccagcagcacagaggacctgcagcccggccacagcagcgccagcctcatcaaggccatccgggaggagctgctgcggctgagccagaagcagagcacagtgcagaacttccacagctag

SEQ ID NO: 165852 - DNA, 357 bp, Artificial Sequence
  Description of Artificial Sequence: Synthetic coding sequence
tgaaaaagcaatggcaagacagccatcggggaccccggccgggccaacatgcctggctacaatgaagacagccgcagcaccttctttgacaagaagtacagcaacatgagcaccctgggcaacaacggccccacccacaagaagctgtaccgccacaagagcagcagcaaggccctgagagatgagaagtgcaagggcaagcacatggagcgggagcaggtgcacaaggatgaaagtggcacagccagctttgagaagctgcgggacagcgactacaacctgctgaaggccgagaccaccttctgggtgctgcctgtgtttgaggaggagacccgcatcttccagaaggacatctag

SEQ ID NO: 165853 - DNA, 3084 bp, Artificial Sequence
  Description of Artificial Sequence: Synthetic coding sequence
atgagggtgagccacaccttccctgtggtggactgcacagctgcctgctgtgacctgagcagctgtgacctggcctggtggtttgagggccgctgctacctggtgtcctgcccccacaaggagaactgtgagcccaagaagatgggccccatccgcagctacctgacctttgtgctgcggcctgtgcagaggcctgcccagctgctggactatggagacatgatgctgaacagaggcagccccagcggcatctggggagacagccctgaggacatcaggaaggacctgaccttcctgggcaaggactggggcctggaggagatgtctgagtacagtgatgactaccgggagctggagaaggacctgctgcagcccagcggcaagcaggagccccggggcagcgctgagtacacagactggggcctgctgcccggcagcgagggcgccttcaacagctctgtgggggacagccctgctgtgcctgctgagacccagcaggaccctgagctgcactacctgaatgaaagtgccagcaccccagcccccaagctgcctgagaggtctgtgctgctgcccctgcccaccacccccagcagtggagaggtgctggagaaggagaaggccagccagctgcaggagcagagcagcaacagcagcggcaaggaggtgctgatgcccagccacagcctgcccccagccagcctggagctgagctctgtgacagtggagaagagccctgtgctgactgtgaccccaggcagcacagagcacagcatccccaccccacccaccagcgctgcccccagcgagagcacccccagcgagctgcccatcagccccaccacagcccccaggacagtgaaggagctgactgtgtctgctggggacaacctgatcatcaccctgcctgacaatgaggtggagctgaaggcctttgtggccccagcccctcctgtggagaccacctacaactatgagtggaacctgatcagccaccccacagactaccagggcgagatcaagcagggccacaagcagaccctgaacctgagccagctgtctgtgggcctgtatgtgttcaaggtgacagtgtccagtgaaaatgccttcggggagggctttgtgaatgtgacagtgaagccagccaggagagtgaacctgccccctgtggccgtggtgagcccccagctgcaggagctgaccctgcccctgaccagcgccctgattgatggcagccagagcacagatgacacagagatcgtgtcctaccactgggaggagatcaatggccccttcatcgaggagaagacctctgtggacagccctgtgctgcggctgagcaacctggaccccggcaactacagcttccggctgactgtgacagacagtgatggagccaccaacagcaccacagctgccctgattgtgaacaatgctgtggactacccacctgtggccaatgccggccccaaccacaccatcaccctgccccagaacagcatcaccctgaatggaaaccagagcagtgatgaccaccagatcgtgctgtatgagtggagcctgggccctggcagcgagggcaagcacgtggtgatgcagggcgtgcagaccccctacctgcacctgagcgccatgcaggagggggactacaccttccagctgaaggtgacagacagcagccggcagcagagcacagctgtggtgacagtgattgtgcagcctgagaacaacagacctcctgtggccgtggccggccctgacaaggagctgatcttccctgtggagagcgccaccctggatggcagcagcagcagtgatgaccacggcatcgtgttctaccactgggagcacgtgcggggccccagcgctgtggagatggagaacatcgacaaggccatcgccaccgtgacaggcctgcaggtgggcacctaccacttccggctgactgtgaaggaccagcagggcctgagcagcaccagcaccctgactgtggccgtgaagaaggagaacaacagccccccccgggcccgggccggcggccgccacgtgctggtgctgcccaacaacagcatcaccctggatggcagccgcagcacagatgaccagagaattgtgtcctacctgtggatcagagatggccagagccctgctgctggagatgtgattgatggcagtgaccacagcgtggccctgcagctgaccaacctggtggagggcgtgtacaccttccacctgcgggtgacagacagccagggcgccagtgacacagacacagccaccgtggaggtgcagcctgaccccaggaagagcggcctggtggagctgaccctgcaggtgggcgtgggccagctgacagagcagaggaaggacaccctggtgcggcagctggccgtgctgctgaatgtgctggacagcgacatcaaggtgcagaagatccgggcccacagcgacctgagcaccgtcatcgtgttctacgtgcagagccggccccccttcaaggtgctgaaggctgctgaggtggccaggaacctgcacatgaggctgagcaaggagaaggctgacttcctgctcttcaaggtgctgcgggtggacacagctggctgcctgctgaagtgcagcggccacggccactgtgaccccctgaccaagcgctgcatctgcagccacctgtggatggagaacctgatccagcgctacatctgggatggagagagcaactgtgagtggagcatcttctacgtgacagtgctggccttcaccctcatcgtgctgactggaggcttcacctggctgtgcatctgctgctgcaagaggcagaagaggaccaagatcaggaagaagaccaagtacaccatcctggacaacatggatgagcaggagaggatggagctgcggcccaagtatggcatcaagcacaggagcacagagcacaacagcagcctgatggtgtctgagagcgagtttgacagcgaccaggacaccatcttcagccgggagaagatggagcggggcaaccccaaggtgtccatgaatggcagcatcagaaatggagccagcttctcctactgcagcaaggacagatag

SEQ ID NO: 165854 - DNA, 1821 bp, Artificial Sequence
  Description of Artificial Sequence: Synthetic coding sequence
atgggcaacacctgccgggtgtgctaccagctggaggccatcaagaggagcaatgagatgagcaatgtgatgggcaacaccacctggaccaccagcggcctgaagagccagggccgcctgtctgtgggcagcaacagagaccgggagatctccatgtctgtgggcctgggccgcagccagctggacagcaagggcggcgtggtgggcggcaccattgatgtgaatgccctggagatggtggcccacatcagcgagcaccccaaccagcagcccagccacaagatccagatcaccatgggcagcacagaggcccgggtggactacatgggcagcagcatcctgatgggcatcttcagcaatgctgacctgaagctgcaggatgagtggaaggtgaacctgtacaacaccctggacagcagcatcacagacaagtctgagatctttgtgcacggggacctgaagtgggacatcttccaggtgatgatcagccgcagcaccaccccagacctgatcaagattggcatgaagctgcaggagttcttcacccagcagtttgacaccagcaagagggccctgagcacctggggccctgtgccctacctgccccccaagaccatgaccagcaacctggagaagagcagccaggagcagctgctggatgctgcccaccaccgccactggccaggagtgctgaaggtggtgtctggctgccacatcagcctcttccagatccccctgcctgaagatggcatgcagtttggaggctccatgagcctgcacggcaaccacatgaccctggcctgcttccacggccccaacttccgcagcaagtcctgggccctcttccacctggaggagcccaacatcgccttctggacagaggcccagaagatctgggaggatggcagcagtgaccacagcacctacatcgtgcagaccctggacttccacctgggccacaacaccatggtgaccaagccctgtggggccctggagagccccatggccaccatcaccaagatcaccaggagaagacatgaaaatcctcctcatggagtggcctctgtgaaggagtggttcaactacgtgacagccaccagaaatgaggagctgaacctgctgagaaatgtggatgccaacaacacagagaacagcaccaccgtgaagaacagcagcctgctgagcggcttccggggcggcagcagctacaaccatgaaacagagaccatctttgccctgcccaggatgcagctggacttcaagagcatccacgtgcaggagccccaggagcccagcctgcaggatgccagcctgaagcccaaggtggagtgcagcgtggtgacagagttcacagaccacatctgtgtgaccatggatgctgagctgatcatgttcctgcatgacctggtgtctgcctacctgaaggagaaggagaaggccatcttccccccacgcatcctgagcaccaggcctggccagaagagccccatcatcatccatgatgacaacagcagtgacaaggaccgggaggacagcatcacctacaccaccgtggactggagggacttcatgtgcaacacctggcacctggagcccaccctgcggctcatctcctggacaggcaggaagattgatcctgtgggcgtggactacatcctgcagaagctgggcttccaccacgcccggaccaccatccccaagtggctgcagaggggcgtgatggaccccctggacaaggtgctgtctgtgctgatcaagaagctgggcacagccctgcaggatgagaaggagaagaagggcaaggacaaggaggagcactag

SEQ ID NO: 165855 - DNA, 5805 bp, Artificial Sequence
  Description of Artificial Sequence: Synthetic coding sequence
atgcctggggccaggagaagaagaagaggagctgccatggagggcaagcccagggctggggtggccctggcccctggccccagcggccggcggcccagcgcccgctgtgccaggagaagaagacctggcctgctgctgcccggcctgtggctgctgctgctggcccggcctgccagctgtgccccagatgagctgagccctgagcagcacaacctgagcctgtacagcatggagctggtgctgaagaagagcacaggccacagcgctgcccaggtggccctgacagaaacagcccctggcagccagcacagcagccccctgcacgtgacagccccacccagcgccaccacctttgacacagccttcttcaaccagggcaagcagaccaagagcacagctgaccccagcatctttgtggccacctacgtgtctgtgaccagcaaggaggtggccgtgaatgatgatgagatggacaacttcctgcctgacacccactggaccacccccaggatggtgagccccatccagtacatcaccgtgagccccccaggcctgccccgggaggccctggagcccatgctgacccccagcctgcccatggtgtccctgcaggatgaggaggtgaccagcggctggcagaacaccacccggcagcctgctgcctatgcagagagcgccagccacttccacaccttccgcagcgccttccgcaccagcgagggcatcgtgcccaccccaggcaggaacctggtgctgtaccccacagatgcctacagccacctgagcagcaggaccctgcctgagatcgtggccagcctgacagagggcgtggagaccaccctcttcctgagcagccgcagcctgatgccccagcccctgggagatggcatcaccatccccctgcccagcctgggggaggtgtcccagcccccagaggaggtgtgggccaccagcgctgaccgctacacagatgtgaccaccgtgctgagccagagcctggaggagaccatcagccccaggacctaccccaccgtgacagccagccacgccgccctggccttcagcaggacccacagccccctgctgagcacccccctggcctttgccagcagcgccagccccacagatgtgagcagcaaccccttcctgcccagcgacagcagcaagaccagcgagctgcacagcaacagcgccctgcccggccctgtggacaacacccacatcctgagccctgtgagcagcttccggccctacacctggtgtgccgcctgcaccgtgcccagcccccagcaggtgctggccaccagcctgatggagaaggatgtgggcagcggagatggagctgagaccctgtgcatgacagtgctggaggagagcagcatcagcctgatgagctctgtggtggccgacttcagcgagtttgaggaggacccccaggtgttcaacaccctcttccccagccggcccatcgtgcccctgagcagccgctccatggagatcagcgagacctctgtgggcatctctgctgaggtggacatgagctctgtgaccaccacccaggtgcccccagcccacggccgcctgtctgtgcctgccagcctggaccccacagctggcagcctgtctgtggccgagacccaggtgacccccagctctgtgaccacagccttcttcagcgtcatcaccagcatcctgctggacagcagcttctctgtgattgccaacaagaacacccccagcctggccgtgcgggaccccagcgtcttcaccccctacagcctggtgcccagcgtggagagcagcctcttcagtgaccaggagaggagcagcttcagcgagcacaagcccaggggggccctggactttgccagcagcttcttcagcaccccacccctggagctgagcggcagcatcagcagccccagcgaggccccagccagcctgagcctgatgcccagcgacctgagccccttcaccagccagagcttcagccccctggtggagaccttcaccctgtttgacagcagtgacctgcagagcagccagctgagcctgcccagcagcaccaacctggagttcagccagctgcagcccagcagcgagctgcccctgaacaccatcatgctgctgcccagccgctctgaggtgagcccctggagcagcttccccagcgacagcctggagtttgtggaggccagcacagtgtccctgacagacagcgaggcccacttcaccagcgccttcatcgagaccaccagctacctggagagcagcctcatcagccatgagagcgctgtgacagccctggtgcccccaggcagcgagagctttgacatcctgacagctggcatccaggccaccagccccctgaccaccgtgcacaccacccccatcctgacagagagcagcctcttcagcaccctgaccccaccagatgaccagatcagcgccctggatggccacgtgtctgtgctggccagcttcagcaaggccatccccaccggcaccgtgctgatcacagatgcctacctgcccagcggcagcagctttgtgtctgaggccacccccttccccctgcccacagagctgactgtggtgggccccagcctgacccccacagaggtgcccctgaacaccagcacagaggtgtccaccaccagcactggagctgccaccggcggccccctggacagcaccctgatgggagatgctgccagccagagccccccagagagcagcgctgccccacccctgcccagcctgcggcctgtgacagccttcaccctggaggccaccgtggacacccccaccctggccacagccaagccaccctacgtgtgtgacatcaccgtgcctgatgcctacctgatcaccaccgtgctggccaggagagctgtgcaggagtacatcatcacagccatcaaggaggtgctgcgcatccacttcaacagagctgtggagctgaaggtgtatgagctgttcacagacttcaccttcctggtgaccagcggcccctttgtgtacacagccatcagcgtcatcaacgtgctgatcaacagcaagctggtgcgggaccagacccccctcatcctgtctgtgaagcccagcttcctggtgcctgagagccgcttccaggtgcagacagtgctgcagtttgtgccccccagcgtggacaccggcttctgcaacttcacccagagaattgagaagggcctgatgacagccctgtttgaggtgaggaagcaccaccagggcacctacaacctgactgtgcagatcctgaacatcaccatcagcagcagccgggtgaccccccggcggggccctgtgaacatcatctttgctgtgaagagcacccagggcttcctgaatggcagcgaggtgtctgagctgctgaggaacctgtctgtggtggagttctccttctacctgggctaccctgtgctgcagattgctgagcccttccagtacccccagctgaacctgagccagctgctgaagagctcctgggtgaggacagtgctgctgggcgtgatggagaagcagctgcagaatgaggtgttccaggccgagatggagaggaagctggcccagctgctgtctgaggtgtccaccaggaggaggatgtggaggcgggccaccgtggccgccggcaacagcgtggtgcaggtggtgaatgtgtcccggctggagggagatgacaaccctgtgcagctgatctactttgtggaggaccaggatggagagcggctgtctgctgtgaagagcagtgacctgatcaacaagatggacctgcagagagctgccatcatcctgggctaccgcatccagggcgtcatcgcccagcctgtggacagagtgaagaggcccagccctgagagccagagcaacaacctgtgggtgattgtgggcgtggtgattcctgtgctggtggtgatggtgattgtggtgatcctgtactggaagctgtgcaggacagacaagctggacttccagcctgacacagtggccaacatccagcagaggcagaagctgcagatccccagcgtgaagggctttgattttgccaagcagcacctgggccagcacaacaaggatgacatcctgatcatccacgagcccgcccccctgcccggccccctgaaggaccacaccacccccagtgaaaatggagatgtgcccagccccaagagcaagatccccagcaagaatgtgcgccaccggggccgggtgagccccagtgatgctgacagcacagtgtctgaggagagcagcgagagagatgctggggacaagaccccaggagctgtgaatgatggccgcagccaccgggccccccagagcggcccccccctgcccagcagtggaaatgagcagcacagcagcgccagcatctttgagcacgtggaccgcatcagcaggcctcctgaggccagccggcgggtgcccagcaagatccagctgattgccatgcagcccatcccagcccctcctgtgcagaggcccagccctgctgacagagtggccgagagcaacaagatcaacaaggagatccagacagccctgcggcacaagtcagaaattgagcaccacaggaacaagatccggctgcgggccaagagaagaggccactatgagttccctgtggtggatgacctgagcagcggggacaccaaggagcggcaccgggtgtaccgccgggcccagatgcagattgacaagatcctggaccccacagcctctgtgcccagcgtcttcatcgagcccaggaagagcagccgcatcaagaggagccccaagcccaggaggaagcaccaggtgaatggctgcccagcagatgctgagaaggacaggctcatcaccacagacagtgatggcacctacagaagacctcctggggtgcacaacagcgcctacatcggctgccccagcgaccctgacctgcctgcagatgtgcagacccccagctctgtggagctgggccgctacccagccctgcccttccctgccagccagtacatccccccccagcccagcattgaggaggcccggcagaccatgcacagcctgctggatgatgcctttgccctggtggcccccagcagccagcctgccagcacagctggggtgggccctggggtgcccccaggcctgcctgccaacagcacccccagccaggaggagcggcgggccacccagtggggcagcttctacagccctgcccagacagccaacaacccctgcagccgctatgaggactatggcatgaccccacccaccggccccctgccccggcccggcttcggccctggcctgctgcagagcacagagctggtgcccccagacccccagcagccccaggccagcgctgaggccccctttgctgcccggggcatctacagcgaggagatgcccagcgtggcccggcccaggcctgtgggcggcaccaccggcagccagatccagcacctgacccaggtgggcatcgccagcagaattggagcccagcctgtggagatcccccccagccggggcagccagtatggaggccctggctggcccagctatggagaagatgaagctggaagaagagaggccgtgcccaggaccagcggccgggagcccagcgcccccagcggcaacctgccccaccggggcctgcagggccctggcctgggctaccccaccagcagcacagaggacctgcagcccggccacagcagcgccagcctcatcaaggccatccgggaggagctgctgcggctgagccagaagcagagcacagtgcagaacttccacagctag

SEQ ID NO: 165856 - DNA, 252 bp, Artificial Sequence
  Description of Artificial Sequence: Synthetic coding sequence
atgggcggcctcttcagccgctggaggaccaagcccagcacagtggaggtgctggagagcattgacaaggagatccaggccctggaggagttccgggagaagaaccagaggctgcagaagctgtgggtgggccgcctcatcctgtacagctctgtgctgtacctgttcacctgcctgattgtgtacctgtggtacctgcctgatgagttcaccgcccggctggccatgaccctgcccttctttgccttctag

SEQ ID NO: 165857 - DNA, 3090 bp, Artificial Sequence
  Description of Artificial Sequence: Synthetic coding sequence
atgctgttccgggcccggggccctgtgcggggccggggctggggccggcctgctgaggccccccggcggggccgcagccccccctggagccctgcctggatctgctgctgggccctggccggctgccaggccgcctgggccggggacctgcccagcagcagcagccggcccctgcccccctgccaggagaaggactaccactttgagtacacagaatgtgacagcagcggcagccgctggagggtggccatccccaacagcgctgtggactgcagcggcctgcctgaccctgtgcggggcaaggagtgcaccttcagctgtgccagcggggagtacctggagatgaagaaccaggtgtgcagcaaatgtggggagggcacctacagcctgggcagcggcatcaagtttgatgagtgggatgagctgcctgctggcttcagcaacatcgccaccttcatggacacagtggtgggccccagcgacagcaggccagatggctgcaacaacagctcctggatcccccggggcaactacatcgagagcaacagagatgactgcaccgtgtccctcatctatgctgtgcacctgaagaagagcggctacgtgttctttgagtaccagtatgtggacaacaacatcttctttgagttcttcatccagaatgaccagtgccaggagatggacaccaccacagacaagtgggtgaagctgacagacaacggggagtggggcagccacagcgtgatgctgaagagcggcaccaacatcctgtactggaggaccaccggcatcctgatgggcagcaaggctgtgaagcctgtgctggtgaagaacatcaccattgaaggagtggcctacaccagcgagtgcttcccctgcaagccaggcaccttcagcaacaagccaggcagcttcaactgccaggtgtgccccaggaacacctacagcgagaagggggccaaggagtgcatccgctgcaaggatgacagccagttcagcgaggagggcagcagtgaatgtacagagcggcccccctgcaccaccaaggactacttccagatccacaccccctgtgatgaggagggcaagacccagatcatgtacaagtggattgagcccaagatctgccgggaggacctgacagatgccatccggctgcccccatctggagagaagaaggactgccccccctgcaaccctggcttctacaacaacggcagcagcagctgccacccctgccccccaggcaccttcagtgatggcaccaaggagtgccggccctgcccagctggaacagagcccgccctgggctttgagtacaagtggtggaatgtgctgcccggcaacatgaagaccagctgcttcaacgtgggcaacagcaaatgtgatggcatgaatggctgggaggtggccggggaccacatccagagcggggccggcggcagtgacaatgactacctgatcctgaacctgcacatccctggcttcaagccacccacctccatgactggagccaccggcagcgagctgggccgcatcacctttgtgtttgagaccctgtgcagcgctgactgtgtgctgtacttcatggtggacatcaacaggaagagcaccaacgtggtggagagctggggcggcaccaaggagaagcaggcctacacccacatcatcttcaagaatgccaccttcaccttcacctgggccttccagaggaccaaccagggccaggacaacagacgcttcatcaatgacatggtgaagatctacagcatcacagccaccaatgctgtggatggagtggccagcagctgccgggcctgtgccctgggcagcgagcagagcggcagcagctgtgtgccctgccccccaggccactacatcgagaaggagaccaaccagtgcaaggagtgccccccagacacctacctgagcatccaccaggtgtatggcaaggaggcctgcatcccctgtggccctggcagcaagaacaaccaggaccacagcgtgtgctacagcgactgcttcttctaccacgagaaggagaaccagagcctgcactatgacttcagcaacctgagctctgtgggcagcctgatgaatggccccagcttcaccagcaagggcaccaagtacttccacttcttcaacatcagcctgtgtggccacgagggcaagaagatggccctgtgcaccaacaacatcacagacttcaccgtgaaggagatcgtggccggcagtgatgactacaccaacctggtgggcgcctttgtgtgccagagcaccatcatccccagcgagagcaagggcttccgggccgccctgagcagccagagcatcatcctggccgacaccttcatcggcgtgacagtggagaccaccctgaagaacatcaacatcaaggaggacatgtttcctgtgcccaccagccagatcccagatgtgcacttcttctacaagagcagcacagccaccaccagctgcatcaatggccgcagcacagctgtgaagatgcgctgcaaccccaccaagagcggggccggggtcatctctgtgcccagcaagtgcccagctggcacctgtgatggctgcaccttctacttcctgtgggagagcgctgaggcctgccccctgtgcacagaacatgacttccacgagattgagggcgcctgcaagaggggcttccaggagaccctgtatgtgtggaatgagcccaagtggtgcatcaagggcatcagcctgcctgagaagaagctggccacctgtgaaacagtggacttctggctgaaggtgggcgctggggtgggcgccttcaccgctgtgctgctggtggccctgacctgctacttctggaagaagaaccagaagctggagtacaagtacagcaagctggtgatgaccaccaacagcaaagaatgtgagctgcctgctgctgacagctgtgccatcatggagggggaggacaatgaggaggaggtggtgtacagcaacaagcagagcctgctgggcaagctgaagagcctggccaccaaggagaaggaggaccactttgagagcgtgcagctgaagaccagccgcagccccaacatctag

SEQ ID NO: 165858 - DNA, 11043 bp, Artificial Sequence
  Description of Artificial Sequence: Synthetic coding sequence
atggaccagaggaagaatgaaagcatcgtgcccagcatcacccagctggaggacttcctgacagagcacaacagcaatgtggtgtggctgctggtggccaccatcctgagctgtggctggatcatctacctgacctactacaacagcagaaatgtgggcctcatcctgaccctggtgctgaacagactctacaagcacggctacatccacatcggcagcttctccttctctgtgctgagcggcaaggtgatggtgcgggagatctactacatcacagaggacatgagcatccgcatccaggacggcttcatcatcttccgctggtggaagatgtacaaccccaagcagaagcagcacgaccccaaggccgagacccggctgtacatcaccgtgaatgactttgagttccacgtgtacaacagaagtgacctgtatggccgcctgcaggagctgtttggcctggagcccaccatcatcccccccaagaaggatgatgacaagacccgggagattggaagaaccaggacccagagcaagattgaaagagtgaaggtgaagacagagagccaggaccccaccagctcctggaggagcctcatccctgtgatcaaggtgaatgtgtccacaggccgcctggccttcggcaaccactaccagccccagaccctgtgcatcaactttgatgatgccttcctgacctacaccaccaagccacccagcagccacctggaccagttcatgcacatcgtgaagggcaagctggagaatgtgcgggtgatgctggtgcccagccccaggtatgtgggcctgcagaatgatgagcccccccggctgatgggagagggctttgtggtgatgcagagcaatgatgtggacatctactactacatggatgagcccggcctggtgcctgaggagacagaagaaaatattgaaggagagatgagcagcgaggactgcaagctgcaggacctgcccccctgctggggcctggacatcgtgtgtgggaaaggaacagacttcaactacggcccctgggccgaccggcagagggactgcctgtggaagttcttcttccccccagactaccaggtgctgaaggtgtctgaaattgcccagcccggccggccccggcagatcctggcctttgagctgaggatgaacatcatcgcagatgccaccatcgacctgctcttcaccaagaaccgggagaccaatgctgtgcacgtgaatgtgggcgccggcagctacctggagatcaacatccccatgacagtggaggagaatggctacaccccagccatcaagggccagctgctgcacgtggatgccaccacctccatgcagtaccgcaccctgctggaggccgagatgctggccttccacatcaatgccagctacccccgcatctggaacatgccccagacctggcagtgtgagctggaggtgtacaaggccacctaccacttcatctttgcccagaagaacttcttcacagacctgatccaggactggagcagtgacagccccccagacatcttctcctttgtgccctacacctggaacttcaagatcatgttccaccagtttgagatgatctgggccgccaaccagcacaactggattgactgcagcaccaagcagcaggagaatgtgtacctggccgcctgtggggagaccctgaacatcgacttcagcctgcccttcacagactttgtgcctgccacctgcaacaccaagttcagcctgcggggggaggatgtggacctgcacctgttcctgcctgactgccaccccagcaagtacagcctcttcatgctggtgaagaactgccaccccaacaagatgattcatgacaccggcatcccagctgagtgccagagcggccagaagacagtgaagcccaagtggagaaatgtgacccaggagaagagcggctgggtggagtgctggacagtgcccagcgtgatgctgaccatcgactacacctggcaccccatctacccccagaaggcagatgagcagctgaagcagagcctgtctgagatggaggagaccatgctgtctgtgctgcggcccagccagaagaccagtgacagagtggtgagcagccccagcaccagcagcaggcctcccatcgaccccagcgagctgcccccagacaagctgcacgtggagatggagctgagcccagacagccagatcaccctgtatggccccctgctgaatgccttcctgtgcatcaaggagaactactttggagaagatgacatgtacatggactttgaggaggtgatcagcagccctgtgctgagcctgagcaccagcagcagcagcggctggacagctgtgggcatggagaatgacaagaaggaaaatgaaggcagcgccaagagcatccaccccctggccctgcggccctgggacatcaccgtgctggtgaacctgtacaaggtgcacggccgcctgcctgtgcacggcaccacagatggcccagaatgtcccacagccttcctggagcggctgtgctttgagatgaagaagggcttccgggagaccatgctgcagctgatcctgagccccctgaatgtgtttgtgtctgacaactaccagcagaggcctcctgtggatgaggtgctgcgggagggccacatcaacctgagcggcctgcagctgcgggcccacgccatgttttctgctgagggcctgcccctgggcagtgacagcctggagtatgcctggctgattgatgtgcaggccggcagcctgacagccaaggtgacagccccccagctggcctgcctgctggagtggggccagacctttgtgttccacgtggtgtgccgggagtatgagctggagcggcccaagagcgtcatcatctgccagcacggcatcgaccggcgcttctgtgagagcaagctgagctgcatccctggcccctgccccaccagtgatgacctgaagtacaccatgatccggctggccgtggatggagctgacatctacatcgtggagcacggctgtgccaccaacatcaagatgggcgccatccgggtggccaactgcaacctgcacaaccagagcgtgggggagggcatctctgctgccatccaggacttccaggtgcggcagtacatcgagcagctgaacaactgcagaattggcctgcagcctgctgtgctgcggcgggcctactggctggaggccggcagcgccaacctgggcctcatcaccgtggacatcgccctggccgctgaccaccacagcaagcatgaggcccagaggcacttcctggagacccatgatgcccggaccaagaggctgtggttcctgtggccagatgacatcctgaagaacaagcgctgcaggaacaagtgtggctgcctgggcggctgccgcttcttcggcggcaccgtgacaggcctggacttcttcaagctggaggagctgacccccagcagcagcagcgccttcagcagcaccagcgctgagagtgacatgtactacggccagagcctgctgcagcctggagagtggatcatcaccaaggagatccccaagatcattgatggaaatgtgaatggcatgaagaggaaggagtgggagaacaagtctgtgggcatcgaggtggagaggaagacccagcacctgagcctgcaggtgcccctgcggagccacagcagcagcagcagcagcgaggagaacagcagcagcagcgctgcccagcccctgctggccggggagaaggagagccccagctctgtggctgatgaccacctggtgcagaaggagttcctgcacggcaccaagagagatgatggccaggccagcatccccacagagatcagcggcaacagccctgtgagccccaacacccaggacaagtctgtgggccagagccccctgcggagccccctgaagaggcaggcctctgtgtgcagcacccggctgggcagcaccaagagcctgacagctgccttctatggagacaagcagcctgtgacagtgggcgtgcagttcagcagtgatgtgtccagaagtgatgaaaatgtgctggacagccccaagcagaggaggagctttggcagcttcccctacacccccagcgctgacagcaacagcttccaccagtaccgctccatggacagctccatgtccatggctgacagcgaggcctacttctctgctgctgaggagtttgagcccatcagcagtgatgagggccctggcacctacccaggcaggaagaagaagaagaagcagacccagcagattgactacagccggggcagcatctaccacagcgtggagggccccctgaccggccacggggagagcatccaggacagcaggaccctgcccttcaagacccaccccagccaggccagctttgtgtctgccctgggcggggaggatgatgtgattgagcacctgtacatcgtggagggggagaagacagtggagagcgagcagatcaccccccagcagcctgtgatgaactgctaccagacctacctgacccagttccaggtgatcaactggagcgtgaagcaccccaccaacaagaggaccagcaagagcagcctgcaccggcccctggacctggacacccccaccagcgaggagagcagcagcagctttgagcagctgtctgtgcccaccttcaaggtgatcaagcagggcctgacagccaacagcctgctggaccggggcatgcagctgagcggcagcaccagcaacaccccctacacccccctggagaagaagctggccgacaacacagatgatgagaccctgacagaggagtggaccctggaccagcctgtgtcccagaccaggaccacagccatcgtggaggtgaagggcaccgtggacatcgtgctgacccccctggtggccgaggccctggaccgctacatcgaggccatggtgcactgtgccagcaccaggcaccctgctgccatcgtggatgacctgcacgccaaggtgctgcgggaggccgtgcagaacagcaagaccaccttcagcgagaacctgagcagcaagcaggacatccggggcaccaagacagagcagagcaccatcggcaccaccaaccagggccaggcccagaccaacctgaccatgaagcaggacaacgtgaccatcaagggcctgcagaccaacgtgtccatccccaaggtgaacctgtgcctgctgcaggcctctgtggaggagagccccaccacagcccccagccgctctgtgacccacgtgtccctggtggccctgtgctttgacagaattgccacccaggtgaggatgaacagaggagtggtggaggagaccagcaacaatgctgagcccggccgcaccagcaactttgaccgctacgtgcacgccaccaagatgcagccccagagcagcggcagcctgcggagcaatgctggagctgagaagggcaaggagattgctgccaagctgaacatccaccgggtgcacggccagctgcggggcctggacaccacagacatcggcacctgtgccatcacagccatcccctttgagaagagcaaggtgctcttcaccctggaggagctggatgagttcacctttgtggatgaaacagaccagcaggccgtgcctgatgtgaccagaattggccccagccaggagaagtggggctggatcatgtttgaatgtggcctggagaacctgaccatcaagggcggccggcagagcggggctgtgctgtacaacagctttggcatcatgggcaaggccagtgacacagagcggggcggcgtgctgaccagcaacaacagcagtgacagccccactggaagtggctacaacacagatgtgtctgatgacaacctgccctgtgacaggaccagccccagcagtgacctgaatggaaattctgtgtctgatgagcaggatgaaggagtggagagtgatgacctgaagaaggacctgcccctgatgcctcctcctccagacagctgcagcatgaagctgaccatcaaggagatctggttctcctttgctgcccccaccaacgtgcgcagccacacccacgccttcagccggcagctgaacctgctgagcacagccaccccagctgtgggcgcctggctggtgcccatcgaccagctgaagagcagcctgaacaagctggagacagagggcaccctgcgcatctgtgctgtgatgggctgcatcatgacagaggccctggagaacaagtctgtgcacttccccctgcggagcaagtacaaccggctgaccaaggtggcccgcttcctgcaggagaaccccagctgcctgctgtgcaacatcctgcaccactacctgcaccaggccaactacagcatcattgatgatgccaccatgtctgatggcctgcctgccctggtgaccctgaagaagggcctggtggccctggcccggcagtggatgaagttcatcgtggtgaccccagccttcaagggcgtgtccctgcacaggcctgcccagcccctgaagccccagatcgccatggaccatgaacatgaagatggcctgggcctggacaatggaggcggcctgcagagcgacaccagcgcagatggagctgagtttgaatttgatgctgccaccgtgtctgagcacaccatgctgctggagggcacagccaacagacctcctcctggcagcagcggccctgtgactggagctgagatcatgaggaagctgagcaagacccacacccacagcgacagcgccctgaagatcaagggcatccacccctaccacagcctgagctacaccagcggggacacagccacagacagccctgtgcacgtgggccgggccggcatgcctgtgaaggacagccccaggaaggagagcctgctgagctacctgaccggcagcttccccagcctgcacaacctgctggagggcaccccccagaggagcagcgctgctgtgaagagcagcagcctgaccaggactggaaacacagtggccacagacatgctgtctgagcaccccctgctgtctgagcccagctctgtgtccttctacaactggatgagcaatgctgtgggcaacagaggctctgtgctgcaggagagccctgtgaccaagagcggccacaacagcctgcccaccggggtggcccccaacctgcccaccatccccagcgccagtgacttcaacacagtgctgagcagtgaccagaacaccctggatggcacccacagccagcacagcaccagccaggatgatgtggccggcgtggaggaggccaaccagggcttccctgctgtgcagctggctgatgcccaggtggtgttcaagcccctgctgagccacacaggcatccagagccaggacaccatgcccttctgctacaggatgtactttggagagcacctgtccttcagcggcaccctggactgcctgcgggctgacatcgtggacagcgacacagccaaggagaggaagggcaagagggcccggcggcagggccacgtgaacctgccccccctggagttcaagccagccctgatgctgggcaccttcagcatctctgctgtggtgatggagaagtctgtgtgcaccccccagaacagcaccagcgccctgtccttccatgacctgagcaagcgctactacaacaccttccactgcaacttcaccatcagctgccagagcatcagccagcacgtggacatggccctggtgcggctcatccaccagttcagcaccatgattgatgacatcaaggccacccagacagacatcaagctgagccgctacacagctggcagcgccagccccacccccaccttcaagaccaggaagcaccgggacttccgcagcagtgacttcagccgcagcagccggggcagcctgaatggaggcaacagagtgaacaatgccaagaacaagaggaccaacaatgaaaacaacaagaaggagagcaggaacaagaacagcctgggccgctcagaaagaaggaccagcaaggtgtccaggaagggcagcaaggatgtggtggaccacatgaccatccacatggatgacagcgacagcatcaccgtgtctgagcagagcgagcccagcgctgagtgctggcagaacatgtacaagctgctgaacttctacagcctcatcagtgaccccaccggcatcctggagaagagcagcgagaccttcggccctgctggggtgcgcagccccacagagcccacctgcaaggtggtgtttgaaaatgagcaggacaacagcagcctgaccaagacccagaggaagaggagcctggtgaccagcgagccccagcacgtgaccctcatcgtgtttggcatcggcatggtgaacagaacccacctggaggccgacatcggcggcctgaccatggagagcgagctgaagagaattcatggcagcttcaccctgaaggagaagatgaaggatgtgctgcaccagaagatgacagagacctgtgccacagcccacatcggcggcgtgaacatcgtgctgctggagggcatcacccccaacatccagctggaggacttccccaccagccccaccagcacagccaagcaggagttcctgactgtggtgaagtgcagcatcgccaagagccaggccctgtacagcgcccagaggggcctgaagaccaacaatgctgctgtgttcaaggtgggcgccatcagcatcaacatcccccagcacccagccaccctgcacagcatgatggtgcgcagcagccaccagctgagcaagcagatcagtgacctgatccggcagcccagcacagccccccagcctgtgaaggaggacatcgccacccccctgcccagcgagaagacccccacctctgtgaaccagacccctgtggagaccaatgagttcccccagctgcctgagggcctggagaagaagcccatcgtgctgaagttcagcgccatgctggatggcatcgccatcggggccgccctgctgcccagcctgaaggccgagtacaagatgggccgcatgaggagccacggcatgaccggggcccagacccgcttcacctttgagctgcccaaccaccggctgcgcttcaccagcaaggtgtctgccacagacatgagcaccatcccccccagcgccagcctgaacctgccccctgtgaccatgtctgggaagtacatcatggaggagcatgacagctacagcgaccaggtgtggagcattgatgagctgcccagcaagcagggctactacctgcagggcaactacctgcgctgtgtggccgaggtgggcagctttgagcacaacctgaccacagacctgctgaaccacctggtgtttgtgcagaaggtgttcatgaaggaggtgaatgaggtgatccagaaggtgtctggaggagagcagcccatccccctgtggaatgaacatgatggaacagcagatggagacaagcccaagatcctgctgtacagcctgaacctgcagttcaagggcatccaggtgacagccaccacccccagcatgagagctgtgcgctttgagaccggcctgattgagctggagctgagcaaccggctgcagaccaaggccagccctggcagcagcagctacctgaagctgtttgggaagtgccaggtggacctgaacctggccctgggccagatcgtgaagcaccaggtgtatgaggaggccggcagtgacttccaccaggtggcctacttcaagaccagaattggcctgagaaatgccctgcgggaggagatcagcggcagcagtgaccgggaggccgtgctgatcaccctgaaccggcccatcgtgtatgcccagcctgtggcctttgacagagctgtgctcttctggctgaactacaaggccgcctatgacaactggaatgagcagaggatggccctgcacaaggacatccacatggccaccaaggaggtggtggacatgctgcccggcatccagcagaccagcgcccaggccttcggcaccctcttcctgcagctgactgtgaatgacctgggcatctgcctgcccatcaccaacacagcccagagcaaccacactggagacctggacaccggcagcgccctggtgctgaccatcgagagcaccctcatcacagcctgcagcagcgagagcctggtgtccaagggccacttcaagaacttctgcatccgctttgctgatggctttgagacctcctgggatgactggaagccagagatccacggggacctggtgatgaatgcctgtgtggtgcctgatggcacctatgaggtgtgcagcaggaccaccggccaggccgctgctgagagcagcagcgctggcacctggaccctgaatgtgctgtggaagatgtgtggcattgatgtgcacatggaccccaacatcggcaagaggctgaatgccctgggcaacaccctgaccaccctgactggagaggaggacattgatgacattgctgacctgaacagcgtgaacattgctgacctgagtgatgaagatgaggtggacaccatgagccccaccatccacacagaggccacagactaccgccggcaggccgccagcgccagccagcccggggagctgcggggcaggaagatcatgaagagaattgtggacatccgggagctgaatgagcaggccaaggtgattgatgacctgaagaagctgggcgccagcgagggcaccatcaaccaggagatccagcgctaccagcagctggagagcgtggccgtgaatgacatcagaagagatgtgaggaagaagctgcggcgcagctccatgagagctgccagcctgaaggacaagtggggcctgagctacaagcccagctacagccgcagcaagagcatcagcgccagcggccggccccccctgaagaggatggagcgggccagcagccgggtgggggagacagaggagctgcctgagatccgggtggatgctgccagccctggcccccgggtgaccttcaacatccaggacaccatcgccgagatccggaggaagaagatctccttcaaggtggtgttctag

SEQ ID NO: 165859 - DNA, 2241 bp, Artificial Sequence
  Description of Artificial Sequence: Synthetic coding sequence
atgccctgcctgggcctgctggccaacctgtgccgccacaacctgtctgtgcagacccacatcaagaccctgagcaatgtgaagagcttctaccgcaccctcatcaccctgctggcccacagcagcctgactgtggtggtgtttgccctgagcatcctgagcagcctgaccctgaatgaggaggtgggggagaagctgttccacgccaggaacatccaccagaccttccagctgatcttcaacatcctgatcaatggagatggcaccctgaccaggaagtacagcgtggacctgctgatggacctgctgaagaaccccaagattgctgactacctgaccaggtatgagcacttcagcagctgcctgcaccaggtgctgggcctgctgaatggcaaggaccctgacagcagcagcaaggtgctggagctgctgctggccttctgcagcgtgacccagctgcggcacatgctgacccagatgatgtttgagcagagccccccaggcagcgccaccctgggcagccacaccaagtgcctggagcccaccgtggccctgctgcgctggctgagccagcccctggatggcagcgagaactgcagcgtgctggccctggagctgttcaaggagatctttgaagatgtgattgatgctgccaactgcagcagcgctgacagatttgtgaccctgctgctgcccaccatcctggaccagctgcagttcacagagcagaacctggatgaggccctgaccaggaagaagtgtgaaagaattgccaaggccatcgaggtgctgctgaccctgtgtggagatgacaccctgaagatgcacatcgccaagatcctgaccaccgtgaagtgcaccaccctcatcgagcagcagttcacctacggcaagattgacctgggcttcggcaccaaggtggccgacagcgagctgtgcaagctggccgcagatgtgatcctgaagaccctggacctgatcaacaagctgaagcccctggtgcccggcatggaggtgtccttctacaagatcctgcaggaccccaggctcatcacccccctggcctttgccctgaccagtgacaaccgggagcaggtgcagagcggcctgcgcatcctgctggaggccgcccccctgcctgacttccctgccctggtgctgggggagagcattgctgccaacaatgcctaccggcagcaggagacagagcacatccccaggaagatgccctggcagagcagcaaccacagcttccccaccagcatcaagtgcctgaccccccacctgaaggatggagtgcccggcctgaacatcgaggagctgattgagaagctgcagagcggcatggtggtgaaggaccagatctgtgatgtgcgcatcagtgacatcatggatgtgtatgagatgaagctgagcaccctggccagcaaggagagccggctgcaggacctgctggagaccaaggccctggccctggcccaggccgaccggctgattgcccagcaccgctgccagaggacccaggccgagacagaggcccggaccctggcctccatgctgcgggaggtggagaggaagaatgaggagctgtctgtgctgctgaaggcccagcaggtggagagcgagcgggcccagagcgacatcgagcacctgttccagcacaacaggaagctggagagcgtggccgaggagcacgagatcctgaccaagagctacatggagctgctgcagagaaatgaaagcacagagaagaagaacaaggacctgcagatcacctgtgacagcctgaacaagcagatcgagaccgtgaagaagctgaatgaaagcctgaaggagcagaatgagaagagcatcgcccagctgattgagaaggaggagcagaggaaggaggtgcagaaccagctggtggaccgggagcacaagctggccaacctgcaccagaagaccaaggtgcaggaggagaagatcaagaccctgcagaaggagcgggaggacaaggaggagaccatcgacatcctgaggaaggagctgagcaggacagagcagatcaggaaggagctgagcatcaaggccagcagcctggaggtgcagaaggcccagctggagggccgcctggaggagaaggagagcctggtgaagctgcagcaggaggagctgaacaagcacagccacatgattgccatgatccacagcctgagcggcggcaagatcaaccctgagaccgtgaacctgagcatctag

SEQ ID NO: 165860 - DNA, 840 bp, Artificial Sequence
  Description of Artificial Sequence: Synthetic coding sequence
atgaccctgcccttctttgccttccccctcatcatctggagcatcagaactgtcatcatcttcttcttcagcaagaggacagaaagaaataatgaggccctggatgacctgaagagccagaggaagaagatcctggaggaggtgatggagaaggagacctacaagacagccaagctgatcctggagagatttgatcctgacagcaagaaggccaaggaatgtgagccccccagcgctggagctgctgtgacagcccggcccggccaggagatccggcagaggacagctgcccagaggaacctgagccccaccccagccagccccaaccagggccccccaccccaggtgcctgtgtccccaggcccccccaaggacagcagcgcccctgggggccccccagagaggacagtgaccccagccctgagcagcaatgtgctgcccaggcacctgggcagccctgccacctctgtgcccggcatgggcctgcaccccccaggcccccccctggcccggcccatcctgccccgggagcggggggccctggaccgcatcgtggagtacctggtgggagatggcccccagaacagatatgccctgatctgccagcagtgcttcagccacaacggcatggccctgaaggaggagtttgagtacatcgccttccgctgtgcctactgcttcttcctgaacccagccaggaagacccggccccaggccccccggctgcctgagttctcctttgagaagaggcaggtggtggagggcagcagctctgtgggccccctgcccagcggctctgtgctgagcagtgacaaccagttcaatgaggtgcagtactag

SEQ ID NO: 165861 - DNA, 3192 bp, Artificial Sequence
  Description of Artificial Sequence: Synthetic coding sequence
atgacccggctgggctggcccagcccctgctgtgccaggaagcagtgcagcgagggccgcacctacagcaatgctgtgatcagccccaacctggagaccacccgcatcatgagggtgagccacaccttccctgtggtggactgcacagctgcctgctgtgacctgagcagctgtgacctggcctggtggtttgagggccgctgctacctggtgtcctgcccccacaaggagaactgtgagcccaagaagatgggccccatccgcagctacctgacctttgtgctgcggcctgtgcagaggcctgcccagctgctggactatggagacatgatgctgaacagaggcagccccagcggcatctggggagacagccctgaggacatcaggaaggacctgaccttcctgggcaaggactggggcctggaggagatgtctgagtacagtgatgactaccgggagctggagaaggacctgctgcagcccagcggcaagcaggagccccggggcagcgctgagtacacagactggggcctgctgcccggcagcgagggcgccttcaacagctctgtgggggacagccctgctgtgcctgctgagacccagcaggaccctgagctgcactacctgaatgaaagtgccagcaccccagcccccaagctgcctgagaggtctgtgctgctgcccctgcccaccacccccagcagtggagaggtgctggagaaggagaaggccagccagctgcaggagcagagcagcaacagcagcggcaaggaggtgctgatgcccagccacagcctgcccccagccagcctggagctgagctctgtgacagtggagaagagccctgtgctgactgtgaccccaggcagcacagagcacagcatccccaccccacccaccagcgctgcccccagcgagagcacccccagcgagctgcccatcagccccaccacagcccccaggacagtgaaggagctgactgtgtctgctggggacaacctgatcatcaccctgcctgacaatgaggtggagctgaaggcctttgtggccccagcccctcctgtggagaccacctacaactatgagtggaacctgatcagccaccccacagactaccagggcgagatcaagcagggccacaagcagaccctgaacctgagccagctgtctgtgggcctgtatgtgttcaaggtgacagtgtccagtgaaaatgccttcggggagggctttgtgaatgtgacagtgaagccagccaggagagtgaacctgccccctgtggccgtggtgagcccccagctgcaggagctgaccctgcccctgaccagcgccctgattgatggcagccagagcacagatgacacagagatcgtgtcctaccactgggaggagatcaatggccccttcatcgaggagaagacctctgtggacagccctgtgctgcggctgagcaacctggaccccggcaactacagcttccggctgactgtgacagacagtgatggagccaccaacagcaccacagctgccctgattgtgaacaatgctgtggactacccacctgtggccaatgccggccccaaccacaccatcaccctgccccagaacagcatcaccctgaatggaaaccagagcagtgatgaccaccagatcgtgctgtatgagtggagcctgggccctggcagcgagggcaagcacgtggtgatgcagggcgtgcagaccccctacctgcacctgagcgccatgcaggagggggactacaccttccagctgaaggtgacagacagcagccggcagcagagcacagctgtggtgacagtgattgtgcagcctgagaacaacagacctcctgtggccgtggccggccctgacaaggagctgatcttccctgtggagagcgccaccctggatggcagcagcagcagtgatgaccacggcatcgtgttctaccactgggagcacgtgcggggccccagcgctgtggagatggagaacatcgacaaggccatcgccaccgtgacaggcctgcaggtgggcacctaccacttccggctgactgtgaaggaccagcagggcctgagcagcaccagcaccctgactgtggccgtgaagaaggagaacaacagccccccccgggcccgggccggcggccgccacgtgctggtgctgcccaacaacagcatcaccctggatggcagccgcagcacagatgaccagagaattgtgtcctacctgtggatcagagatggccagagccctgctgctggagatgtgattgatggcagtgaccacagcgtggccctgcagctgaccaacctggtggagggcgtgtacaccttccacctgcgggtgacagacagccagggcgccagtgacacagacacagccaccgtggaggtgcagcctgaccccaggaagagcggcctggtggagctgaccctgcaggtgggcgtgggccagctgacagagcagaggaaggacaccctggtgcggcagctggccgtgctgctgaatgtgctggacagcgacatcaaggtgcagaagatccgggcccacagcgacctgagcaccgtcatcgtgttctacgtgcagagccggccccccttcaaggtgctgaaggctgctgaggtggccaggaacctgcacatgaggctgagcaaggagaaggctgacttcctgctcttcaaggtgctgcgggtggacacagctggctgcctgctgaagtgcagcggccacggccactgtgaccccctgaccaagcgctgcatctgcagccacctgtggatggagaacctgatccagcgctacatctgggatggagagagcaactgtgagtggagcatcttctacgtgacagtgctggccttcaccctcatcgtgctgactggaggcttcacctggctgtgcatctgctgctgcaagaggcagaagaggaccaagatcaggaagaagaccaagtacaccatcctggacaacatggatgagcaggagaggatggagctgcggcccaagtatggcatcaagcacaggagcacagagcacaacagcagcctgatggtgtctgagagcgagtttgacagcgaccaggacaccatcttcagccgggagaagatggagcggggcaaccccaaggtgtccatgaatggcagcatcagaaatggagccagcttctcctactgcagcaaggacagatag

SEQ ID NO: 165862 - DNA, 1293 bp, Artificial Sequence
  Description of Artificial Sequence: Synthetic coding sequence
atgggccgctcctggccaggcctgagcctgtgccagtggaggctgctgcctgccctggaggccggctgggccgtggccgctgagactggaggcggcggccggcccggccgggccgccccagccagctgcagctgtgagttcctgtggaccattgatgacatctaccactgtgcccagttcctgcagatcaaggatggctggatcatcttctccatggaggcccggctggccatgaccctgcccttctttgccttccccctcatcatctggagcatccgcaccgtcatcatcttcttcttcagcaagaggacagagaggaacaatgaggccctggatgacctgaagagccagaggaagaagatcctggaggaggtgatggagaaggagacctacaagacagccaagctgatcctggagagatttgatcctgacagcaagaaggccaaggaatgtgagcccccatctgctggagctgctgtgacagcccggcccggccaggagatccggcagaggacagctgcccagaggaacctgagccccaccccagccagccccaaccagggccccccaccccaggtgcctgtgtccccaggcccccccaaggacagcagcgcccctgggggccccccagagaggacagtgaccccagccctgagcagcaatgtgctgcccaggcacctgggcagccctgccacctctgtgcccggcatgggcctgcaccccccaggcccccccctggcccggcccatcctgccccgggagcggggggccctggacagaattgtggagtacctggtgggagatggcccccagaacagatatgccctgatctgccagcagtgcttcagccacaacggcatggccctgaaggaggagtttgagtacatcgccttccgctgtgcctactgcttcttcctgaacccagccaggaagacccggccccaggccccccggctgcctgagttctcctttgagaagaggcaggtggtggagggcagcagctctgtgggccccctgcccagcggctctgtgctgagcagtgacaaccagttcaatgaggagagcctggagcatgatgtgctggatgacaacacagagcagacagatgacaagatcccagccacagagcagaccaaccaggtgattgagaaggccagtgacagcgaggagcctgaggagaagcaggagacagaaaatgaggaggcctctgtgattgagaccaacagcacagtgcctggagctgacagcatcccagaccctgagctgtctggagagagcctgacagctgagtag

SEQ ID NO: 165863 - DNA, 3036 bp, Artificial Sequence
  Description of Artificial Sequence: Synthetic coding sequence
atggcccccccaactggagtgctgagcagcctgctgctgctggtgaccatcgccggctgtgccaggaagcagtgcagcgagggccgcacctacagcaatgctgtgatcagccccaacctggagaccacccgcatcatgagggtgagccacaccttccctgtggtggactgcacagctgcctgctgtgacctgagcagctgtgacctggcctggtggtttgagggccgctgctacctggtgtcctgcccccacaaggagaactgtgagcccaagaagatgggccccatccgcagctacctgacctttgtgctgcggcctgtgcagaggcctgcccagctgctggactatggagacatgatgctgaacagaggcagccccagcggcatctggggagacagccctgaggacatcaggaaggacctgaccttcctgggcaaggactggggcctggaggagatgtctgagtacagtgatgactaccgggagctggagaaggacctgctgcagcccagcggcaagcaggagccccggggcagcgctgagtacacagactggggcctgctgcccggcagcgagggcgccttcaacagctctgtgggggacagccctgctgtgcctgctgagacccagcaggaccctgagctgcactacctgaatgaaagtgccagcaccccagcccccaagctgcctgagaggtctgtgctgctgcccctgcccaccacccccagcagcggggaggtgctggagaaggagaaggccagccagctgcaggagcagagcagcaacagcagcggcaaggaggtgctgatgcccagccacagcctgcccccagccagcctggagctgagctctgtgacagtggagaagagccctgtgctgactgtgaccccaggcagcacagagcacagcatccccaccccacccaccagcgctgcccccagcgagagcaccccatctgagctgcccatcagccccaccacagcccccaggacagtgaaggagctgactgtgtctgctggggacaacctgatcatcaccctgcctgacaatgaggtggagctgaaggcctttgtggccccagcccctcctgtggagaccacctacaactatgagtggaacctgatcagccaccccacagactaccagggcgagatcaagcagggccacaagcagaccctgaacctgagccagctgtctgtgggcctgtatgtgttcaaggtgacagtgtccagtgaaaatgcctttggagagggctttgtgaatgtgacagtgaagccagcccggcgggtgaacctgccccctgtggccgtggtgagcccccagctgcaggagctgaccctgcccctgaccagcgccctgattgatggcagccagagcacagatgacacagaaattgtgtcctaccactgggaggagatcaatggccccttcatcgaggagaagacctctgtggacagccctgtgctgcggctgagcaacctggaccccggcaactacagcttccggctgactgtgacagacagtgatggagccaccaacagcaccacagctgccctgattgtgaacaatgctgtggactacccacctgtggccaatgccggccccaaccacaccatcaccctgccccagaacagcatcaccctgaatggaaaccagagcagtgatgaccaccagatcgtgctgtatgagtggagcctgggccctggcagcgagggcaagcacgtggtgatgcagggcgtgcagaccccctacctgcacctgagcgccatgcaggagggggactacaccttccagctgaaggtgacagacagcagccggcagcagagcacagctgtggtgaccgtcatcgtgcagcctgagaacaaccggccccctgtggccgtggccggccctgacaaggagctgatcttccctgtggagagcgccaccctggatggcagcagcagcagtgatgaccatggaattgtgttctaccactgggagcacgtgcggggccccagcgctgtggagatggagaacatcgacaaggccatcgccaccgtgacaggcctgcaggtgggcacctaccacttccggctgactgtgaaggaccagcagggcctgagcagcaccagcaccctgactgtggccgtgaagaaggagaacaacagccccccccgggcccgggccggcggcagacatgtgctggtgctgcccaacaacagcatcaccctggatggcagccgcagcacagatgaccagagaattgtgtcctacctgtggatcagagatggccagagccctgctgctggagatgtgattgatggcagtgaccacagcgtggccctgcagctgaccaacctggtggagggcgtgtacaccttccacctgcgggtgacagacagccagggcgccagtgacacagacacagccaccgtggaggtgcagcctgaccccaggaagagcggcctggtggagctgaccctgcaggtgggcgtgggccagctgacagagcagaggaaggacaccctggtgcggcagctggccgtgctgctgaatgtgctggacagcgacatcaaggtgcagaagatccgggcccacagcgacctgagcacagtgattgtgttctacgtgcagagcaggcctcccttcaaggtgctgaaggctgctgaggtggccaggaacctgcacatgaggctgagcaaggagaaggctgacttcctgctcttcaaggtgctgcgggtggacacagctggctgcctgctgaagtgcagcggccacggccactgtgaccccctgaccaagcgctgcatctgcagccacctgtggatggagaacctgatccagcgctacatctgggatggagagagcaactgtggcatcaagcacaggagcacagagcacaacagcagcctgatggtgtctgagagcgagtttgacagcgaccaggacaccatcttcagccgggagaagatggagcggggcaaccccaaggtgtccatgaatggcagcatcagaaatggagccagcttctcctactgcagcaaggacagatag

SEQ ID NO: 165864 - DNA, 1206 bp, Artificial Sequence
  Description of Artificial Sequence: Synthetic coding sequence
atggagaccccagaggtgcctgtgggcagcctgattgactttggacctgaggcccccaccagcagccccctggaggcccctcctcctgtgctgcaggatggagatggcagcctgggagatggagccagcgagagcgagaccacagagagcgctgacagtgaaaatgacatgggagagagccccagccaccccagctgggaccaggaccggcgcagcagcagcaatgaaagcttcagcagcaaccagagcacagagagcacccaggatgaggagaccctggccctgcgggacttcatgaggggctacgtggagaagatcttctctggaggagaggacctggaccaggaggagaaggccaagtttggagagtactgcagcagtgaaaatggcaagggccgggagtggtttgcccgctacgtgtctgcccagcgctgcaacagcaaatgtgtgtctgaggccaccttctaccgcctggtgcagagctttgctgtggtgctgtttgagtgccaccagatggatgactttggacctgccaagaacctgatgaccatgtgcttcacctactaccacatcggcaagccccagctgctgcccccagagagccgggagaagccagctggcagcattgacagctacctgaagagcgccaacagctggctggccgagaagaaggacattgctgagcggctgctgaagaacaccagcgccaggacagaaaatgtgaagggcttctttggaggcctggagaccaagctgaagggccccctggccaggagaaatgaggaggatgagaacaagccccaggagaagaggcccagggctgtgacagcctacagcccagaagatgagaagaagggggagaagatctacctgtacacccacctgaagcagcagcccatctggcacaccctgcgcttctggaatgctgccttctttgatgctgtgcactgtgagaggaccaagaggagccccaccacccgggagaagtggtgccacatgacccaggaggagagagatgacagcctgcgcttcaatgaaaacatcaccttcggccagctgggcaccttcacccacaacatgctggccttcggcctgaacaagaagctgtgcaatgacttcctgaagaagcaggccgtcatcggcaacctggatgaggagcagtacaagctgctgagtgaccacatcgagcagatggccacagaatag

SEQ ID NO: 165865 - DNA, 3219 bp, Artificial Sequence; identical to SEQ ID NO: 165839
  Description of Artificial Sequence: Synthetic coding sequence

SEQ ID NO: 165866 - DNA, 1380 bp, Artificial Sequence
  Description of Artificial Sequence: Synthetic coding sequence
atgggcggcctcttcagccgctggaggaccaagcccagcacagtggaggtgctggagagcattgacaaggagatccaggccctggaggagttccgggagaagaaccagaggctgcagaagctgtgggtgggccgcctcatcctgtacagctctgtgctgtacctgttcacctgcctgattgtgtacctgtggtacctgcctgatgagttcaccgcccggctggccatgaccctgcccttctttgccttccccctcatcatctggagcatccgcaccgtcatcatcttcttcttcagcaagaggacagagaggaacaatgaggccctggatgacctgaagagccagaggaagaagatcctggaggaggtgatggagaaggagacctacaagacagccaagctgatcctggagagatttgatcctgacagcaagaaggccaaggaatgtgagcccccatctgctggagctgctgtgacagcccggcccggccaggagatccggcagaggacagctgcccagaggaacctgagccccaccccagccagccccaaccagggccccccaccccaggtgcctgtgtccccaggcccccccaaggacagcagcgcccctgggggccccccagagaggacagtgaccccagccctgagcagcaatgtgctgcccaggcacctgggcagccctgccacctctgtgcccggcatggagatgggcctgccccacatcgcccaggccggcctggagcacctgagcagcagtgacctgagcaccagcaccagccagagcgctggcatcaccggcctgcaccccccaggcccccccctggcccggcccatcctgccccgggagcggggggccctggaccgcatcgtggagtacctggtgggagatggcccccagaacagatatgccctgatctgccagcagtgcttcagccacaacggcatggccctgaaggaggagtttgagtacatcgccttccgctgtgcctactgcttcttcctgaacccagccaggaagacccggccccaggccccccggctgcctgagttctcctttgagaagaggcaggtggtggagggcagcagctctgtgggccccctgcccagcggctctgtgctgagcagtgacaaccagttcaatgaggagagcctggagcatgatgtgctggatgacaacacagagcagacagatgacaagatcccagccacagagcagaccaaccaggtgattgagaaggccagtgacagcgaggagcctgaggagaagcaggagacagaaaatgaggaggccagcgtcatcgagaccaacagcacagtgcctggagctgacagcatcccagaccctgagctgagcggggagagcctgacagctgagtag

SEQ ID NO: 165867 - DNA, 240 bp, Artificial Sequence
  Description of Artificial Sequence: Synthetic coding sequence
atgcacccagacctgagcccccacctgcacacagaagaatgtaatgtgctgatcaacctgctgaaggagtgccacaagaaccacaacatcctgaagttcttcggctactgcaatgatgtggaccgggagctgaggaagtgcctgaagaatgaatatgtggagaacagaaccaagagccgggagcacggcatcgccatgaggaagaagctgttcaaccccccagaggagagcgagaagtag

SEQ ID NO: 165868 - DNA, 1569 bp, Artificial Sequence
  Description of Artificial Sequence: Synthetic coding sequence
atgagccggcagctgctgcctgtgctgctgctgctgctgctgcgggccagctgcccctggggccaggagcagggcgcccggagccccagcgaggagcccccagaggaggagatccccaaggaggatggcatcctggtgctgagccgccacaccctgggcctggccctgcgggagcacccagccctgctggtggagttctacgccccctggtgtggccactgccaggccctggcccctgagtacagcaaggctgctgctgtgctggccgctgagagcatggtggtgaccctggccaaggtggatggccctgcccagcgggagctggccgaggagtttggagtgacagagtaccccaccctgaagttcttcagaaatggaaacagaacccaccctgaggagtacacaggccccagagatgctgagggcattgctgagtggctgcggaggagagtgggccccagcgccatgaggctggaggatgaggccgccgcccaggccctgattggaggccgggacctggtggtgattggcttcttccaggatgaagatgtggccaccttcctggccctggcccaggatgccctggacatgaccttcggcctgacagaccggcccaggctcttccagcagtttggcctgaccaaggacacagtggtgctcttcaagaagtttgatgagggccgggctgacttccctgtggatgaggagctgggcctggacctgggggacctgagccgcttcctggtgacccacagcatgaggctggtgacagagttcaacagccagaccagcgccaagatctttgctgcccgcatcctgaaccacctgctgctgtttgtgaaccagaccctggccgcccaccgggagctgctggccggctttggagaggccgccccccgcttccggggccaggtgctgtttgtggtggtggatgtggccgctgacaatgagcacgtgctgcagtacttcggcctgaaggccgaggccgcccccaccctgcggctggtgaacctggagaccaccaagaagtatgcccctgtggatggcggccctgtgacagctgccagcatcacagccttctgccacgctgtgctgaatggccaggtgaagccctacctgctgagccaggagatccccccagactgggaccagaggcctgtgaagaccctggtgggcaagaactttgagcaggtggcctttgatgagaccaagaatgtgtttgtgaagttctacgccccctggtgcacccactgcaaggagatggccccagcctgggaggccctggccgagaagtaccaggaccacgaggacatcatcatcgccgagctggatgccacagccaatgagctggatgcctttgctgtgcacggcttccccaccctgaagtacttccctgctggccctggcaggaaggtgattgagtacaagagcacccgggacctggagaccttcagcaagttcctggacaatggaggagtgctgcccacagaggagcccccagaggagcctgctgcccccttccctgagcccccagccaacagcaccatgggcagcaaggaggagctgtag

SEQ ID NO: 165869 - DNA, 1485 bp, Artificial Sequence
  Description of Artificial Sequence: Synthetic coding sequence
atgggcagcggcactggaagtgaggagcccctgggcggggccagcagaggaggcaacccccagggcggctgggacctgggcgctgagcccccccaccctggccctggccctgctggggccccctgcccagctgggggcatcctgtgccctgtggtgtgggccctgcccggccctggcccccgggtgcagcagggcagctgccgggcccggggccgggtgaatggaggccacgccgaggagtttggagtgacagagtaccccaccctgaagttcttcagaaatggaaacagaacccaccctgaggagtacacaggccccagagatgctgagggcattgctgagtggctgcggcggcgggtgggccccagcgccatgaggctggaggatgaagctgctgcccaggccctgattggaggccgggacctggtggtgattggcttcttccaggacctgcaggatgaagatgtggccaccttcctggccctggcccaggatgccctggacatgaccttcggcctgacagaccggcccaggctcttccagcagtttggcctgaccaaggacacagtggtgctcttcaagaagtttgatgagggccgggctgacttccctgtggatgaggagctgggcctggacctgggggacctgagccgcttcctggtgacccacagcatgaggctggtgacagagttcaacagccagaccagcgccaagatctttgctgcccgcatcctgaaccacctgctgctgtttgtgaaccagaccctggccgcccaccgggagctgctggccggctttggagaggccgccccccgcttccggggccaggtgctgtttgtggtggtggatgtggccgctgacaatgagcacgtgctgcagtacttcggcctgaaggccgaggccgcccccaccctgcggctggtgaacctggagaccaccaagaagtatgcccctgtggatggcggccctgtgacagctgccagcatcacagccttctgccacgctgtgctgaatggccaggtgaagccctacctgctgagccaggagatccccccagactgggaccagaggcctgtgaagaccctggtgggcaagaactttgagcaggtggcctttgatgagaccaagaatgtgtttgtgaagttctacgccccctggtgcacccactgcaaggagatggccccagcctgggaggccctggccgagaagtaccaggaccacgaggacatcatcatcgccgagctggatgccacagccaatgagctggatgcctttgctgtgcacggcttccccaccctgaagtacttccctgctggccctggcaggaaggtgattgagtacaagagcacccgggacctggagaccttcagcaagttcctggacaatggaggagtgctgcccacagaggagcccccagaggagcctgctgcccccttccctgagcccccagccaacagcaccatgggcagcaaggaggagctgtag

SEQ ID NO: 165870 - DNA, 1323 bp, Artificial Sequence
  Description of Artificial Sequence: Synthetic coding sequence
atggccctgctggtgctgggcctggtgtcctgcaccttcttcctggccgtgaatggcctgtacagcagcagtgatgatgtgattgagctgacccccagcaacttcaaccgggaggtgatccagagcgacagcctgtggctggtggagttctacgccccctggtgtggccactgccagaggctgaccccagagtggaagaaggccgccacagccctgaaggatgtggtgaaggtgggcgctgtggatgctgacaagcaccacagcctgggcggccagtatggagtgcagggcttccccaccatcaagatcttcggcagcaacaagaacagacctgaggactaccagggcggccgcactggagaggccatcgtggatgctgccctgagcgccctgcggcagctggtgaaggaccggctgggcggccgcagcggcggctacagcagcggcaagcagggccgcagtgacagcagcagcaagaaggatgtgattgagctgacagatgacagctttgacaagaatgtgctggacagtgaagatgtgtggatggtggagttctacgccccctggtgtggccactgcaagaacctggagcctgagtgggccgctgctgccagcgaggtgaaggagcagaccaagggcaaggtgaagctggccgctgtggatgccaccgtgaaccaggtgctggccagccgctatggcatccggggcttccccaccatcaagatcttccagaagggggagagccctgtggactatgatggcggccgcaccaggagtgacatcgtgtcccgggccctggacctcttcagtgacaatgcccctcctcctgagctgctggagatcatcaatgaagacatcgccaagaggacctgtgaggagcaccagctgtgtgtggtggccgtgctgccccacatcctggacaccggggctgctggaagaaattcctacctggaggtgctgctgaagctggccgacaagtacaagaagaagatgtggggctggctgtggacagaagctggggcccagagcgagctggagacagccctgggcattggaggcttcggctacccagccatggccgccatcaatgccaggaagatgaagtttgccctgctgaagggcagcttcagcgagcagggcatcaatgagttcctgcgggagctgagctttggccggggcagcacagcccctgtgggcggcggggccttccccaccatcgtggagcgggagccctgggatggaagagatggagagctgcctgtggaggatgacatcgacctgagtgatgtggagctggatgacctgggcaaggatgagctgtag

SEQ ID NO: 165871 - DNA, 1338 bp, Artificial Sequence
  Description of Artificial Sequence: Synthetic coding sequence
atgtaccccagcaccaccatggccaatgcccctggcctggtgtcctgcaccttcttcctggccgtgaatggcctgtacagcagcagtgatgatgtgattgagctgacccccagcaacttcaaccgggaggtgatccagagcgacagcctgtggctggtggagttctacgccccctggtgtggccactgccagaggctgaccccagagtggaagaaggccgccacagccctgaaggatgtggtgaaggtgggcgctgtggatgctgacaagcaccacagcctgggcggccagtatggagtgcagggcttccccaccatcaagatcttcggcagcaacaagaacagacctgaggactaccagggcggccgcactggagaggccatcgtggatgctgccctgagcgccctgcggcagctggtgaaggaccggctgggcggccgcagcggcggctacagcagcggcaagcagggccgcagtgacagcagcagcaagaaggatgtgattgagctgacagatgacagctttgacaagaatgtgctggacagtgaagatgtgtggatggtggagttctacgccccctggtgtggccactgcaagaacctggagcctgagtgggccgccgccgccagcgaggtgaaggagcagaccaagggcaaggtgaagctggccgctgtggatgccaccgtgaaccaggtgctggccagccgctatggcatccggggcttccccaccatcaagatcttccagaagggggagagccctgtggactatgatggcggccgcaccaggagtgacatcgtgtcccgggccctggacctcttcagtgacaatgcccctcctcctgagctgctggagatcatcaatgaagatattgccaagaggacctgtgaggagcaccagctgtgtgtggtggccgtgctgccccacatcctggacacaggagctgctggcaggaacagctacctggaggtgctgctgaagctggccgacaagtacaagaagaagatgtggggctggctgtggacagaggccggggcccagagcgagctggagacagccctgggcatcggcggcttcggctacccagccatggccgccatcaatgccaggaagatgaagtttgccctgctgaagggcagcttcagcgagcagggcatcaatgagttcctgcgggagctgagctttggccggggcagcacagcccctgtgggcggcggggccttccccaccatcgtggagcgggagccctgggatggaagagatggagagctgcctgtggaggatgacatcgacctgagtgatgtggagctggatgacctgggcaaggatgagctgtag

SEQ ID NO: 165872 - DNA, 36 bp, Artificial Sequence
  Description of Artificial Sequence: Synthetic coding sequence
atgtaccccagcaccaccatggccaatgccccctag

SEQ ID NO: 165873 - DNA, 1314 bp, Artificial Sequence
  Description of Artificial Sequence: Synthetic coding sequence
atgatcctgggcctggtgtcctgcaccttcttcctggccgtgaatggcctgtacagcagcagtgatgatgtgattgagctgacccccagcaacttcaaccgggaggtgatccagagcgacagcctgtggctggtggagttctacgccccctggtgtggccactgccagaggctgaccccagagtggaagaaggccgccacagccctgaaggatgtggtgaaggtgggcgctgtggatgctgacaagcaccacagcctgggcggccagtatggagtgcagggcttccccaccatcaagatcttcggcagcaacaagaacagacctgaggactaccagggcggccgcactggagaggccatcgtggatgctgccctgagcgccctgcggcagctggtgaaggaccggctgggcggccgcagcggcggctacagcagcggcaagcagggccgcagtgacagcagcagcaagaaggatgtgattgagctgacagatgacagctttgacaagaatgtgctggacagtgaagatgtgtggatggtggagttctacgccccctggtgtggccactgcaagaacctggagcctgagtgggccgccgccgccagcgaggtgaaggagcagaccaagggcaaggtgaagctggccgctgtggatgccaccgtgaaccaggtgctggccagccgctatggcatccggggcttccccaccatcaagatcttccagaagggggagagccctgtggactatgatggcggccgcaccaggagtgacatcgtgtcccgggccctggacctcttcagtgacaatgcccctcctcctgagctgctggagatcatcaatgaagatattgccaagaggacctgtgaggagcaccagctgtgtgtggtggccgtgctgccccacatcctggacacaggagctgctggcaggaacagctacctggaggtgctgctgaagctggccgacaagtacaagaagaagatgtggggctggctgtggacagaggccggggcccagagcgagctggagacagccctgggcatcggcggcttcggctacccagccatggccgccatcaatgccaggaagatgaagtttgccctgctgaagggcagcttcagcgagcagggcatcaatgagttcctgcgggagctgagctttggccggggcagcacagcccctgtgggcggcggggccttccccaccatcgtggagcgggagccctgggatggaagagatggagagctgcctgtggaggatgacatcgacctgagtgatgtggagctggatgacctgggcaaggatgagctgtag

SEQ ID NO: 165874 - DNA, 1956 bp, Artificial Sequence
  Description of Artificial Sequence: Synthetic coding sequence
atggctgacagcgctgagctgaagcagatggtgatgagcctgcgggtgtctgagctgcaggtgctgctgggctacgccggcaggaacaagcacggcaggaagcatgagctgctgaccaaggccctgcacctgctgaaggccggctgcagccctgctgtgcagatgaagatcaaggagctgtacagaagacgcttcccccagaagatcatgaccccagctgacctgagcatccccaacgtgcacagcagccccatgcctgccaccctgagccccagcaccatcccccagctgacctatgatggccacccagccagcagccccctgctgcctgtgtccctgctgggccccaagcatgagctggagctgccccacctgaccagcgccctgcaccctgtgcacccagacatcaagctgcagaagctgcccttctatgacctgctggatgagctgatcaagcccaccagcctggccagtgacaacagccagcgcttccgggagacctgctttgcctttgccctgaccccccagcaggtgcagcagatcagcagctccatggacatcagcggcaccaagtgtgacttcaccgtgcaggtgcagctgcgcttctgcctgtctgagaccagctgcccccaggaggaccacttcccccccaacctgtgtgtgaaggtgaacaccaagccctgcagcctgcccggctacctgccccccaccaagaatggagtggagcccaagaggcccagccggcccatcaacatcaccagcctggtgcggctgagcaccaccgtgcccaacaccatcgtggtgtcctggacagctgagatcggcaggaactacagcatggctgtgtacctggtgaagcagctgagcagcacagtgctgctgcagaggctgcgggccaagggcatcagaaatccagaccacagccgggccctgatcaaggagaagctgacagctgaccctgacagcgagatcgccaccaccagcctgcgggtgtccctgctgtgccccctgggcaagatgaggctgaccatcccctgccgggccctgacctgcagccacctgcagtgctttgatgccaccctgtacatccagatgaatgagaagaagcccacctgggtgtgccctgtgtgtgacaagaaggccccctatgagcacctgatcattgatggcctcttcatggagatcctgaagtactgcacagactgtgatgagatccagttcaaggaggatggcacctgggcccccatgaggagcaagaaggaggtgcaggaggtgtctgccagctacaacggggtggatggctgcctgagcagcaccctggagcaccaggtggccagccaccaccagagcagcaacaagaacaagaaggtggaggtgattgacctgaccatcgacagcagcagtgatgaggaggaggaggagcccagcgccaagaggacctgccccagcctgagccccaccagccccctgaacaacaagggcatcctgagcctgccccaccaggccagccctgtgtccaggacccccagcctgcctgctgtggacaccagctacatcaacaccagcctcatccaggactaccgccaccccttccacatgacccccatgccctatgacctgcagggcctggacttcttccccttcctgagcggggacaaccagcactacaacaccagcctgctggccgctgctgctgctgctgtgtctgatgaccaggacctgctgcacagcagccgcttcttcccctacaccagcagccagatgttcctggaccagctgtctgctgggggcagcaccagcctgcccaccaccaacggcagcagcagcggcagcaacagcagcctggtgagcagcaacagcctgcgggagagccacagccacacagtgaccaacagaagcagcacagacacagccagcatcttcggcatcatcccagacatcatcagcctggactag

SEQ ID NO: 165875 - DNA, 1962 bp, Artificial Sequence
  Description of Artificial Sequence: Synthetic coding sequence
atgttcaccctgcaggacagctatgtgaagcagatggtgatgagcctgcgggtgtctgagctgcaggtgctgctgggctacgccggcaggaacaagcacggcaggaagcatgagctgctgaccaaggccctgcacctgctgaaggccggctgcagccctgctgtgcagatgaagatcaaggagctgtacagaagacgcttcccccagaagatcatgaccccagctgacctgagcatccccaacgtgcacagcagccccatgcctgccaccctgagccccagcaccatcccccagctgacctatgatggccacccagccagcagccccctgctgcctgtgtccctgctgggccccaagcatgagctggagctgccccacctgaccagcgccctgcaccctgtgcacccagacatcaagctgcagaagctgcccttctatgacctgctggatgagctgatcaagcccaccagcctggccagtgacaacagccagcgcttccgggagacctgctttgcctttgccctgaccccccagcaggtgcagcagatcagcagctccatggacatcagcggcaccaagtgtgacttcaccgtgcaggtgcagctgcgcttctgcctgtctgagaccagctgcccccaggaggaccacttcccccccaacctgtgtgtgaaggtgaacaccaagccctgcagcctgcccggctacctgccccccaccaagaatggagtggagcccaagaggcccagccggcccatcaacatcaccagcctggtgcggctgagcaccaccgtgcccaacaccatcgtggtgtcctggacagctgagatcggcaggaactacagcatggctgtgtacctggtgaagcagctgagcagcacagtgctgctgcagaggctgcgggccaagggcatcagaaatccagaccacagccgggccctgatcaaggagaagctgacagctgaccctgacagcgagatcgccaccaccagcctgcgggtgtccctgctgtgccccctgggcaagatgaggctgaccatcccctgccgggccctgacctgcagccacctgcagtgctttgatgccaccctgtacatccagatgaatgagaagaagcccacctgggtgtgccctgtgtgtgacaagaaggccccctatgagcacctgatcattgatggcctcttcatggagatcctgaagtactgcacagactgtgatgagatccagttcaaggaggatggcacctgggcccccatgaggagcaagaaggaggtgcaggaggtgtctgccagctacaacggggtggatggctgcctgagcagcaccctggagcaccaggtggccagccaccaccagagcagcaacaagaacaagaaggtggaggtgattgacctgaccatcgacagcagcagtgatgaggaggaggaggagcccagcgccaagaggacctgccccagcctgagccccaccagccccctgaacaacaagggcatcctgagcctgccccaccaggccagccctgtgtccaggacccccagcctgcctgctgtggacaccagctacatcaacaccagcctcatccaggactaccgccaccccttccacatgacccccatgccctatgacctgcagggcctggacttcttccccttcctgagcggggacaaccagcactacaacaccagcctgctggccgctgctgctgctgctgtgtctgatgaccaggacctgctgcacagcagccgcttcttcccctacaccagcagccagatgttcctggaccagctgtctgctgggggcagcaccagcctgcccaccaccaacggcagcagcagcggcagcaacagcagcctggtgagcagcaacagcctgcgggagagccacagccacacagtgaccaacagaagcagcacagacacagccagcatcttcggcatcatcccagacatcatcagcctggactag

SEQ ID NO: 165876 - DNA, 1782 bp, Artificial Sequence
  Description of Artificial Sequence: Synthetic coding sequence
atggccgagctgggggagctgaagcacatggtgatgtccttccgggtgtctgagctgcaggtgctgctgggctttgctggcaggaacaagagcggcaggaagcatgagctgctggccaaggccctgcacctgctgaagagcagctgtgcccccagcgtgcagatgaagatcaaggagctgtacagaagacgcttccccaggaagaccctgggccccagcgacctgagcctgctgagcctgcccccaggcaccagcccccctgtgcacccagatgtgaccatgaagcccctgcccttctatgaggtgtatggagagctgatccggcccaccaccctggccagcaccagcagccagagatttgaggaggcccacttcacctttgccctgaccccccagcaggtgcagcagatcctgaccagccgggaggtgctgcccggggccaagtgtgactacaccatccaggtgcagctgcgcttctgcctgtgtgagaccagctgcccccaggaggactacttcccccccaacctgtttgtgaaggtgaatggcaagctgtgccccctgcccggctacctgccccccaccaagaatggagctgagcccaagaggcccagccggcccatcaacatcacccccctggcccggctgagcgccaccgtgcccaacaccatcgtggtgaactggagcagcgagtttggaagaaactacagcctgtctgtgtacctggtgcggcagctgacagctggcaccctgctgcagaagctgcgggccaagggcatccggaacccagaccacagccgggccctgatcaaggagaagctgacagctgaccctgattctgaggtggccaccaccagcctgcgggtgtccctgatgtgccccctgggcaagatgaggctgactgtgccctgccgggccctgacctgtgcccacctgcagagctttgatgctgccctgtacctgcagatgaatgagaagaagcccacctggacctgccctgtgtgtgacaagaaggccccctatgagagcctcatcattgatggcctcttcatggagatcctgagcagctgcagcgactgtgatgagatccagttcatggaggatggctcctggtgccccatgaagcccaagaaggaggccagcgaggtgtgccccccacctggctacggcctggatggcctgcagtacagccctgtgcagggcggggaccccagcgagaacaagaagaaggtggaggtgattgacctgaccatcgagagcagcagtgatgaggaggacctgccccccaccaagaagcactgcagcgtgaccagcgctgccatcccagccctgcccggcagcaaaggagtgctgaccagcggccaccagcccagctctgtgctgcggagccctgccatgggcaccctgggcggggacttcctgagcagcctgcccctgcacgagtaccccccagccttccccctgggcgctgacatccagggcctggacctcttctccttcctgcagacagagagccagcactacggccccagcgtcatcaccagcctggatgagcaggatgccctgggccacttcttccagtaccggggcacccccagccacttcctgggccccctggcccccaccctgggcagcagccactgcagcgccaccccagcccctcctcctggccgggtgagcagcatcgtggcccctgggggcgccctgcgggagggccacggcggccccctgcccagcggccccagcctgaccggctgccgcagtgacatcatcagcctggactag

SEQ ID NO: 165877 - DNA, 873 bp, Artificial Sequence
  Description of Artificial Sequence: Synthetic coding sequence
atggtgatgtccttccgggtgtctgagctgcaggtgctgctgggctttgctggaagaaacaagagcggcaggaagcatgagctgctggccaaggccctgcacctgctgaagagcagctgtgcccccagcgtgcagatgaagatcaaggagctgtacagaagacgcttccccaggaagaccctgggccccagcgacctgagcctgctgagcctgcccccaggcaccagccctgtgggcagccctggccccctggcccccatcccccccaccctgctggcccctggcaccctgctgggccccaagcgggaggtggacatgcacccccccctgccccagcctgtgcacccagatgtgaccatgaagcccctgcccttctatgaggtgtatggagagctgatccggcccaccaccctggccagcaccagcagccagagatttgaggaggcccacttcacctttgccctgaccccccagcaggtgcagcagatcctgaccagccgggaggtgctgcccggggccaagtgtgactacaccatccaggtgcagctgcgcttctgcctgtgtgagaccagctgcccccaggaggactacttcccccccaacctgtttgtgaaggtgaatggcaagctgtgccccctgcccggctacctgccccccaccaagaatggagctgagcccaagaggcccagccggcccatcaacatcacccccctggcccggctgagcgccaccgtgcccaacaccatcgtggtgaactggagcagcgagtttggccgggtgtccacagccaaggccggggcctggaagagcctgctgcgggtgaagggcaaccaccctgtgtcctgggtgggggaggccttcagcagcctgtag

SEQ ID NO: 165878 - DNA, 1887 bp, Artificial Sequence
  Description of Artificial Sequence: Synthetic coding sequence
atggccgagctgggggagctgaagcacatggtgatgtccttccgggtgtctgagctgcaggtgctgctgggctttgctggcaggaacaagagcggcaggaagcatgagctgctggccaaggccctgcacctgctgaagagcagctgtgcccccagcgtgcagatgaagatcaaggagctgtacagaagacgcttccccaggaagaccctgggccccagcgacctgagcctgctgagcctgcccccaggcaccagccctgtgggcagccctggccccctggcccccatcccccccaccctgctggcccctggcaccctgctgggccccaagcgggaggtggacatgcacccccccctgccccagcctgtgcacccagatgtgaccatgaagcccctgcccttctatgaggtgtatggagagctgatccggcccaccaccctggccagcaccagcagccagagatttgaggaggcccacttcacctttgccctgaccccccagcaggtgcagcagatcctgaccagccgggaggtgctgcccggggccaagtgtgactacaccatccaggtgcagctgcgcttctgcctgtgtgagaccagctgcccccaggaggactacttcccccccaacctgtttgtgaaggtgaatggcaagctgtgccccctgcccggctacctgccccccaccaagaatggagctgagcccaagaggcccagccggcccatcaacatcacccccctggcccggctgagcgccaccgtgcccaacaccatcgtggtgaactggagcagcgagtttggaagaaactacagcctgtctgtgtacctggtgcggcagctgacagctggcaccctgctgcagaagctgcgggccaagggcatcagaaatccagaccacagccgggccctgatcaaggagaagctgacagctgaccctgacagcgaggtggccaccaccagcctgcgggtgtccctgatgtgccccctgggcaagatgaggctgactgtgccctgccgggccctgacctgtgcccacctgcagagctttgatgctgccctgtacctgcagatgaatgagaagaagcccacctggacctgccctgtgtgtgacaagaaggccccctatgagagcctcatcattgatggcctcttcatggagatcctgagcagctgcagcgactgtgatgagatccagttcatggaggatggctcctggtgccccatgaagcccaagaaggaggccagcgaggtgtgccccccacctggctacggcctggatggcctgcagtacagccctgtgcagggcggggaccccagcgagaacaagaagaaggtggaggtgattgacctgaccatcgagagcagcagtgatgaggaggacctgccccccaccaagaagcactgcagcgtgaccagcgctgccatcccagccctgcccggcagcaagggcgtgctgaccagcggccaccagcccagctctgtgctgcggagccctgccatgggcaccctgggcggggacttcctgagcagcctgcccctgcacgagtaccccccagccttccccctgggcgctgacatccagggcctggacctcttctccttcctgcagacagagagccagcactacggccccagcgtcatcaccagcctggatgagcaggatgccctgggccacttcttccagtaccggggcacccccagccacttcctgggccccctggcccccaccctgggcagcagccactgcagcgccaccccagcccctcctcctggccgggtgagcagcatcgtggcccctggaggagccctgcgggagggccatggaggccccctgcccagcggccccagcctgaccggctgccgcagtgacatcatcagcctggactag

SEQ ID NO: 165879 - DNA, 780 bp, Artificial Sequence
  Description of Artificial Sequence: Synthetic coding sequence
atggtgatgtccttccgggtgtctgagctgcaggtgctgctgggctttgctggaagaaacaagagcggcaggaagcatgagctgctggccaaggccctgcacctgctgaagagcagctgtgcccccagcgtgcagatgaagatcaaggagctgtacagaagacgcttccccaggaagaccctgggccccagcgacctgagcctgctgagcctgcccccaggcaccagccctgtgggcagccctggccccctggcccccatcccccccaccctgctggcccctggcaccctgctgggccccaagcgggaggtggacatgcacccccccctgccccagcctgtgcacccagatgtgaccatgaagcccctgcccttctatgaggtgtatggagagctgatccggcccaccaccctggccagcaccagcagccagagatttgaggaggcccacttcacctttgccctgaccccccagcaggtgcagcagatcctgaccagccgggaggtgctgcccggggccaagtgtgactacaccatccaggtgcagctgcgcttctgcctgtgtgagaccagctgcccccaggaggactacttcccccccaacctgtttgtgaaggtgaatggcaagctgtgccccctgcccggctacctgccccccaccaagaatggagctgagcccaagaggcccagccggcccatcaacatcacccccctggcccggctgagcgccaccgtgcccaacaccatcgtggtgaactggagcagcgagtttggaagatag

SEQ ID NO: 165880 - DNA, 1248 bp, Artificial Sequence
  Description of Artificial Sequence: Synthetic coding sequence
atgtttgctgacctggactatgacatcgaggaggacaagctgggcatccccaccgtgcctgggaaggtgaccctgcagaaggatgcccagaacctgattggcatcagcattggaggaggagcccagtactgcccctgcctgtacatcgtgcaggtgtttgacaacaccccagctgccctggatggcaccgtggccgctggagatgagatcactggagtgaatggccgcagcatcaagggcaagaccaaggtggaggtggccaagatgatccaggaggtgaagggggaggtgaccatccactacaacaagctgcaggccgaccccaagcagggcatgagcctggacatcgtgctgaagaaggtgaagcaccggctggtggagaacatgagcagcggcacagcagatgccctgggcctgagccgggccatcctgtgcaatgatggcctggtgaagaggctggaggagctggagaggacagctgagctgtacaagggcatgacagagcacaccaagaacctgctgcgggccttctatgagctgagccagacccaccgggcctttggagatgtgttcagcgtcatcggcgtgcgggagccccagcctgctgccagcgaggcctttgtgaagtttgctgatgcccacaggagcattgagaagtttggcatccggctgctgaagaccatcaagcccatgctgacagacctgaacacctacctgaacaaggccatcccagacacccggctgaccatcaagaagtacctggatgtgaagtttgagtacctgagctactgcctgaaggtgaaggagatggatgatgaggagtacagctgcatcgccctgggggagcccctgtacagagtgtccactggaaattatgagtaccgcctcatcctgcgctgccggcaggaggcccgggcccgcttcagccagatgaggaaggatgtgctggagaagatggagctgctggaccagaagcacgtgcaggacatcgtgttccagctgcagaggctggtgtccaccatgagcaagtactacaatgactgctatgctgtgctgagagatgctgatgtgttccccatcgaggtggacctggcccacaccaccctggcctacggcctgaaccaggaggagttcacagatggagaggaggaggaggaggaggaggacacagctgctggggagcccagccgggacaccagaggagctgctggccccctggacaagggcggctcctggtgtgacagctag

SEQ ID NO: 165881 - DNA, 1248 bp, Artificial Sequence; identical to SEQ ID NO: 165880
  Description of Artificial Sequence: Synthetic coding sequence

SEQ ID NO: 165882 - DNA, 690 bp, Artificial Sequence
  Description of Artificial Sequence: Synthetic coding sequence
atgtttgctgacctggactatgacatcgaggaggacaagctgggcatccccaccgtgcctgggaaggtgaccctgcagaaggatgcccagaacctgattggcatcagcattggaggaggagcccagtactgcccctgcctgtacatcgtgcaggtgtttgacaacaccccagctgccctggatggcaccgtggccgctggagatgagatcactggagtgaatggccgcagcatcaagggcaagaccaaggtggaggtggccaagatgatccaggaggtgaagggggaggtgaccatccactacaacaagctgcaggccgaccccaagcagggcatgagcctggacatcgtgctgaagaaggtgaagcaccggctggtggagaacatgagcagcggcacagcagatgccctgggcctgagccgggccatcctgtgcaatgatggcctggtgaagaggctggaggagctggagaggacagctgagctgtacaagggcatgacagagcacaccaagaacctgctgcgggccttctatgagctgagccagacccaccgggcctttggagatgtgttcagcgtcatcggcgtgcgggagccccagcctgctgccagcgaggcctttgtgaagtttgctgatgcccacaggagcattgagaagtttggcatccggctgctgaagaccatcaagtag

SEQ ID NO: 165883 - DNA, 405 bp, Artificial Sequence
  Description of Artificial Sequence: Synthetic coding sequence
atgtttgctgacctggactatgacatcgaggaggacaagctgggcatccccaccgtgcctgggaaggtgaccctgcagaaggatgcccagaacctgattggcatcagcattggaggaggagcccagtactgcccctgcctgtacatcgtgcaggtgtttgacaacaccccagctgccctggatggcaccgtggccgctggagatgagatcactggagtgaatggccgcagcatcaagggcaagaccaaggtggaggtggccaagatgatccaggaggtgaagggggaggtgaccatccactacaacaagctgcaggccgaccccaagcagggcatgagcctggacatcgtgctgaagaaggtgaagcaccggctggtggagaacatgagcagcggcacagcctag

SEQ ID NO: 165884 - DNA, 393 bp, Artificial Sequence
  Description of Artificial Sequence: Synthetic coding sequence
atgtttgctgacctggactatgacatcgaggaggacaagctgggcatccccaccgtgcctgggaaggtgaccctgcagaaggatgcccagaacctgattggcatcagcattggaggaggagcccagtactgcccctgcctgtacatcgtgcaggtgtttgacaacaccccagctgccctggatggcaccgtggccgctggagatgagatcactggagtgaatggccgcagcatcaagggcaagaccaaggtggaggtggccaagatgatccaggaggtgaagggggaggtgaccatccactacaacaagctgcaggccgaccccaagcagggcatgagcctggacatcggccagaggctgggcttccacggccctggcccccacagcagctag

SEQ ID NO: 165885 - DNA, 117 bp, Artificial Sequence
  Description of Artificial Sequence: Synthetic coding sequence
atgtttgctgacctggactatgacatcgaggaggacaagctgggcatccccaccgtgcctgggaaggtgaccctgcagaaggatgcccagaacctgattggcatcagcattggatag

SEQ ID NO: 165886 - DNA, 231 bp, Artificial Sequence
  Description of Artificial Sequence: Synthetic coding sequence
atgacagatgtggagaccacctatgctgacttcatcgccagcggccgcactggaagaagaaatgccatccatgacatcctggtgagcagcgccagcggcaacagcaatgagctggccctgaagctggccggcctggacatcaacaagacagaaggagaggaggatgcccagaggagcagcacagagcagagcggggaggcccagggcgaggccgccaagtctgagagctag

SEQ ID NO: 165887 - DNA, 231 bp, Artificial Sequence; identical to SEQ ID NO: 165886
  Description of Artificial Sequence: Synthetic coding sequence

SEQ ID NO: 165888 - DNA, 231 bp, Artificial Sequence; identical to SEQ ID NO: 165886
  Description of Artificial Sequence: Synthetic coding sequence

SEQ ID NO: 165889 - DNA, 258 bp, Artificial Sequence
  Description of Artificial Sequence: Synthetic coding sequence
atgagccaccaggatgtggccatgaggacagacagcagcaagatgacagatgtggagagcggcgtggccaactttgccagcagcgcccgggccggcagaagaaatgccctgcctgacatccagagcagcgctgccacagatggcaccagtgacctgcccctgaagctggaggccctgtctgtgaaggaggatgccaaggagaaggatgagaagaccacccaggaccagctggagaagccccagaatgaggagaagtag

SEQ ID NO: 165890 - DNA, 237 bp, Artificial Sequence
  Description of Artificial Sequence: Synthetic coding sequence
atgaggacagacagcagcaagatgacagatgtggagagcggcgtggccaactttgccagcagcgcccgggccggcagaagaaatgccctgcctgacatccagagcagcgctgccacagatggcaccagtgacctgcccctgaagctggaggccctgtctgtgaaggaggatgccaaggagaaggatgagaagaccacccaggaccagctggagaagccccagaatgaggagaagtag

SEQ ID NO: 165891 - DNA, 264 bp, Artificial Sequence
  Description of Artificial Sequence: Synthetic coding sequence
atgcacatcctgtttgtggatgtggccatgaggacagacagcagcaagatgacagatgtggagagcggcgtggccaactttgccagcagcgcccgggccggcagaagaaatgccctgcctgacatccagagcagcgctgccacagatggcaccagtgacctgcccctgaagctggaggccctgtctgtgaaggaggatgccaaggagaaggatgagaagaccacccaggaccagctggagaagccccagaatgaggagaagtag

SEQ ID NO: 165892 - DNA, 237 bp, Artificial Sequence; identical to SEQ ID NO: 165890
  Description of Artificial Sequence: Synthetic coding sequence

SEQ ID NO: 165893 - DNA, 237 bp, Artificial Sequence; identical to SEQ ID NO: 165890
  Description of Artificial Sequence: Synthetic coding sequence

SEQ ID NO: 165894 - DNA, 237 bp, Artificial Sequence; identical to SEQ ID NO: 165890
  Description of Artificial Sequence: Synthetic coding sequence

SEQ ID NO: 165895 - DNA, 237 bp, Artificial Sequence; identical to SEQ ID NO: 165890
  Description of Artificial Sequence: Synthetic coding sequence

SEQ ID NO: 165896 - DNA, 231 bp, Artificial Sequence
  Description of Artificial Sequence: Synthetic coding sequence
atgatggaggtggagagcagctacagcgacttcatcagctgtgacagaactggaagaagaaatgctgtgcctgacatccagggcgacagcgaggccgtgtctgtgaggaagctggccggggacatgggagagctggccctggagggcgctgagggccaggtggagggcagcgccccagacaaggaggccggcaaccagccccagagcagtgatggcaccaccagcagctag

SEQ ID NO: 165897 - DNA, 195 bp, Artificial Sequence
  Description of Artificial Sequence: Synthetic coding sequence
atgatggaggtggagagcagctacagcgacttcatcagctgtgacagaactggaagaagaaatgctgtgcctgacatccagggcgacagcgaggccgtgtctgtgaggaagctggccggggacatgggagagctggccctggagggcgctgagatggacctgaccatgctgccctggctggtgagcaacagctag

SEQ ID NO: 165898 - DNA, 231 bp, Artificial Sequence; identical to SEQ ID NO: 165896
  Description of Artificial Sequence: Synthetic coding sequence

SEQ ID NO: 165899 - DNA, 231 bp, Artificial Sequence; identical to SEQ ID NO: 165896
  Description of Artificial Sequence: Synthetic coding sequence

SEQ ID NO: 165900 - DNA, 231 bp, Artificial Sequence; identical to SEQ ID NO: 165896
  Description of Artificial Sequence: Synthetic coding sequence

SEQ ID NO: 165901 - DNA, 231 bp, Artificial Sequence; identical to SEQ ID NO: 165896
  Description of Artificial Sequence: Synthetic coding sequence

SEQ ID NO: 165902 - DNA, 231 bp, Artificial Sequence; identical to SEQ ID NO: 165896
  Description of Artificial Sequence: Synthetic coding sequence

SEQ ID NO: 165903 - DNA, 1578 bp, Artificial Sequence
  Description of Artificial Sequence: Synthetic coding sequence
atgcccctgctggatggagacctggagggcagcggcaagcacagcagcaggaaggtggacagcccctttggacctggcagccccagcaagggcttcttcagccggggcccccagccccggcccagcagccccatgtctgcccctgtgcggcccaagaccagccctggcagccccaagacagtgttccccttctcctaccaggagagcccccccaggagccccaggaggatgtccttcagcggcatcttccgcagcagcagcaaggagagcagccccaacagcaacccagccaccagccctgggggcatccgcttcttcagccgcagcaggaagaccagcggcctgagcagcagccccagcacccccacccaggtgaccaagcagcacaccttccccctggagagctacaagcatgagcctgagcggctggagaaccgcatctatgccagcagcagccccccagacaccggccagcgcttctgccccagcagcttccagagccccaccaggcctcccctggccagccccacccactacgcccccagcaaggctgctgccctggccgccgccctgggccctgctgaggccggcatgctggagaagctggagtttgaagatgaggccgtggaggacagcgagagcggcgtgtacatgaggttcatgaggagccacaagtgctatgacatcgtgcccaccagcagcaagctggtggtgtttgacaccaccctgcaggtgaagaaggccttctttgccctggtggccaatggagtgcgggccgcccccctgtgggagagcaagaagcagagctttgtgggcatgctgaccatcacagacttcatcaacatcctgcaccgctactacaagagccccatggtgcagatctatgagctggaggagcacaagattgagacctggagggagctgtacctgcaggagaccttcaagcccctggtgaacatcagcccagatgccagcctgtttgatgctgtgtacagcctcatcaagaacaagatccaccggctgcccgtcatcgaccccatctctggaaatgccctgtacatcctgacccacaagaggatcctgaagttcctgcagctgttcatgtctgacatgcccaagccagccttcatgaagcagaacctggatgagctgggcatcggcacctaccacaacatcgccttcatccacccagacacccccatcatcaaggccctgaacatctttgtggagcggcgcatcagcgccctgcctgtggtggatgagagcggcaaggtggtggacatctacagcaagtttgatgtgatcaacctggccgctgagaagacctacaacaacctggacatcaccgtgacccaggccctgcagcacaggagccagtactttgaaggagtggtgaagtgcaacaagctggagatcctggagaccatcgtggaccgcatcgtgcgggcagaggtgcaccggctggtggtggtgaatgaggccgacagcatcgtgggcatcatcagcctgagtgacatcctgcaggccctgatcctgaccccagctggggccaagcagaaggagacagaaacagaatag

SEQ ID NO: 165904 - DNA, 987 bp, Artificial Sequence
  Description of Artificial Sequence: Synthetic coding sequence
atgctggagaagctggagtttgaagatgaagctgtggaggacagcgagagcggcgtgtacatgaggttcatgaggagccacaagtgctatgacatcgtgcccaccagcagcaagctggtggtgtttgacaccaccctgcaggtgaagaaggccttctttgccctggtggccaacggggtgcgggccgcccccctgtgggagagcaagaagcagagctttgtgggcatgctgaccatcacagacttcatcaacatcctgcaccgctactacaagagccccatggtgcagatctatgagctggaggagcacaagattgagacctggagggagctgtacctgcaggagaccttcaagcccctggtgaacatcagcccagatgccagcctgtttgatgctgtgtacagcctcatcaagaacaagatccaccggctgcctgtgattgaccccatctctggaaatgccctgtacatcctgacccacaagaggatcctgaagttcctgcagctgttcatgtctgacatgcccaagccagccttcatgaagcagaacctggatgagctgggcatcggcacctaccacaacatcgccttcatccacccagacacccccatcatcaaggccctgaacatctttgtggagcggcgcatcagcgccctgcctgtggtggatgaaagtggcaaggtggtggacatctacagcaagtttgatgtgatcaacctggccgctgagaagacctacaacaacctggacatcaccgtgacccaggccctgcagcacaggagccagtactttgagggcgtggtgaagtgcaacaagctggagatcctggagaccatcgtggacagaattgtgcgggcagaggtgcaccggctggtggtggtgaatgaagctgacagcatcgtgggcatcatcagcctgagtgacatcctgcaggccctgatcctgaccccagctggggccaagcagaaggagacagaaacagaatag

SEQ ID NO: 165905 - DNA, 1335 bp, Artificial Sequence
  Description of Artificial Sequence: Synthetic coding sequence
atgagcagcagctatgatgaggccagcctggcccctgaggagaccacagacagcttctgggaggtgggcaactacaagaggacagtgaagagaattgatgatggccaccggctgtgcaatgacctgatgaactgtgtgcaggagcgggccaagattgagaaggcctacggccagcagctgacagactgggccaagcgctggaggcagctgattgagaagggcccccagtatggcagcctggagcgggcctggggcgccatcatgacagaagctgacaaggtgtctgagctgcaccaggaggtgaagaacaacctgctgaatgaagacctggagaaggtgaagaactggcagaaggatgcctaccacaagcagatcatgggcggcttcaaggagaccaaggaggccgaggatggcttcaggaaggcccagaagccctgggccaagaagatgaaggagctggaggccgccaagaaggcctaccacctggcctgcaaggaggagaagctggccatgacccgggagatgaacagcaagacagagcagagcgtgaccccagagcagcagaagaagctgcaggacaaggtggacaagtgcaagcaggatgtgcagaagacccaggagaagtatgagaaggtgctggaggatgtgggcaagaccaccccccagtacatggagaacatggagcaggtgtttgagcagtgccagcagtttgaggagaagaggctggtgttcctgaaggaggtgctgctggacatcaagaggcacctgaacctggccgagaacagcagctacatccacgtgtaccgggagctggagcaggccatcagaggagcagatgcccaggaggacctgcgctggttccgcagcaccagcggccctggcatgcccatgaactggccccagtttgaggagtggaacccagacctgccccacaccaccaccaagaaggagaagcagcccaagaaggccgagggcgtggccctgaccaatgccaccggggctgtggagagcaccagccaggccggggaccggggctctgtgtcctcctatgaccggggccagccctatgccacagagtggagcgatgatgaaagtggcaacccctttggaggcagcgagaccaatggaggagccaacccctttgaagatgacagcaagggcgtgcgggtgcgggccctgtatgactatgatggccaggagcaggatgagctgtccttcaaggctggagatgagctgaccaagctgggggaggaggatgagcagggctggtgccggggccgcctggacagcggccagctgggcctgtacccagccaactacgtggaggccatctag

SEQ ID NO: 165906 - DNA, 1281 bp, Artificial Sequence
  Description of Artificial Sequence: Synthetic coding sequence
atgagcagcagctatgatgaggccagcctggcccctgaggagaccacagacagcttctgggaggtgggcaactacaagaggacagtgaagagaattgatgatggccaccggctgtgcaatgacctgatgaactgtgtgcaggagcgggccaagattgagaaggcctacggccagcagctgacagactgggccaagcgctggaggcagctgattgagaagggcccccagtatggcagcctggagcgggcctggggcgccatcatgacagaagctgacaaggtgtctgagctgcaccaggaggtgaagaacaacctgctgaatgaagacctggagaaggtgaagaactggcagaaggatgcctaccacaagcagatcatgggcggcttcaaggagaccaaggaggccgaggatggcttcaggaaggcccagaagccctgggccaagaagatgaaggagctggaggccgccaagaaggcctaccacctggcctgcaaggaggagaagctggccatgacccgggagatgaacagcaagacagagcagagcgtgaccccagagcagcagaagaagctgcaggacaaggtggacaagtgcaagcaggatgtgcagaagacccaggagaagtatgagaaggtgctggaggatgtgggcaagaccaccccccagtacatggagaacatggagcaggtgtttgagcagtgccagcagtttgaggagaagaggctggtgttcctgaaggaggtgctgctggacatcaagaggcacctgaacctggccgagaacagcagctacatccacgtgtaccgggagctggagcaggccatcagaggagcagatgcccaggaggacctgcgctggttccgcagcaccagcggccctggcatgcccatgaactggccccagtttgaggagtggaacccagacctgccccacaccaccaccaagaaggagaagcagcccaagaaggccgagggcgtggccctgaccaatgccaccggggctgtggagagcaccagccaggccggggaccggggctctgtgtcctcctatgaccggggccagccctatgccacagagtggagcgatgatgaaagtggcaacccctttggaggcagcgagaccaatggaggagccaacccctttgaagatgacagcaagggcgtgcgggtgcgggccctgtatgactatgatggccaggagcaggatgagctgtccttcaaggctggagatgagctgaccaagctgggcctgtacccagccaactacgtggaggccatctag

SEQ ID NO: 165907 - DNA, 1335 bp, Artificial Sequence; identical to SEQ ID NO: 165905
  Description of Artificial Sequence: Synthetic coding sequence

SEQ ID NO: 165908 - DNA, 1275 bp, Artificial Sequence
  Description of Artificial Sequence: Synthetic coding sequence
atggccccagaagaagatgctggaggagaggccctgggcggcagcttctgggaggccggcaactacagaagaacagtgcagagggtggaggatggccaccggctgtgtggggacctggtgtcctgcttccaggagcgggccagaattgagaaggcctatgcccagcagctggccgactgggccaggaagtggaggggcaccgtggagaagggcccccagtatggcaccctggagaaggcctggcacgccttcttcaccgctgctgagcggctgagcgccctgcacctggaggtgcgggagaagctgcagggccaggacagcgagcgggtgcgggcctggcagagaggagccttccacaggcctgtgctgggcggcttccgggagagcagagctgctgaagatggcttcaggaaggcccagaagccctggctgaagaggctgaaggaggtggaggccagcaagaagagctaccacgccgccaggaaggatgagaagacagcccagacccgggagagccacgccaaggctgacagcgctgtgtcccaggagcagctgaggaagctgcaggagcgggtggagcgctgtgccaaggaggccgagaagaccaaggcccagtatgagcagaccctggccgagctgcaccgctacaccccccgctacatggaggacatggagcaggcctttgagacctgccaggccgctgagcggcagaggctgctcttcttcaaggacatgctgctgaccctgcaccagcacctggacctgagcagcagcgagaagttccacgagctgcaccgggacctgcaccagggcatcgaggccgccagtgatgaggaggacctgcgctggtggaggagcacccacggccctggcatggccatgaactggccccagtttgaggagtggagcctggacacccagaggaccatcagcaggaaggagaagggcggccgcagcccagatgaggtgaccctgaccagcatcgtgcccaccagagatggaacagcccccccaccccagagccctggcagccctggcaccggccaggatgaggagtggagcgatgaggagagccccaggaaggccgccaccggggtgcgggtgcgggccctgtatgactatgccggccaggaggctgatgagctgtccttccgggccggggaggagctgctgaagatgtctgaggaggatgagcagggctggtgccagggccagctgcagagcggcagaattggcctgtacccagccaactacgtggagtgtgtgggcgcctag

SEQ ID NO: 165909 - DNA, 879 bp, Artificial Sequence
  Description of Artificial Sequence: Synthetic coding sequence
atggccccagaagaagatgctggaggagaggccctgggcggcagcttctgggaggccggcaactacagaagaacagtgcagagggtggaggatggccaccggctgtgtggggacctggtgtcctgcttccaggagcgggccagaattgagaaggcctatgcccagcagctggccgactgggccaggaagtggaggggcaccgtggagaagggcccccagtatggcaccctggagaaggcctggcacgccttcttcaccgctgctgagcggctgagcgccctgcacctggaggtgcgggagaagctgcagggccaggacagcgagcgggtgcgggcctggcagagaggagccttccacaggcctgtgctgggcggcttccgggagagcagagctgctgaagatggcttcaggaaggcccagaagccctggctgaagaggctgaaggaggtggaggccagcaagaagagctaccacgccgccaggaaggatgagaagacagcccagacccgggagacccagaggcagacagcccccagccccaggagcagctgtgccaactgcagaaatggctggaatgctgtgccccggcggccccggcggcagaagctgtccatgagccgccgctggcagagctgcatcgccaccctgcacgccacctggaggacctggaaccggcccctgcggcctgcccggccccccagcgccagcggcttcttcagcagccgcatctgctgcagcccctacaccagcacctggaccttccctgctgtgcgcagctccatgaacagcacagtgacctgcacccgggccctgcggcagcctgtgaccaagaggatctgtgccggcggggccgcccccaccggccaggcctggccctag

SEQ ID NO: 165910 - DNA, 210 bp, Artificial Sequence
  Description of Artificial Sequence: Synthetic coding sequence
atggccccagaagaagatgctggaggagaggccctgggcggcagcttctgggaggccggcaactacagaagaacagtgcagagggtggaggatggccaccggctgtgtggggacctggtgtcctgcttccaggagcgggccagaattgagaaggcctatgcccagcagctggccgactgggccaggaagtggaggggcaccgtggagtag

SEQ ID NO: 165911 - DNA, 429 bp, Artificial Sequence
  Description of Artificial Sequence: Synthetic coding sequence
atggccccagaagaagatgctggaggagaggccctgggcggcagcttctgggaggccggcaactacagaagaacagtgcagagggtggaggatggccaccggctgtgtggggacctggtgtcctgcttccaggagcgggccagaattgagaaggcctatgcccagcagctggccgactgggccaggaagtggaggggcaccgtggagaagggcccccagtatggcaccctggagaaggcctggcacgccttcttcaccgctgctgagcggctgagcgccctgcacctggaggtgcgggagaagctgcagggccaggacagcgagcgggtgcgggcctggcagagaggagccttccacaggcctgtgctgggcggcttccgggagagcagagctgctgaagatggcttcaggaaggcccagaagccctag

SEQ ID NO: 165912 - DNA, 1218 bp, Artificial Sequence
  Description of Artificial Sequence: Synthetic coding sequence
atggccccagaagaagatgctggaggagaggccctgggcggcagcttctgggaggccggcaactacagaagaacagtgcagagggtggaggatggccaccggctgtgtggggacctggtgtcctgcttccaggagcgggccagaattgagaaggcctatgcccagcagctggccgactgggccaggaagtggaggggcaccgtggagaagggcccccagtatggcaccctggagaaggcctggcacgccttcttcaccgctgctgagcggctgagcgccctgcacctggaggtgcgggagaagctgcagggccaggacagcgagcgggtgcgggcctggcagagaggagccttccacaggcctgtgctgggcggcttccgggagagcagagctgctgaagatggcttcaggaaggcccagaagccctggctgaagaggctgaaggaggtggaggccagcaagaagagctaccacgccgccaggaaggatgagaagacagcccagacccgggagagccacgccaaggctgacagcgctgtgtcccaggagcagctgaggaagctgcaggagcgggtggagcgctgtgccaaggaggccgagaagaccaaggcccagtatgagcagaccctggccgagctgcaccgctacaccccccgctacatggaggacatggagcaggcctttgagacctgccaggccgctgagcggcagaggctgctcttcttcaaggacatgctgctgaccctgcaccagcacctggacctgagcagcagcgagaagttccacgagctgcaccgggacctgcaccagggcatcgaggccgccagtgatgaggaggacctgcgctggtggaggagcacccacggccctggcatggccatgaactggccccagtttgaggagtggagcctggacacccagaggaccatcagcaggaaggagaagggcggccgcagcccagatgaggtgaccctgaccagcatcgtgcccaccagagatggaacagcccccccaccccagagccctggcagccctggcaccggccaggatgaggagtggagcgatgaggagagccccaggaaggccgccaccggggtgcgggtgcgggccctgtatgactatgccggccaggaggctgatgagctgtccttccgggccggggaggagctgctgaagatgtctgaggaggatgagcagggctggtgccagggccagtag

SEQ ID NO: 165913 - DNA, 210 bp, Artificial Sequence; identical to SEQ ID NO: 165910
  Description of Artificial Sequence: Synthetic coding sequence

SEQ ID NO: 165914 - DNA, 447 bp, Artificial Sequence
  Description of Artificial Sequence: Synthetic coding sequence
atggccccagaagaagatgctggaggagaggccctgggcggcagcttctgggaggccggcaactacagaagaacagtgcagagggtggaggatggccaccggctgtgtggggacctggtgtcctgcttccaggagcgggccagaattgagaaggcctatgcccagcagctggccgactgggccaggaagtggaggggcaccgtggagaagggcccccagtatggcaccctggagaaggcctggcacgccttcttcaccgctgctgagcggctgagcgccctgcacctggaggtgcgggagaagctgcagggccaggacagcgagcgggtgcgggcctggcagagaggagccttccacaggcctgtgctgggcggcttccgggagagcagagctgctgaagatggcttcaggaaggcccagaagccctggctgaagaggctgaagtag

SEQ ID NO: 165915 - DNA, 1275 bp, Artificial Sequence; identical to SEQ ID NO: 165908
  Description of Artificial Sequence: Synthetic coding sequence

SEQ ID NO: 165916 - DNA, 1587 bp, Artificial Sequence
  Description of Artificial Sequence: Synthetic coding sequence
atgctgctgcccctgctgctgctgctgcccatgtgctgggccgtggaggtgaagaggccccggggcgtgtccctgaccaaccaccacttctatgatgagagcaagcccttcacctgcctggatggcagcgccaccatcccctttgaccaggtgaatgatgactactgtgactgcaaggatggcagtgatgagcctggaacagctgcctgccccaacggcagcttccactgcaccaacacaggctacaagcccctgtacatccccagcaacagagtgaatgatggagtgtgtgactgctgtgatggaacagatgagtacaacagcggggtcatctgtgagaacacctgcaaggagaagggcaggaaggagcgggagagcctgcagcagatggccgaggtgacccgggagggcttccggctgaagaagatcctgattgaggactggaagaaggcccgggaggagaagcagaagaagctgattgagctgcaggccggcaagaagagcctggaggaccaggtggagatgctgaggacagtgaaggaggaggccgagaagccagagcgggaggccaaggagcagcaccagaagctgtgggaggagcagctggccgccgccaaggcccagcaggagcaggagctggccgcagatgccttcaaggagctggatgatgacatggatggcaccgtgtctgtgacagagctgcagacccaccctgagctggacacagatggagatggagccctgtctgaggccgaggcccaggccctgctgagcggggacacccagacagatgccaccagcttctatgacagagtgtgggccgccatccgggacaagtacagaagtgaggccctgcccacagacctgcctgcccccagcgccccagacctgacagagcccaaggaggagcagccccctgtgcccagcagccccacagaggaggaggaggaggaggaggaggaggaggaggaggaggccgaggaggaggaggaggaggaggacagcgaggaggcccccccacccctgagccccccccagcctgccagccctgctgaggaggacaagatgccaccctatgatgagcagacccaggccttcattgatgctgcccaggaggccaggaacaagtttgaggaggccgagaggagcctgaaggacatggaggagagcatccggaacctggagcaggagatcagctttgattttggccccaatggagaatttgcctacctgtacagccagtgctatgagctgaccaccaatgaatatgtgtaccgcctgtgccccttcaagctggtgtcccagaagcccaagctgggcggcagccccaccagcctgggcacctggggctcctggattggaccagaccatgacaagttcagcgccatgaagtatgagcagggcaccggctgctggcagggccccaacagaagcaccaccgtgcggctgctgtgtgggaaggagaccatggtgaccagcaccacagagcccagccgctgtgagtacctgatggagctgatgaccccagctgcctgcccagagcccccacctgaggcccccacagaagatgaccatgatgagctgtag

SEQ ID NO: 165917 - DNA, 1578 bp, Artificial Sequence
  Description of Artificial Sequence: Synthetic coding sequence
atgctgctgcccctgctgctgctgctgcccatgtgctgggccgtggaggtgaagaggccccggggcgtgtccctgaccaaccaccacttctatgatgagagcaagcccttcacctgcctggatggcagcgccaccatcccctttgaccaggtgaatgatgactactgtgactgcaaggatggcagtgatgagcctggaacagctgcctgccccaacggcagcttccactgcaccaacacaggctacaagcccctgtacatccccagcaacagagtgaatgatggagtgtgtgactgctgtgatggaacagatgagtacaacagcggggtcatctgtgagaacacctgcaaggagaagggcaggaaggagcgggagagcctgcagcagatggccgaggtgacccgggagggcttccggctgaagaagatcctgattgaggactggaagaaggcccgggaggagaagcagaagaagctgattgagctgcaggccggcaagaagagcctggaggaccaggtggagatgctgaggacagtgaaggaggaggccgagaagccagagcgggaggccaaggagcagcaccagaagctgtgggaggagcagctggccgccgccaaggcccagcaggagcaggagctggccgcagatgccttcaaggagctggatgatgacatggatggcaccgtgtctgtgacagagctgcagacccaccctgagctggacacagatggagatggagccctgtctgaggccgaggcccaggccctgctgagcggggacacccagacagatgccaccagcttctatgacagagtgtgggccgccatccgggacaagtacagaagtgaggccctgcccacagacctgcctgcccccagcgccccagacctgacagagcccaaggaggagcagccccctgtgcccagcagccccacagaggaggaggaggaggaggaggaggaggaggaggaggaggccgaggaggaggaggaggaggaggacagcgaggtgcagggcgagcagcccaagccagccagccctgctgaggaggacaagatgccaccctatgatgagcagacccaggccttcattgatgctgcccaggaggccaggaacaagtttgaggaggccgagaggagcctgaaggacatggaggagagcatccggaacctggagcaggagatcagctttgattttggccccaacggggagtttgcctacctgtacagccagtgctatgagctgaccaccaatgaatatgtgtaccgcctgtgccccttcaagctggtgtcccagaagcccaagctgggcggcagccccaccagcctgggcacctggggctcctggattggccctgaccatgacaagttcagcgccatgaagtatgagcagggcaccggctgctggcagggccccaacagaagcaccaccgtgcggctgctgtgtgggaaggagaccatggtgaccagcaccacagagcccagccgctgtgagtacctgatggagctgatgaccccagctgcctgcccagagcccccacctgaggcccccacagaagatgaccatgatgagctgtag

SEQ ID NO: 165918 - DNA, 2031 bp, Artificial Sequence
  Description of Artificial Sequence: Synthetic coding sequence
atggcccccttcctgagaattgccttcaacagctatgagctgggcagcctgcaggccgaggatgaggccaaccagcccttctgtgctgtgaagatgaaggaggccctgagcacagagcggggcaagaccctggtgcagaagaagcccaccatgtacccagagtggaagagcacctttgatgcccacatctatgagggccgggtcatccagatcgtgctgatgagagctgctgaggagcctgtgtctgaggtgacagtgggcgtgtctgtgctggccgagcgctgcaagaagaacaacgggaaggccgagttctggctggacctgcagccccaggccaaggtgctgatgtctgtgcagtacttcctggaggatgtggactgcaagcagagcatgagaagtgaagatgaggccaagttccccaccatgaacagaagaggagccatcaagcaggccaagatccactacatcaagaaccacgagttcatcgccaccttcttcggccagcccaccttctgcagcgtgtgcaaggactttgtgtggggcctgaacaagcagggctacaagtgccggcagtgcaatgctgccatccacaagaagtgcatcgacaagatcatcggccgctgcacaggaacagctgccaacagccgggacaccatcttccagaaggagcgcttcaacatcgacatgccccaccgcttcaaggtgcacaactacatgagccccaccttctgtgaccactgcggcagcctgctgtggggcctggtgaagcagggcctgaagtgtgaggactgtggcatgaatgtgcaccacaagtgccgggagaaggtggccaacctgtgtggcatcaaccagaagctgctggccgaggccctgaaccaggtgacccagagggccagccgccgcagtgacagcgccagcagcgagcctgtgggcatctaccagggctttgagaagaagacaggagtggccggggaggacatgcaggacaacagcggcacctacggcaagatctgggagggcagcagcaagtgcaacatcaacaacttcatcttccacaaggtgctgggcaagggcagctttgggaaggtgctgctgggggagctgaagggccgcggggagtactttgccatcaaggccctgaagaaggatgtggtgctgattgatgatgatgtggagtgcaccatggtggagaagagggtgctgaccctggccgctgagaaccccttcctgacccacctgatctgcaccttccagaccaaggaccacctgttctttgtgatggagttcctgaatggaggagacctgatgtaccacatccaggacaagggccgctttgagctgtaccgggccaccttctacgccgctgagatcatgtgtggcctgcagttcctgcacagcaagggcatcatctacagagacctgaagctggacaacgtgctgctggacagagatggccacatcaagattgctgactttggcatgtgcaaggagaacatctttggagagagccgggccagcaccttctgtggcaccccagactacatcgcccctgagatcctgcagggcctgaagtacaccttctctgtggactggtggagctttggagtgctgctgtatgagatgctgattggccagagccccttccatggagatgatgaagatgagctgtttgagagcatccgggtggacaccccccactacccccgctggatcaccaaggagagcaaggacatcctggagaagctgtttgagcgggagcccaccaagaggctgggcgtgacaggcaacatcaagatccaccccttcttcaagaccatcaactggaccctgctggagaagaggcggctggagccccccttccggcccaaggtgaagagcccccgggactacagcaactttgaccaggagttcctgaatgagaaggcccggctgagctacagcgacaagaacctgattgacagcatggaccagagcgcctttgctggcttctcctttgtgaaccccaagtttgagcacctgctggaggactag

SEQ ID NO: 165919 - DNA, 2031 bp, Artificial Sequence; identical to SEQ ID NO: 165918
  Description of Artificial Sequence: Synthetic coding sequence

SEQ ID NO: 165920 - DNA, 234 bp, Artificial Sequence
  Description of Artificial Sequence: Synthetic coding sequence
atggcccccttcctgagaattgccttcaacagctatgagctgggcagcctgcaggccgaggatgaggccaaccagcccttctgtgctgtgaagatgaaggaggccctgagcacagagcggggcaagaccctggtgcagaagaagcccaccatgtacccagagtggaagagcacctttgatgcccacatctatgagggccgggtcatccagatcgtgctgatgagagctgcctag

SEQ ID NO: 165921 - DNA, 378 bp, Artificial Sequence
  Description of Artificial Sequence: Synthetic coding sequence
atggcccccttcctgagaattgccttcaacagctatgagctgggcagcctgcaggccgaggatgaggccaaccagcccttctgtgctgtgaagatgaaggaggccctgagcacagagcggggcaagaccctggtgcagaagaagcccaccatgtacccagagtggaagagcacctttgatgcccacatctatgagggccgggtcatccagatcgtgctgatgagagctgctgaggagcctgtgtctgaggtgacagtgggcgtgtctgtgctggccgagcgctgcaagaagaacaacgggaaggccgagttctggctggacctgcagccccaggccaaggtgctgatgtctgtgcagtacttcctggaggatgtgtag

SEQ ID NO: 165922 - DNA, 2052 bp, Artificial Sequence
  Description of Artificial Sequence: Synthetic coding sequence
atgagcagcggcaccatgaagttcaacggctacctgcgggtgcgcatcggggaggccgtgggcctgcagcccacccgctggagcctgcggcacagcctcttcaagaagggccaccagctgctggacccctacctgactgtgtctgtggaccaggtgcgggtgggccagaccagcaccaagcagaagaccaacaagcccacctacaatgaggagttctgtgccaacgtgacagatggcggccacctggagctggccgtgttccacgagacccccctgggctatgaccactttgtggccaactgcaccctgcagttccaggagctgctgcggaccaccggggccagtgacacctttgagggctgggtggacctggagcctgagggcaaggtgtttgtggtgatcaccctgaccggcagcttcacagaggccaccctgcagagggaccgcatcttcaagcacttcaccaggaagaggcagagggccatgagaagaagagtgcaccagatcaatggccacaagttcatggccacctacctgcggcagcccacctactgcagccactgccgggagttcatctggggcgtgtttgggaagcagggctaccagtgccaggtgtgcacctgtgtggtgcacaagcgctgccaccacctgattgtgacagcctgcacctgccagaacaacatcaacaaggtggacagcaagattgctgagcagcgcttcggcatcaacatcccccacaagttcagcatccacaactacaaggtgcccaccttctgtgaccactgcggcagcctgctgtggggcatcatgaggcagggcctgcagtgcaagatctgcaagatgaatgtgcacatccgctgccaggccaacgtggcccccaactgtggggtgaatgctgtggagctggccaagaccctggccggcatgggcctgcagcccggcaacatcagccccaccagcaagctggtgagccgcagcaccctgcggcggcagggcaaggagagcagcaaggagggcaatggcatcggcgtgaacagcagcaaccggctgggcatcgacaactttgagttcatccgggtgctgggcaagggcagctttgggaaggtgatgctggcccgggtgaaggagactggagacctgtatgctgtgaaggtgctgaagaaggatgtgatcctgcaggatgatgatgtggagtgcaccatgacagagaagaggatcctgagcctggccaggaaccaccccttcctgacccagctgttctgctgcttccagaccccagacaggctcttctttgtgatggagtttgtgaatggaggagacctgatgttccacatccagaagagcagaagatttgatgaggcccgggcccgcttctacgccgctgagatcatcagcgccctgatgttcctgcatgacaagggcatcatctacagagacctgaagctggacaacgtgctgctggaccacgagggccactgcaagctggccgactttggcatgtgcaaggagggcatctgcaatggagtgaccacagccaccttctgtggcaccccagactacatcgcccctgagatcctgcaggagatgctgtatggccctgctgtggactggtgggccatgggcgtgctgctgtatgagatgctgtgtggccacgccccctttgaagcagaaaatgaagatgacctgtttgaggccatcctgaatgatgaggtggtgtaccccacctggctgcatgaagatgccaccggcatcctgaagagcttcatgaccaagaaccccaccatgaggctgggcagcctgacccagggcggggagcacgccatcctgcggcaccccttcttcaaggagattgactgggcccagctgaaccaccggcagatcgagccccccttccggccccgcatcaagagcagagaagatgtgagcaactttgatcctgacttcatcaaggaggagcctgtgctgacccccattgatgagggccacctgcccatgatcaaccaggatgagttcaggaacttctcctatgtgtccccagagctgcagccctag

SEQ ID NO: 165923 - DNA, 357 bp, Artificial Sequence
  Description of Artificial Sequence: Synthetic coding sequence
atgagcagcggcaccatgaagttcaacggctacctgcgggtgcgcatcggggaggccgtgggcctgcagcccacccgctggagcctgcggcacagcctcttcaagaagggccaccagctgctggacccctacctgactgtgtctgtggaccaggtgcgggtgggccagaccagcaccaagcagaagaccaacaagcccacctacaatgaggagttctgtgccaacgtgacagatggcggccacctggagctggccgtgttccacgagacccccctgggctatgaccactttgtggccaactgcaccctgcagttccaggagctgctgcggaccaccggggccagtgacaccttctag

SEQ ID NO: 165924 - DNA, 1791 bp, Artificial Sequence
  Description of Artificial Sequence: Synthetic coding sequence
atgcccacccagagggacagcagcaccatgagccacacagtggccggcggcggcagcggggaccacagccaccaggtgcgggtgaaggcctactacagaggagacatcatgatcacccactttgagcccagcatcagctttgagggcctgtgcaatgaggtgcgggacatgtgcagctttgacaatgagcagctgttcaccatgaagtggattgatgaggagggggacccctgcaccgtgagcagccagctggagctggaggaggccttccggctgtatgagctgaacaaggacagcgagctgctgatccacgtgttcccctgtgtgcctgagaggcctggcatgccctgccctggagaggacaagagcatctaccgccgcggggcccggcgctggaggaagctgtactgtgccaacggccacaccttccaggccaagcgcttcaacagaagagcccactgtgccatctgcacagaccgcatctggggcctgggccggcagggctacaagtgcatcaactgcaagctgctggtgcacaagaagtgccacaagctggtgaccattgaatgtggccgccacagcctgccccaggagcctgtgatgcccatggaccagagctccatgcacagcgaccacgcccagaccgtcatcccctacaaccccagcagccatgagagcctggaccaggtgggggaggagaaggaggccatgaacacccgggagagcggcaaggccagcagcagcctgggcctgcaggactttgacctgctgcgggtcatcggccggggcagctatgccaaggtgctgctggtgcggctgaagaagacagaccgcatctatgccatgaaggtggtgaagaaggagctggtgaatgatgatgaggacatcgactgggtgcagacagagaagcacgtgtttgagcaggccagcaaccaccccttcctggtgggcctgcacagctgcttccagacagagagccgcctcttcttcgtcatcgagtatgtgaatggaggagacctgatgttccacatgcagaggcagaggaagctgcctgaggagcacgcccgcttctacagcgctgagatcagcctggccctgaactacctgcacgagcggggcatcatctacagagacctgaagctggacaacgtgctgctggacagcgagggccacatcaagctgacagattatggcatgtgcaaggagggcctgcggcctggggacaccaccagcaccttctgtggcacccccaactacatcgcccctgagatcctgcggggggaggactatggcttctctgtggactggtgggccctgggcgtgctgatgtttgagatgatggccggccgcagcccctttgatattgtgggcagcagtgacaacccagaccagaacacagaggactacctgttccaggtgatcctggagaagcagatccgcatccccaggagcctgtctgtgaaggccgcctctgtgctgaagagcttcctgaacaaggaccccaaggagcggctgggctgccacccccagacaggctttgctgacatccagggccaccccttcttcagaaatgtggactgggacatgatggagcagaagcaggtggtgccccccttcaagcccaacatcagcggggagtttggcctggacaactttgacagccagttcaccaatgaacctgtgcagctgaccccagatgatgatgacatcgtgaggaagattgaccagagcgagtttgagggctttgagtacatcaaccccctgctgatgtctgctgaggagtgtgtgtag

SEQ ID NO: 165925 - DNA, 2121 bp, Artificial Sequence
  Description of Artificial Sequence: Synthetic coding sequence
atgagccccttcctgagaattggcctgagcaactttgactgtggcagctgccagagctgccagggcgaggccgtgaacccctactgtgctgtgctggtgaaggagtatgtggagagtgaaaatggccagatgtacatccagaagaagcccaccatgtacccaccctgggacagcacctttgatgcccacatcaacaagggccgggtgatgcagatcatcgtgaagggcaagaatgtggacctgatcagcgagaccaccgtggagctgtacagcctggccgagcgctgcaggaagaacaacgggaagacagagatctggctggagctgaagccccagggccgcatgctgatgaatgcccgctacttcctggagatgtctgacaccaaggacatgaatgaatttgaaacagagggcttctttgccctgcaccagaggagaggagccatcaagcaggccaaggtgcaccacgtgaagtgccacgagttcaccgccaccttcttcccccagcccaccttctgcagcgtgtgccatgaatttgtgtggggcctgaacaagcagggctaccagtgccggcagtgcaatgctgccatccacaagaagtgcatcgacaaggtgattgccaagtgcaccggcagcgccatcaacagccgggagaccatgttccacaaggagcgcttcaagattgacatgccccaccgcttcaaggtgtacaactacaagagccccaccttctgtgagcactgcggcaccctgctgtggggcctggcccggcagggcctgaagtgtgatgcctgtggcatgaatgtgcaccaccgctgccagaccaaggtggccaacctgtgtggcatcaaccagaagctgatggccgaggccctggccatgattgagagcacccagcaggcccgctgcctgcgggacacagagcagatcttccgggagggccctgtggagatcggcctgccctgcagcatcaagaatgaggcccggcccccctgcctgcccacccctgggaagcgggagccccagggcatctcctgggagagccccctggatgaggtggacaagatgtgccacctgcctgagcctgagctgaacaaggagcggcccagcctgcagatcaagctgaagattgaggacttcatcctgcacaagatgctgggcaagggcagctttgggaaggtgttcctggccgagttcaagaagaccaaccagttctttgccatcaaggccctgaagaaggatgtggtgctgatggatgatgatgtggagtgcaccatggtggagaagagggtgctgagcctggcctgggagcaccccttcctgacccacatgttctgcaccttccagaccaaggagaacctcttctttgtgatggagtacctgaatggaggagacctgatgtaccacatccagagctgccacaagtttgacctgagccgggccaccttctatgctgctgagatcatcctgggcctgcagttcctgcacagcaagggcatcgtgtacagagacctgaagctggacaacatcctgctggacaaggatggccacatcaagattgctgactttggcatgtgcaaggagaacatgctgggagatgccaagaccaacaccttctgtggcaccccagactacatcgcccctgagatcctgctgggccagaagtacaaccacagcgtggactggtggagctttggagtgctgctgtatgagatgctgattggccagagccccttccacggccaggatgaggaggagctgttccacagcatccgcatggacaaccccttctacccccgctggctggagaaggaggccaaggacctgctggtgaagctgtttgtgcgggagcctgagaagaggctgggcgtgcggggggacatccggcagcaccccctcttccgggagatcaactgggaggagctggagaggaaggagattgatcctcccttccggcccaaggtgaagagcccctttgactgcagcaactttgacaaggagttcctgaatgagaagccccggctgagctttgctgaccgggccctgatcaacagcatggaccagaacatgttcaggaacttctccttcatgaaccctggcatggagcggctcatctcctag

SEQ ID NO: 165926 - DNA, 1932 bp, Artificial Sequence
  Description of Artificial Sequence: Synthetic coding sequence
atgagccccttcctgagaattggcctgagcaactttgactgtggcagctgccagagctgccagggcgaggccgtgaacccctactgtgctgtgctggtgaaggagtatgtggagagtgaaaatggccagatgtacatccagaagaagcccaccatgtacccaccctgggacagcacctttgatgcccacatcaacaagggccgggtgatgcagatcatcgtgaagggcaagaatgtggacctgatcagcgagaccaccgtggagctgtacagcctggccgagcgctgcaggaagaacaacgggaagacagagatctggctggagctgaagccccagggccgcatgctgatgaatgcccgctacttcctggagatgtctgacaccaaggacatgaatgaatttgaaacagagggcttctttgccctgcaccagaggagaggagccatcaagcaggccaaggtgcaccacgtgaagtgccacgagttcaccgccaccttcttcccccagcccaccttctgcagcgtgtgccatgaatttgtgtggggcctgaacaagcagggctaccagtgccggcagtgcaatgctgccatccacaagaagtgcatcgacaaggtgattgccaagtgcaccggcagcgccatcaacagccgggagaccatgttccacaaggagcgcttcaagattgacatgccccaccgcttcaaggtgtacaactacaagagccccaccttctgtgagcactgcggcaccctgctgtggggcctggcccggcagggcctgaagtgtgatgcctgtggcatgaatgtgcaccaccgctgccagaccaaggtggccaacctgtgtggcatcaaccagaagctgatggccgaggccctggccatgattgagagcacccagcaggcccgctgcctgcgggacacagagcagatcttccgggagggccctgtggagatcggcctgccctgcagcatcaagaatgaggcccggcccccctgcctgcccacccctgggaagcgggagccccagggcatctcctgggagagccccctggatgaggtggacaagatgtgccacctgcctgagcctgagctgaacaaggagcggcccagcctgcagatcaagctgaagattgaggacttcatcctgcacaagatgctgggcaagggcagctttgggaaggtgttcctggccgagttcaagaagaccaaccagttctttgccatcaaggccctgaagaaggatgtggtgctgatggatgatgatgtggagtgcaccatggtggagaagagggtgctgagcctggcctgggagcaccccttcctgacccacatgttctgcaccttccagaccaaggagaacctcttctttgtgatggagtacctgaatggaggagacctgatgtaccacatccagagctgccacaagtttgacctgagccgggccaccttctatgctgctgagatcatcctgggcctgcagttcctgcacagcaagggcatcgtgtacagagacctgaagctggacaacatcctgctggacaaggatggccacatcaagattgctgactttggcatgtgcaaggagaacatgctgggagatgccaagaccaacaccttctgtggcaccccagactacatcgcccctgagctgtttgtgcgggagcctgagaagaggctgggcgtgcggggggacatccggcagcaccccctcttccgggagatcaactgggaggagctggagaggaaggagattgacccccccttccggcccaaggtgaagagcccctttgactgcagcaactttgacaaggagttcctgaatgagaagccccggctgagctttgctgaccgggccctgatcaacagcatggaccagaacatgttcaggaacttctccttcatgaaccctggcatggagcggctcatctcctag

SEQ ID NO: 165927 - DNA, 1440 bp, Artificial Sequence
  Description of Artificial Sequence: Synthetic coding sequence
tgactgagcctgctgccctgcctgctcttcctgcccaccatcatccccaagaagatcgtcatccagagggacagcctgcccagcaagaagctgtcctatggcctcatcgcctgtggcatgaatgtgcaccaccgctgccagaccaaggtggccaacctgtgtggcatcaaccagaagctgatggccgaggccctggccatgattgagagcacccagcaggcccgctgcctgcgggacacagagcagatcttccgggagggccctgtggagatcggcctgccctgcagcatcaagaatgaggcccggcccccctgcctgcccaccccaggcaagcgggagccccagggcatctcctgggagagccccctggatgaggtggacaagatgtgccacctgcctgagcctgagctgaacaaggagcggcccagcctgcagatcaagctgaagattgaggacttcatcctgcacaagatgctgggcaagggcagctttgggaaggtgttcctggccgagttcaagaagaccaaccagttctttgccatcaaggccctgaagaaggatgtggtgctgatggatgatgatgtggagtgcaccatggtggagaagagggtgctgagcctggcctgggagcaccccttcctgacccacatgttctgcaccttccagaccaaggaaaatctcttctttgtgatggagtacctgaatggaggagacctgatgtaccacatccagagctgccacaagtttgacctgagccgggccaccttctacgccgctgagatcatcctgggcctgcagttcctgcacagcaaaggaattgtgtacagagacctgaagctggacaacatcctgctggacaaggatggccacatcaagattgctgactttggcatgtgcaaggagaacatgctgggagatgccaagaccaacaccttctgtggcaccccagactacatcgcccctgagatcctgctgggccagaagtacaaccacagcgtggactggtggagctttggagtgctgctgtatgagatgctgattggccagagccccttccacggccaggatgaggaggagctgttccacagcatccgcatggacaaccccttctacccccgctggctggagaaggaggccaaggacctgctggtgaagctgtttgtgcgggagcctgagaagaggctgggcgtgcggggggacatccggcagcaccccctcttccgggagatcaactgggaggagctggagaggaaggagattgacccccccttccggcccaaggtgaagagcccctttgactgcagcaactttgacaaggagttcctgaatgagaagccccggctgagctttgctgaccgggccctgatcaacagcatggaccagaacatgttcaggaacttctccttcatgaaccctggcatggagcggctcatctcctag

SEQ ID NO: 165928 - DNA, 1746 bp, Artificial Sequence
  Description of Artificial Sequence: Synthetic coding sequence
atggacaccaaggacatgaatgaatttgaaacagagggcttctttgccctgcaccagaggagaggagccatcaagcaggccaaggtgcaccacgtgaagtgccacgagttcaccgccaccttcttcccccagcccaccttctgcagcgtgtgccacgagtttgtgtggggcctgaacaagcagggctaccagtgccggcagtgcaatgctgccatccacaagaagtgcatcgacaaggtgattgccaagtgcaccggcagcgccatcaacagccgggagaccatgttccacaaggagcgcttcaagattgacatgccccaccgcttcaaggtgtacaactacaagagccccaccttctgtgagcactgcggcaccctgctgtggggcctggcccggcagggcctgaagtgtgatgcctgtggcatgaatgtgcaccaccgctgccagaccaaggtggccaacctgtgtggcatcaaccagaagctgatggccgaggccctggccatgattgagagcacccagcaggcccgctgcctgcgggacacagagcagatcttccgggagggccctgtggagatcggcctgccctgcagcatcaagaatgaggcccggcccccctgcctgcccaccccaggcaagcgggagccccagggcatctcctgggagagccccctggatgaggtggacaagatgtgccacctgcctgagcctgagctgaacaaggagcggcccagcctgcagatcaagctgaagattgaggacttcatcctgcacaagatgctgggcaagggcagctttgggaaggtgttcctggccgagttcaagaagaccaaccagttctttgccatcaaggccctgaagaaggatgtggtgctgatggatgatgatgtggagtgcaccatggtggagaagagggtgctgagcctggcctgggagcaccccttcctgacccacatgttctgcaccttccagaccaaggaaaatctcttctttgtgatggagtacctgaatggaggagacctgatgtaccacatccagagctgccacaagtttgacctgagccgggccaccttctacgccgctgagatcatcctgggcctgcagttcctgcacagcaaaggaattgtgtacagagacctgaagctggacaacatcctgctggacaaggatggccacatcaagattgctgactttggcatgtgcaaggagaacatgctgggagatgccaagaccaacaccttctgtggcaccccagactacatcgcccctgagatcctgctgggccagaagtacaaccacagcgtggactggtggagctttggagtgctgctgtatgagatgctgattggccagagccccttccacggccaggatgaggaggagctgttccacagcatccgcatggacaaccccttctacccccgctggctggagaaggaggccaaggacctgctggtgaagctgtttgtgcgggagcctgagaagaggctgggcgtgcggggggacatccggcagcaccccctcttccgggagatcaactgggaggagctggagaggaaggagattgacccccccttccggcccaaggtgaagagcccctttgactgcagcaactttgacaaggagttcctgaatgagaagccccggctgagctttgctgaccgggccctgatcaacagcatggaccagaacatgttcaggaacttctccttcatgaaccctggcatggagcggctcatctcctag

SEQ ID NO: 165929 - DNA, 1032 bp, Artificial Sequence
  Description of Artificial Sequence: Synthetic coding sequence
atggccagcaacagcagtgatgtgaaggagttcctggccaaggccaaggaggacttcctgaagaagtgggagagccctgcccagaacacagcccacctggaccagtttgagcgcatcaagaccctgggcaccggcagctttggccgggtgatgctggtgaagcacaaggagaccggcaaccactacgccatgaagatcctggacaagcagaaggtggtgaagctgaagcagatcgagcacaccctgaatgagaagaggatcctgcaggccgtgaacttccccttcctggtgaagctggagttctccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccagcagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggccgccggctacccacccttctttgctgaccagcccatccagatctatgagaagatcgtgtctgggaaggtgcgcttccccagccacttcagcagtgacctgaaggacctgctgaggaacctgctgcaggtggacctgaccaagcgcttcggcaacctgaagaatggagtgaatgacatcaagaaccacaagtggtttgccaccacagactggatcgccatctaccagaggaaggtggaggcccccttcatccccaagttcaagggccctggggacaccagcaactttgatgattatgaggaggaggagatccgggtgtccatcaatgaaaaatgtgggaaggagttcagcgagttctag

SEQ ID NO: 165930 - DNA, 1146 bp, Artificial Sequence
  Description of Artificial Sequence: Synthetic coding sequence
atggagagcggcagcacagctgccagcgaggaggcccggagcctgagagaatgtgagctgtatgtgcagaagcacaacatccaggccctgctgaaggacagcatcgtgcagctgtgcacagcccggcctgagcggcccatggccttcctgcgggagtactttgagcggctggagaaggaggaggccaagcagatccagaacctgcagaaggccggcaccaggacagacagcagagaagatgagatcagccccccaccacccaaccctgtggtgaagggcagaagaagaagaggagccatctctgctgaggtgtacacagaggaggatgctgccagctatgtgaggaaggtgatccccaaggactacaagaccatggccgccctggccaaggccatcgagaagaatgtgctcttcagccacctggatgacaatgaaagaagtgacatctttgatgccatgttttctgtgtccttcatcgccggggagaccgtcatccagcagggagatgaaggagacaacttctacgtgattgaccagggcgagacagatgtgtatgtgaacaatgagtgggccacctctgtgggggagggcggcagctttggagagctggccctgatctacggcaccccccgggccgccaccgtgaaggccaagaccaacgtgaagctgtggggcatcgaccgggacagctaccgccgcatcctgatgggcagcaccctgaggaagaggaagatgtatgaggagttcctgagcaaggtgtccatcctggagagcctggacaagtgggagcggctgactgtggctgatgccctggagcctgtgcagtttgaagatggccagaagatcgtggtgcagggcgagcctggagatgagttcttcatcatcctggagggcagcgctgctgtgctgcagaggagaagtgaaaatgaggagtttgtggaggtgggccgcctgggccccagcgactactttggagaaattgccctgctgatgaaccggccccgggccgccaccgtggtggcccggggccccctgaagtgtgtgaagctggaccggcccaggtttgagcgggtgctgggcccctgcagcgacatcctgaagaggaacatccagcagtacaacagctttgtgtccctgtctgtgtag

SEQ ID NO: 165931 - DNA, 2739 bp, Artificial Sequence
  Description of Artificial Sequence: Synthetic coding sequence
atgtctgcccctcctgtgctgcggccccccagccccctgctgcctgtggccgctgctgctgctgctgctgctgctgccctggtgcccggcagcggccctggccctgcccccttcctggcccctgtggccgcccctgtgggcggcatctccttccacctgcagatcggcctgagccgggagcctgtgctgctgctgcaggacagcagcggggactacagcctggcccacgtgcgggagatggcctgcagcatcgtggaccagaagttcccagaatgtggcttctacggcatgtatgacaagatcctgctcttcagacatgaccccaccagcgagaacatcctgcagctggtgaaggccgccagtgacatccaggagggggacctgattgaggtggtgctgagcgccagcgccacctttgaggacttccagatccggccccacgccctgtttgtgcacagctaccgggccccagccttctgtgaccactgtggggagatgctgtggggcctggtgcggcagggcctgaagtgtgagggctgcggcctgaactaccacaagagatgtgccttcaagatccccaacaactgcagcggcgtgagaagaagaaggctgagcaatgtgtccctgactggagtgtccaccatccgcaccagcagcgctgagctgagcaccagcgccccagatgagcccctgctgcagaagagccccagcgagagcttcatcggccgggagaagaggagcaacagccagagctacatcggccggcccatccacctggacaagatcctgatgagcaaggtgaaggtgccccacacctttgtgatccacagctacacccggcccaccgtgtgccagtactgcaagaagctgctgaagggcctcttccggcagggcctgcagtgcaaggactgccgcttcaactgccacaagagatgtgcccccaaggtgcccaacaactgcctgggggaggtgaccatcaatggagacctgctgagccctggagctgagagtgatgtggtgatggaggagggcagtgatgacaatgacagcgagaggaacagcggcctgatggatgacatggaggaggccatggtgcaggatgctgagatggccatggccgagtgccagaatgattctggagagatgcaggaccctgaccctgaccatgaagatgccaacagaaccatcagccccagcaccagcaacaacatccccctgatgagggtggtgcagagcgtgaagcacaccaagaggaagagcagcacagtgatgaaggagggctggatggtgcactacaccagcaaggacaccctgaggaagaggcactactggaggctggacagcaagtgcatcaccctcttccagaatgacaccggcagccgctactacaaggagatccccctgtctgagatcctgagcctggagcctgtgaagaccagcgccctgatccccaatggagccaacccccactgctttgagatcaccacagccaacgtggtgtactacgtgggagaaaatgtggtgaaccccagcagccccagccccaacaacagcgtgctgaccagcggcgtgggcgcagatgtggccaggatgtgggagatcgccatccagcacgccctgatgcctgtgatccccaagggcagctctgtgggcaccggcaccaacctgcaccgggacatctctgtgtccatctctgtgagcaactgccagatccaggagaatgtggacatcagcacagtgtaccagatcttcccagatgaggtgctgggcagcggccagtttggcatcgtgtatggaggcaagcacaggaagacaggaagagatgtggccatcaagatcatcgacaagctgcgcttccccaccaagcaggagagccagctgagaaatgaggtggccatcctgcagaacctgcaccaccctggggtggtgaacctggagtgcatgtttgagaccccagagcgggtgtttgtggtgatggagaagctgcatggagacatgctggagatgatcctgagcagcgagaagggccgcctgcctgagcacatcaccaagttcctgatcacccagatcctggtggccctgcggcacctgcacttcaagaacatcgtgcactgtgacctgaagccagaaaatgtgctgctggccagcgctgaccccttcccccaggtgaagctgtgtgactttggatttgcccgcatcatcggggagaagagcttccgccgctctgtggtgggcaccccagcctacctggcccctgaggtgctgaggaacaagggctacaacagaagcctggacatgtggagcgtgggcgtcatcatctacgtgtccctgagcggcaccttccccttcaatgaagatgaggacatccatgaccagatccagaatgctgccttcatgtacccacccaacccctggaaggagatcagccatgaggccatcgacctgatcaacaacctgctgcaggtgaagatgaggaagcgctacagcgtggacaagaccctgagccacccctggctgcaggactaccagacctggctggacctgcgggagctggagtgcaagattggagagcgctacatcacccatgaaagtgatgacctgcgctgggagaagtatgctggggagcagggcctgcagtaccccacccacctgatcaaccccagcgccagccacagcgacaccccagagacagaggagacagagatgaaggccctgggggagcgggtgtccatcctgtag

SEQ ID NO: 165932 - DNA, 2637 bp, Artificial Sequence
  Description of Artificial Sequence: Synthetic coding sequence
atggccacagcccccagctacccagctggcctgcccggcagccctggccctggcagccccccacctcctgggggcctggagctgcagagccccccacccctgctgccccagatcccagcccctggcagcggcgtgtccttccacatccagatcggcctgacccgggagtttgtgctgctgcctgctgccagcgagctggcccacgtgaagcagctggcctgcagcatcgtggaccagaagttcccagaatgtggcttctacggcctgtatgacaagatcctgctcttcaagcatgaccccaccagcgccaacctgctgcagctggtgcgcagcagcggggacatccaggagggggacctggtggaggtggtgctgagcgccagcgccacctttgaggacttccagatccggccccacgccctgactgtgcacagctaccgggccccagccttctgtgaccactgtggggagatgctgtttggcctggtgcggcagggcctgaagtgtgatggctgcggcctgaactaccacaagagatgtgccttcagcatccccaacaactgcagcggggccaggaagaggcggctgagcagcaccagcctggccagcggccacagcgtgcggctgggcaccagcgagagcctgccctgcacagctgaggagctgagccgcagcaccacagagctgctgccccggcggccccccagcagcagcagcagcagcagcgccagcagctacacaggccggcccatcgagctggacaagatgctgctgagcaaggtgaaggtgccccacaccttcctgatccacagctacacccggcccaccgtgtgccaggcctgcaagaagctgctgaagggcctcttccggcagggcctgcagtgcaaggactgcaagttcaactgccacaagagatgtgccaccagggtgcccaatgactgcctgggggaggccctgatcaatggagatgtgcccatggaggaggccacagacttcagcgaggccgacaagagcgccctgatggatgaaagtgaagattctggagtcatccctggcagccacagtgaaaatgccctgcacgccagcgaggaggaggagggggagggcggcaaggcccagagcagcctgggctacatccccctgatgagggtggtgcagagcgtgcgccacaccaccaggaagagcagcaccaccctgcgggagggctgggtggtgcactacagcaacaaggacaccctgaggaagaggcactactggaggctggactgcaagtgcatcaccctcttccagaacaacaccaccaaccgctactacaaggagatccccctgtctgagatcctgactgtggagagcgcccagaacttcagcctggtgcccccaggcaccaacccccactgctttgaaattgtgacagccaatgccacctactttgtgggggagatgcctgggggcacccctgggggccccagcggccagggcgctgaggccgcccggggctgggagacagccatccggcaggccctgatgcctgtgatcctgcaggatgcccccagcgcccctggccacgccccccaccggcaggccagcctgagcatctctgtgagcaacagccagatccaggagaatgtggacatcgccaccgtgtaccagatcttcccagatgaggtgctgggcagcggccagtttggagtggtgtatggaggcaagcacaggaagacaggaagagatgtggccgtgaaggtgattgacaagctgcgcttccccaccaagcaggagagccagctgagaaatgaggtggccatcctgcagagcctgcggcaccctggcatcgtgaacctggagtgcatgtttgagaccccagagaaggtgtttgtggtgatggagaagctgcatggagacatgctggagatgatcctgagcagcgagaagggccgcctgcctgagcggctgaccaagttcctgatcacccagatcctggtggccctgcggcacctgcacttcaagaacatcgtgcactgtgacctgaagccagaaaatgtgctgctggccagcgctgaccccttcccccaggtgaagctgtgtgactttggatttgcccgcatcatcggggagaagagcttccgccgctctgtggtgggcaccccagcctacctggcccctgaggtgctgctgaaccagggctacaacagaagcctggacatgtggagcgtgggcgtcatcatgtatgtgtccctgagcggcaccttccccttcaatgaagatgaggacatcaatgaccagatccagaatgctgccttcatgtacccagccagcccctggagccacatctctgctggggccatcgacctgatcaacaacctgctgcaggtgaagatgaggaagcgctacagcgtggacaagagcctgagccacccctggctgcaggagtaccagacctggctggacctgcgggagctggagggcaagatgggagagcgctacatcacccatgaaagtgatgatgtgcgctgggagcagtttgctgctgagcaccccctgcccggcagcggcctgcccacagaccgggacctgggcggggcctgccccccccaggaccatgacatgcagggcctggccgagcgcatctctgtgctgtag

SEQ ID NO: 165933 - DNA, 2637 bp, Artificial Sequence; identical to SEQ ID NO: 165932
  Description of Artificial Sequence: Synthetic coding sequence

SEQ ID NO: 165934 - DNA, 2166 bp, Artificial Sequence
  Description of Artificial Sequence: Synthetic coding sequence
atgctgtttggcctggtgcggcagggcctgaagtgtgatggctgcggcctgaactaccacaagagatgtgccttcagcatccccaacaactgcagcggggccaggaagaggcggctgagcagcaccagcctggccagcggccacagcgtgcggctgggcaccagcgagagcctgccctgcacagctgaggagctgagccgcagcaccacagagctgctgcccaggaggcctcccagcagcagcagcagcagcagcgccagcagctacacaggccggcccatcgagctggacaagatgctgctgagcaaggtgaaggtgccccacaccttcctgatccacagctacacccggcccaccgtgtgccaggcctgcaagaagctgctgaagggcctcttccggcagggcctgcagtgcaaggactgcaagttcaactgccacaagagatgtgccaccagggtgcccaatgactgcctgggggaggccctgatcaatggagatgtgcccatggaggaggccacagacttcagcgaggccgacaagagcgccctgatggatgaaagtgaggacagcggggtcatccctggcagccacagtgaaaatgccctgcacgccagcgaggaggaggagggggagggcggcaaggcccagagcagcctgggctacatccccctgatgagggtggtgcagagcgtgcgccacaccaccaggaagagcagcaccaccctgcgggagggctgggtggtgcactacagcaacaaggacaccctgaggaagaggcactactggaggctggactgcaagtgcatcaccctcttccagaacaacaccaccaaccgctactacaaggagatccccctgtctgagatcctgactgtggagagcgcccagaacttcagcctggtgcccccaggcaccaacccccactgctttgagatcgtgacagccaatgccacctactttgtgggggagatgcctgggggcaccccaggcggccccagcggccagggcgctgaggccgcccggggctgggagacagccatccggcaggccctgatgcctgtgatcctgcaggatgcccccagcgcccctggccacgccccccaccggcaggccagcctgagcatctctgtgagcaacagccagatccaggagaatgtggacatcgccaccgtgtaccagatcttcccagatgaggtgctgggcagcggccagtttggagtggtgtatggaggcaagcacaggaagacaggaagagatgtggccgtgaaggtgattgacaagctgcgcttccccaccaagcaggagagccagctgagaaatgaggtggccatcctgcagagcctgcggcaccctggcatcgtgaacctggagtgcatgtttgagaccccagagaaggtgtttgtggtgatggagaagctgcacggggacatgctggagatgatcctgagcagcgagaagggccgcctgcctgagcggctgaccaagttcctgatcacccagatcctggtggccctgcggcacctgcacttcaagaacatcgtgcactgtgacctgaagccagaaaatgtgctgctggccagcgctgaccccttcccccaggtgaagctgtgtgactttggatttgcccgcatcattggagagaagagcttcagaagatctgtggtgggcaccccagcctacctggcccctgaggtgctgctgaaccagggctacaacagaagcctggacatgtggagcgtgggcgtcatcatgtatgtgtccctgagcggcaccttccccttcaatgaagatgaggacatcaatgaccagatccagaatgctgccttcatgtacccagccagcccctggagccacatctctgctggggccatcgacctgatcaacaacctgctgcaggtgaagatgaggaagcgctacagcgtggacaagagcctgagccacccctggctgcaggagtaccagacctggctggacctgcgggagctggagggcaagatgggagagcgctacatcacccatgaaagtgatgatgtgcgctgggagcagtttgctgctgagcaccccctgcccggcagcggcctgcccacagaccgggacctgggcggggcctgccccccccaggaccatgacatgcagggcctggccgagcgcatctctgtgctgtag

SEQ ID NO: 165935 - DNA, 1482 bp, Artificial Sequence
  Description of Artificial Sequence: Synthetic coding sequence
atgagaagaagaagagctgctgtggccgccggcttctgtgccagcttcctgctgggctctgtgctgaatgtgctgtttgcccctggcagcgagccccccaggcctggccagagccctgagcccagccctgcccctggccctggaagaagaggaggccgcggggagctggcccggcagatccgggcccgctatgaggaggtgcagcgctacagcagaggaggccctggccctggagctggccggcctgagcggcggcggctgatggacctggcccctgggggccctggcctgccccggccccggcccccctgggcccggcccctgagtgatggagcccctggctggcccccagcccctggccctggcagccctggccctggcccccggctgggctgtgccgccctgagaaatgtgtctggggcccagtacatgggcagcggctacaccaaggctgtgtacagagtgcggctgcccggcggcgctgctgtggccctgaaggctgtggacttcagcggccatgacctgggcagctgtgtgcgggagtttggagtgagaagaggctgctaccgcctggccgcccacaagctgctgaaggagatggtgctgctggagcggctgcggcaccccaacgtgctgcagctgtatggctactgctaccaggacagcgaggacatcccagacaccctgaccaccatcacagagctgggcgcccctgtggagatgatccagctgctgcagacctcctgggaggaccgcttccgcatctgcctgagcctgggccgcctgctgcaccacctggcccacagccccctgggctctgtgaccctgctggacttccggccccggcagtttgtgctggtggatggagagctgaaggtgacagacctggatgatgcccgggtggaggagaccccctgtgccggcagcacagactgcatcctggagttccctgccaggaacttcaccctgccctgcagcgcccagggctggtgtgagggcatgaatgagaagaggaacctgtacaatgcctaccgcttcttcttcacctacctgctgccccacagcgccccacccagcctgcggcccctgctggacagcatcgtgaatgccactggagagctggcctggggcgtggatgagaccctggcccagctggagaaggtgctgcacctgtaccgcagcggccagtacctgcagaacagcacagccagcagcagcacagagtaccagtgcatcccagacagcaccatcccccaggaggactaccgctgctggcccagctaccaccacggcagctgcctgctgagcgtcttcaacctggccgaggccgtggatgtgtgtgagagccacgcccagtgccgggcctttgtggtgaccaaccagaccacctggacaggccggcagctggtgttcttcaagacaggctggagccaggtggtgcctgaccccaacaagaccacctacgtgaaggccagcggctag

SEQ ID NO: 165936 - DNA, 2829 bp, Artificial Sequence
  Description of Artificial Sequence: Synthetic coding sequence
atggccagtgatgctgtgcagagcgagcccaggtcctggagcctgctggagcagctgggcctggccggggctgacctggccgcccctggggtgcagcagcagctggagctggagcgggagcggctgcggcgggagatcaggaaggagctgaagctgaaggagggcgctgagaacctgcggcgggccaccacagacctgggccgcagcctgggccctgtggagctgctgctgcggggcagcagccggcggctggacctgctgcaccagcagctgcaggagctgcacgcccacgtggtgctgcctgaccctgctgccacccatgatggcccccagagccctggagctgggggccccacctgcagcgccaccaacctgagccgggtggccggcctggagaagcagctggccatcgagctgaaggtgaagcagggcgctgagaacatgatccagacctacagcaatggcagcaccaaggacaggaagctgctgctgacagcccagcagatgctgcaggacagcaagaccaagattgacatcatccgcatgcagctgcggcgggccctgcaggccggccagctggagaaccaggccgccccagatgacacccagggcagcccagacctgggcgctgtggagctgagaattgaggagctgcggcaccacttccgggtggagcacgctgtggccgagggcgccaagaatgtgctgcggctgctgtctgctgccaaggccccagacaggaaggctgtgtctgaggcccaggagaagctgacagagagcaaccagaagctgggcctgctgcgggaggccctggagcggcggctgggggagctgcctgctgaccaccccaagggccgcctgctgcgggaggagctggccgccgccagcagcgctgccttcagcacccggctggccggccccttccctgccacccactacagcaccctgtgcaagccagcccccctgaccggcaccctggaggtgcgggtggtgggctgccgggacctgcctgagaccatcccctggaaccccacccccagcatgggcggccctggcaccccagacagccggccccccttcctgagcaggcctgcccggggcctgtacagccgcagcggcagcctgagcggccgcagcagcctgaaggccgaggccgagaacaccagcgaggtgtccacagtgctgaagctggacaacacagtggtgggccagacctcctggaagccctgtggccccaatgcctgggaccagagcttcaccctggagctggagcgggcccgggagctggagctggccgtgttctggagggaccagaggggcctgtgtgccctgaagttcctgaagctggaggacttcctggacaatgaaagacatgaggtgcagctggacatggagccccagggctgcctggtggccgaggtgaccttcagaaatcctgtgattgagcgcatcccccggctgcggcggcagaagaagatcttcagcaagcagcagggcaaggccttccagagggcccggcagatgaacattgatgtggccacctgggtgcggctgctgcggcggctcatccccaatgccactggaacaggcaccttcagccctggggccagccctggcagcgaggcccggaccactggagacatctctgtggagaagctgaacctgggcacagacagcgacagcagcccccagaagagcagccgggacccccccagcagccccagcagcctgagcagccccatccaggagagcacagcccctgagctgcccagcgagacccaggagaccccaggccctgccctgtgcagccccctgaggaagagccccctgaccctggaggacttcaagttcctggccgtgctgggccggggccactttgggaaggtgctgctgtctgagttccggcccagcggggagctgtttgccatcaaggccctgaagaagggggacatcgtggccagagatgaggtggagagcctgatgtgtgagaagaggatcctggccgctgtgaccagcgctggccaccccttcctggtgaacctgtttggctgcttccagaccccagagcacgtgtgctttgtgatggagtacagcgctggaggagacctgatgctgcacatccacagtgatgtgttttctgagccccgggccatcttctacagcgcctgtgtggtgctgggcctgcagttcctgcacgagcacaagatcgtgtacagagacctgaagctggacaacctgctgctggacacagagggctacgtgaagattgctgactttggcctgtgcaaggagggcatgggctacggggacaggaccagcaccttctgtggcaccccagagttcctggcccctgaggtgctgacagacaccagctacaccagggctgtggactggtggggcctgggcgtgctgctgtatgagatgctggtgggggagagccccttccctggagatgatgaggaggaggtgtttgacagcatcgtgaatgatgaggtgcgctacccccgcttcctgtctgctgaggccatcggcatcatgaggcggctgctgcggaggaaccctgagcggcggctgggcagcagcgagagagatgctgaagatgtgaagaagcagcccttcttccgcaccctgggctgggaggccctgctggcccggcggctgcccccaccatttgtgcccaccctgagcggccgcacagatgtgagcaactttgatgaggagttcaccggggaggcccccaccctgagccccccaagagatgcccggcccctgacagctgctgagcaggccgccttcctggactttgattttgtggccggcggctgctag

SEQ ID NO: 165937 - DNA, 2847 bp, Artificial Sequence
  Description of Artificial Sequence: Synthetic coding sequence
atggccgaggccaacaaccccagcgagcaggagctggagagcgagcccaggtcctggagcctgctggagcagctgggcctggccggggctgacctggccgcccctggggtgcagcagcagctggagctggagcgggagcggctgcggcgggagatcaggaaggagctgaagctgaaggagggcgctgagaacctgcggcgggccaccacagacctgggccgcagcctgggccctgtggagctgctgctgcggggcagcagccggcggctggacctgctgcaccagcagctgcaggagctgcacgcccacgtggtgctgcctgaccctgctgccacccatgatggcccccagagccctggagctgggggccccacctgcagcgccaccaacctgagccgggtggccggcctggagaagcagctggccatcgagctgaaggtgaagcagggcgctgagaacatgatccagacctacagcaatggcagcaccaaggacaggaagctgctgctgacagcccagcagatgctgcaggacagcaagaccaagattgacatcatccgcatgcagctgcggcgggccctgcaggccggccagctggagaaccaggccgccccagatgacacccagggcagcccagacctgggcgctgtggagctgagaattgaggagctgcggcaccacttccgggtggagcacgctgtggccgagggcgccaagaatgtgctgcggctgctgtctgctgccaaggccccagacaggaaggctgtgtctgaggcccaggagaagctgacagagagcaaccagaagctgggcctgctgcgggaggccctggagcggcggctgggggagctgcctgctgaccaccccaagggccgcctgctgcgggaggagctggccgccgccagcagcgctgccttcagcacccggctggccggccccttccctgccacccactacagcaccctgtgcaagccagcccccctgaccggcaccctggaggtgcgggtggtgggctgccgggacctgcctgagaccatcccctggaaccccacccccagcatgggcggccctggcaccccagacagccggccccccttcctgagcaggcctgcccggggcctgtacagccgcagcggcagcctgagcggccgcagcagcctgaaggccgaggccgagaacaccagcgaggtgtccacagtgctgaagctggacaacacagtggtgggccagacctcctggaagccctgtggccccaatgcctgggaccagagcttcaccctggagctggagcgggcccgggagctggagctggccgtgttctggagggaccagaggggcctgtgtgccctgaagttcctgaagctggaggacttcctggacaatgaaagacatgaggtgcagctggacatggagccccagggctgcctggtggccgaggtgaccttcagaaatcctgtgattgagcgcatcccccggctgcggcggcagaagaagatcttcagcaagcagcagggcaaggccttccagagggcccggcagatgaacattgatgtggccacctgggtgcggctgctgcggcggctcatccccaatgccactggaacaggcaccttcagccctggggccagccctggcagcgaggcccggaccactggagacatctctgtggagaagctgaacctgggcacagacagcgacagcagcccccagaagagcagccgggacccccccagcagccccagcagcctgagcagccccatccaggagagcacagcccctgagctgcccagcgagacccaggagaccccaggccctgccctgtgcagccccctgaggaagagccccctgaccctggaggacttcaagttcctggccgtgctgggccggggccactttgggaaggtgctgctgtctgagttccggcccagcggggagctgtttgccatcaaggccctgaagaagggggacatcgtggccagagatgaggtggagagcctgatgtgtgagaagaggatcctggccgctgtgaccagcgctggccaccccttcctggtgaacctgtttggctgcttccagaccccagagcacgtgtgctttgtgatggagtacagcgctggaggagacctgatgctgcacatccacagtgatgtgttttctgagccccgggccatcttctacagcgcctgtgtggtgctgggcctgcagttcctgcacgagcacaagatcgtgtacagagacctgaagctggacaacctgctgctggacacagagggctacgtgaagattgctgactttggcctgtgcaaggagggcatgggctacggggacaggaccagcaccttctgtggcaccccagagttcctggcccctgaggtgctgacagacaccagctacaccagggctgtggactggtggggcctgggcgtgctgctgtatgagatgctggtgggggagagccccttccctggagatgatgaggaggaggtgtttgacagcatcgtgaatgatgaggtgcgctacccccgcttcctgtctgctgaggccatcggcatcatgaggcggctgctgcggaggaaccctgagcggcggctgggcagcagcgagagagatgctgaagatgtgaagaagcagcccttcttccgcaccctgggctgggaggccctgctggcccggcggctgcccccaccatttgtgcccaccctgagcggccgcacagatgtgagcaactttgatgaggagttcaccggggaggcccccaccctgagccccccaagagatgcccggcccctgacagctgctgagcaggccgccttcctggactttgattttgtggccggcggctgctag

SEQ ID NO: 165938 - DNA, 1815 bp, Artificial Sequence
  Description of Artificial Sequence: Synthetic coding sequence
atggccagcaaccctgagcggggggagatcctgctgacagagctgcagggcgacagccgcagcctgcccttctctgaaaatgtgtctgctgtgcagaagctggacttcagtgacaccatggtgcagcagaagctggatgacatcaaggaccgcatcaagcgggagatcaggaaggagctgaagatcaaggagggcgctgagaacctgaggaaggtgaccacagacaagaagagcctggcctacgtggacaacatcctgaagaagagcaacaagaagctggaggagctgcaccacaagctgcaggagctgaatgcccacatcgtggtgtctgaccctgaggacatcacagactgccccaggaccccagacacccccaacaatgacccccgctgcagcaccagcaacaaccggctgaaggccctgcagaagcagctggacatcgagctgaaggtgaagcagggcgctgagaacatgatccagatgtacagcaatggcagcagcaaggacaggaagctgcatggaacagcccagcagctgctgcaggacagcaagaccaagattgaagtcatccgcatgcagatcctgcaggccgtgcagaccaatgagctggcctttgacaatgccaagcctgtgatcagccccctggagctgaggatggaggagctgcggcaccacttccgcatcgagtttgctgtggccgagggcgccaagaatgtgatgaagctgctgggcagcggcaaggtgacagacaggaaggccctgtctgaggcccaggcccgcttcaatgaaagcagccagaagctggacctgctgaagtacagcctggagcagaggctgaatgaggtgcccaagaaccaccccaagagccgcatcatcatcgaggagctgagcctggtggccgccagccccaccctgagcccccggcagagcatgatcagcacccagaaccagtacagcaccctgagcaagccagctgccctgaccggcaccctggaggtgcggctgatgggctgccaggacatcctggagaatgtgcccggccgcagcaaggccacctctgtggccctgcccggctggagccccagcgagaccaggagcagcttcatgagcaggaccagcaagagcaagagcggcagcagcaggaacctgctgaagacagatgacctgagcaatgatgtgtgtgctgtgctgaagctggacaacacagtggtgggccagacctcctggaagcccatcagcaaccagagctgggaccagaagttcaccctggagctggacaggagccgggagctggagatctctgtgtactggagggactggaggagcctgtgtgctgtgaagttcctgcggctggaggacttcctggacaaccagagacatggcatgtgcctgtacctggagccccagggcaccctgtttgctgaggtgaccttcttcaaccctgtgattgaaagaagacccaagctgcagaggcagaagaagatcttcagcaagcagcagggcaagaccttcctgcgggccccccagatgaacatcaacatcgccacctggggccgcctggtgcggcgggccatccccaccgtgaaccacagcggcaccttcagcccccaggcccctgtgcccaccaccgtgcctgtggtggatgtgcgcatcccccagctggcccccccagcccgctacgtgtctgagatcctgagcatctcctacaccaagctgctgggccacagctatgtgctgatcatcgccggcgtgctgagcctggccttcttccccagcagcatcctgaaggtggtgttctgcctgctgaagaagtag

SEQ ID NO: 165939 - DNA, 2484 bp, Artificial Sequence
  Description of Artificial Sequence: Synthetic coding sequence
atgatccagatgtacagcaatggcagcagcaaggacaggaagctgcacggcacagcccagcagctgctgcaggacagcaagaccaagattgaggtgatccgcatgcagatcctgcaggccgtgcagaccaatgagctggcctttgacaatgccaagcctgtgatcagccccctggagctgaggatggaggagctgcggcaccacttcagaattgaatttgctgtggccgagggcgccaagaatgtgatgaagctgctgggcagcggcaaggtgacagacaggaaggccctgtctgaggcccaggcccgcttcaatgaaagcagccagaagctggacctgctgaagtacagcctggagcagaggctgaatgaggtgcccaagaaccaccccaagagccgcatcatcatcgaggagctgagcctggtggccgccagccccaccctgagcccccggcagagcatgatcagcacccagaaccagtacagcaccctgagcaagccagctgccctgaccggcaccctggaggtgcggctgatgggctgccaggacatcctggagaatgtgcccggccgcagcaaggccacctctgtggccctgcccggctggagccccagcgagaccaggagcagcttcatgagcaggaccagcaagagcaagagcggcagcagcaggaacctgctgaagacagatgacctgagcaatgatgtgtgtgctgtgctgaagctggacaacacagtggtgggccagacctcctggaagcccatcagcaaccagagctgggaccagaagttcaccctggagctggacaggagccgggagctggagatctctgtgtactggagggactggaggagcctgtgtgctgtgaagttcctgcggctggaggacttcctggacaaccagagacatggcatgtgcctgtacctggagccccagggcaccctgtttgctgaggtgaccttcttcaaccctgtgattgaaagaagacccaagctgcagaggcagaagaagatcttcagcaagcagcagggcaagaccttcctgcgggccccccagatgaacatcaacatcgccacctggggccgcctggtgagaagagccatccccaccgtgaaccacagcggcaccttcagcccccaggcccctgtgcccaccaccgtgcctgtggtggatgtgcgcatcccccagctggcccccccagccagtgacagcacagtgaccaagctggactttgacctggagcctgagcccccaccagccccaccccgggccagcagcctgggggagattgatgagagcagcgagctgcgggtgctggacatccctggccaggacagcgagaccgtgtttgacatccagaatgacaggaacagcatcctgcccaagagccagagcgagtacaagccagacaccccccagagcggcctggagtacagcggcatccaggagctggaggacagaagaagccagcagcgcttccagttcaacctgcaggacttccgctgctgtgctgtgctgggccggggccactttgggaaggtgctgctggccgagtacaagaacaccaatgagatgtttgccatcaaggccctgaagaagggggacatcgtggccagagatgaggtggacagcctgatgtgtgagaagaggatctttgagaccgtgaacagcgtgcgccaccccttcctggtgaacctgtttgcctgcttccagaccaaggagcacgtgtgctttgtgatggagtatgctgctggaggagacctgatgatgcacatccacacagatgtgttcagcgagcccagggctgtgttctacgccgcctgtgtggtgctgggcctgcagtacctgcacgagcacaagatcgtgtacagagacctgaagctggacaacctgctgctggacacagagggctttgtgaagattgctgactttggcctgtgcaaggagggcatgggctatggagacaggaccagcaccttctgtggcaccccagagttcctggcccctgaggtgctgacagagaccagctacaccagggctgtggactggtggggcctgggcgtgctgatctatgagatgctggtgggggagagccccttccctggagatgatgaggaggaggtgtttgacagcatcgtgaatgatgaggtgcgctacccccgcttcctgagcacagaggccatcagcatcatgaggcggctgctgcggagaaatcctgagcggcggctgggcgccagcgagaaggatgctgaagatgtgaagaagcaccccttcttccggctgattgactggagcgccctgatggacaagaaggtgaagccacccttcatccccaccatccggggccgggaggatgtgagcaactttgatgatgagttcaccagcgaggcccccatcctgaccccaccccgggagccccgcatcctgtctgaggaggagcaggagatgttccgggactttgactacatcgctgactggtgctag

SEQ ID NO: 165940 - DNA, 2811 bp, Artificial Sequence
  Description of Artificial Sequence: Synthetic coding sequence
atggccagcaaccctgagcggggggagatcctgctgacagagctgcagggcgacagccgcagcctgcccttctctgaaaatgtgtctgctgtgcagaagctggacttcagtgacaccatggtgcagcagaagctggatgacatcaaggaccgcatcaagcgggagatcaggaaggagctgaagatcaaggagggcgctgagaacctgaggaaggtgaccacagacaagaagagcctggcctacgtggacaacatcctgaagaagagcaacaagaagctggaggagctgcaccacaagctgcaggagctgaatgcccacatcgtggtgtctgaccctgaggacatcacagactgccccaggaccccagacacccccaacaatgacccccgctgcagcaccagcaacaaccggctgaaggccctgcagaagcagctggacatcgagctgaaggtgaagcagggcgctgagaacatgatccagatgtacagcaatggcagcagcaaggacaggaagctgcatggaacagcccagcagctgctgcaggacagcaagaccaagattgaagtcatccgcatgcagatcctgcaggccgtgcagaccaatgagctggcctttgacaatgccaagcctgtgatcagccccctggagctgaggatggaggagctgcggcaccacttccgcatcgagtttgctgtggccgagggcgccaagaatgtgatgaagctgctgggcagcggcaaggtgacagacaggaaggccctgtctgaggcccaggcccgcttcaatgaaagcagccagaagctggacctgctgaagtacagcctggagcagaggctgaatgaggtgcccaagaaccaccccaagagccgcatcatcatcgaggagctgagcctggtggccgccagccccaccctgagcccccggcagagcatgatcagcacccagaaccagtacagcaccctgagcaagccagctgccctgaccggcaccctggaggtgcggctgatgggctgccaggacatcctggagaatgtgcccggccgcagcaaggccacctctgtggccctgcccggctggagccccagcgagaccaggagcagcttcatgagcaggaccagcaagagcaagagcggcagcagcaggaacctgctgaagacagatgacctgagcaatgatgtgtgtgctgtgctgaagctggacaacacagtggtgggccagacctcctggaagcccatcagcaaccagagctgggaccagaagttcaccctggagctggacagagtgaccttcttcaaccctgtgattgaaagaagacccaagctgcagaggcagaagaagatcttcagcaagcagcagggcaagaccttcctgcgggccccccagatgaacatcaacatcgccacctggggccgcctggtgcggcgggccatccccaccgtgaaccacagcggcaccttcagcccccaggcccctgtgcccaccaccgtgcctgtggtggatgtgcgcatcccccagctggcccccccagccagtgacagcacagtgaccaagctggactttgacctggagcctgagcccccaccagccccaccccgggccagcagcctgggggagattgatgagagcagcgagctgcgggtgctggacatccctggccaggacagcgagaccgtgtttgacatccagaatgacagaaattccatcctgcccaagagccagagcgagtacaagccagacaccccccagagcggcctggagtacagcggcatccaggagctggaggaccggcgcagccagcagcgcttccagttcaacctgcaggacttccgctgctgtgctgtgctgggccggggccactttgggaaggtgctgctggccgagtacaagaacaccaatgagatgtttgccatcaaggccctgaagaagggggacatcgtggccagagatgaggtggacagcctgatgtgtgagaagaggatctttgaaacagtgaacagcgtgcgccaccccttcctggtgaacctgtttgcctgcttccagaccaaggagcacgtgtgctttgtgatggagtatgctgctggaggagacctgatgatgcacatccacacagatgtgttttctgagcccagggctgtgttctatgctgcctgtgtggtgctgggcctgcagtacctgcacgagcacaagatcgtgtacagagacctgaagctggacaacctgctgctggacacagagggctttgtgaagattgctgactttggcctgtgcaaggagggcatgggctacggggacaggaccagcaccttctgtggcaccccagagttcctggcccctgaggtgctgacagagaccagctacaccagggctgtggactggtggggcctgggcgtgctgatctatgagatgctggtgggggagagccccttccctggagatgatgaggaggaggtgtttgacagcatcgtgaatgatgaggtgcgctacccccgcttcctgagcacagaggccatcagcatcatgaggcggctgctgcggaggaaccctgagcggcggctgggcgccagcgagaaggatgctgaagatgtgaagaagcaccccttcttccggctgattgactggagcgccctgatggacaagaaggtgaagccacccttcatccccaccatccggggcagagaagatgtgagcaactttgatgatgagttcaccagcgaggcccccatcctgaccccaccccgggagccccgcatcctgtctgaggaggagcaggagatgttccgggactttgactacatcgctgactggtgctag

SEQ ID NO: 165941 - DNA, 2955 bp, Artificial Sequence
  Description of Artificial Sequence: Synthetic coding sequence
atggccagcaaccctgagcggggggagatcctgctgacagagctgcagggcgacagccgcagcctgcccttctctgaaaatgtgtctgctgtgcagaagctggacttcagtgacaccatggtgcagcagaagctggatgacatcaaggaccgcatcaagcgggagatcaggaaggagctgaagatcaaggagggcgctgagaacctgaggaaggtgaccacagacaagaagagcctggcctacgtggacaacatcctgaagaagagcaacaagaagctggaggagctgcaccacaagctgcaggagctgaatgcccacatcgtggtgtctgaccctgaggacatcacagactgccccaggaccccagacacccccaacaatgacccccgctgcagcaccagcaacaaccggctgaaggccctgcagaagcagctggacatcgagctgaaggtgaagcagggcgctgagaacatgatccagatgtacagcaatggcagcagcaaggacaggaagctgcatggaacagcccagcagctgctgcaggacagcaagaccaagattgaagtcatccgcatgcagatcctgcaggccgtgcagaccaatgagctggcctttgacaatgccaagcctgtgatcagccccctggagctgaggatggaggagctgcggcaccacttccgcatcgagtttgctgtggccgagggcgccaagaatgtgatgaagctgctgggcagcggcaaggtgacagacaggaaggccctgtctgaggcccaggcccgcttcaatgaaagcagccagaagctggacctgctgaagtacagcctggagcagaggctgaatgaggtgcccaagaaccaccccaagagccgcatcatcatcgaggagctgagcctggtggccgccagccccaccctgagcccccggcagagcatgatcagcacccagaaccagtacagcaccctgagcaagccagctgccctgaccggcaccctggaggtgcggctgatgggctgccaggacatcctggagaatgtgcccggccgcagcaaggccacctctgtggccctgcccggctggagccccagcgagaccaggagcagcttcatgagcaggaccagcaagagcaagagcggcagcagcaggaacctgctgaagacagatgacctgagcaatgatgtgtgtgctgtgctgaagctggacaacacagtggtgggccagacctcctggaagcccatcagcaaccagagctgggaccagaagttcaccctggagctggacaggagccgggagctggagatctctgtgtactggagggactggaggagcctgtgtgctgtgaagttcctgcggctggaggacttcctggacaaccagagacatggcatgtgcctgtacctggagccccagggcaccctgtttgctgaggtgaccttcttcaaccctgtgattgaaagaagacccaagctgcagaggcagaagaagatcttcagcaagcagcagggcaagaccttcctgcgggccccccagatgaacatcaacatcgccacctggggccgcctggtgcggcgggccatccccaccgtgaaccacagcggcaccttcagcccccaggcccctgtgcccaccaccgtgcctgtggtggatgtgcgcatcccccagctggcccccccagccagtgacagcacagtgaccaagctggactttgacctggagcctgagcccccaccagccccaccccgggccagcagcctgggggagattgatgagagcagcgagctgcgggtgctggacatccctggccaggacagcgagaccgtgtttgacatccagaatgacagaaattccatcctgcccaagagccagagcgagtacaagccagacaccccccagagcggcctggagtacagcggcatccaggagctggaggaccggcgcagccagcagcgcttccagttcaacctgcaggacttccgctgctgtgctgtgctgggccggggccactttgggaaggtgctgctggccgagtacaagaacaccaatgagatgtttgccatcaaggccctgaagaagggggacatcgtggccagagatgaggtggacagcctgatgtgtgagaagaggatctttgaaacagtgaacagcgtgcgccaccccttcctggtgaacctgtttgcctgcttccagaccaaggagcacgtgtgctttgtgatggagtatgctgctggaggagacctgatgatgcacatccacacagatgtgttttctgagcccagggctgtgttctatgctgcctgtgtggtgctgggcctgcagtacctgcacgagcacaagatcgtgtacagagacctgaagctggacaacctgctgctggacacagagggctttgtgaagattgctgactttggcctgtgcaaggagggcatgggctacggggacaggaccagcaccttctgtggcaccccagagttcctggcccctgaggtgctgacagagaccagctacaccagggctgtggactggtggggcctgggcgtgctgatctatgagatgctggtgggggagagccccttccctggagatgatgaggaggaggtgtttgacagcatcgtgaatgatgaggtgcgctacccccgcttcctgagcacagaggccatcagcatcatgaggcggctgctgcggaggaaccctgagcggcggctgggcgccagcgagaaggatgctgaagatgtgaagaagcaccccttcttccggctgattgactggagcgccctgatggacaagaaggtgaagccacccttcatccccaccatccggggcagagaagatgtgagcaactttgatgatgagttcaccagcgaggcccccatcctgaccccaccccgggagccccgcatcctgtctgaggaggagcaggagatgttccgggactttgactacatcgctgactggtgctag

SEQ ID NO: 165942 - DNA, 636 bp, Artificial Sequence
  Description of Artificial Sequence: Synthetic coding sequence
tgagaagagctgcggcaccacttccgcatcgagtttgctgtggccgagggcgccaagaatgtgatgaagctgctgggcagcggcaaggtgacagacaggaaggccctgtctgaggcccaggcccgcttcaatgaaagcagccagaagctggacctgctgaagtacagcctggagcagaggctgaatgaggtgcccaagaaccaccccaagagccgcatcatcatcgaggagctgagcctggtggccgccagccccaccctgagcccccggcagagcatgatcagcacccagaaccagtacagcaccctgagcaagccagctgccctgacagatgatgtgtgtgctgtgctgaagctggacaacacagtggtgggccagacctcctggaagcccatcagcaaccagagctgggaccagaagttcaccctggagctggacaggagccgggagctggagatctctgtgtactggagggactggaggagcctgtgtgctgtgaagttcctgcggctggaggacttcctggacaaccagagacatggcatgtgcctgtacctggagccccagggcaccctgtttgctgaggtgaccttcttcaaccctgtgattgaaagaagacccaagctgcagaggtag

SEQ ID NO: 165943 - DNA, 198 bp, Artificial Sequence
  Description of Artificial Sequence: Synthetic coding sequence
tgaggatttgtgaagattgctgactttggcctgtgcaaggagggcatgggctacggggacaggaccagcaccttctgtggcaccccagagttcctggcccctgaggtgctgacagagaccagctacaccagggctgtggactggtggggcctgggcgtgctgatctatgagatgctggtgggggagacctctgtgtag

SEQ ID NO: 165944 - DNA, 1977 bp, Artificial Sequence
  Description of Artificial Sequence: Synthetic coding sequence
atgaacagcaccctggaggtgcggctgatgggctgccaggacatcctggagaatgtgcccggccgcagcaaggccacctctgtggccctgcccggctggagccccagcgagaccaggagcagcttcatgagcaggaccagcaagagcaagagcggcagcagcaggaacctgctgaagacagatgacctgagcaatgatgtgtgtgctgtgctgaagctggacaacacagtggtgggccagacctcctggaagcccatcagcaaccagagctgggaccagaagttcaccctggagctggacaggagccgggagctggagatctctgtgtactggagggactggaggagcctgtgtgctgtgaagttcctgcggctggaggacttcctggacaaccagagacatggcatgtgcctgtacctggagccccagggcaccctgtttgctgaggtgaccttcttcaaccctgtgattgaaagaagacccaagctgcagaggcagaagaagatcttcagcaagcagcagggcaagaccttcctgcgggccccccagatgaacatcaacatcgccacctggggccgcctggtgcggcgggccatccccaccgtgaaccacagcggcaccttcagcccccaggcccctgtgcccaccaccgtgcctgtggtggatgtgcgcatcccccagctggcccccccagccagtgacagcacagtgaccaagctggactttgacctggagcctgagcccccaccagccccaccccgggccagcagcctgggggagattgatgagagcagcgagctgcgggtgctggacatccctggccaggacagcgagaccgtgtttgacatccagaatgacagaaattccatcctgcccaagagccagagcgagtacaagccagacaccccccagagcggcctggagtacagcggcatccaggagctggaggaccggcgcagccagcagcgcttccagttcaacctgcaggacttccgctgctgtgctgtgctgggccggggccactttgggaaggtgctgctggccgagtacaagaacaccaatgagatgtttgccatcaaggccctgaagaagggggacatcgtggccagagatgaggtggacagcctgatgtgtgagaagaggatctttgaaacagtgaacagcgtgcgccaccccttcctggtgaacctgtttgcctgcttccagaccaaggagcacgtgtgctttgtgatggagtatgctgctggaggagacctgatgatgcacatccacacagatgtgttttctgagcccagggctgtgttctatgctgcctgtgtggtgctgggcctgcagtacctgcacgagcacaagatcgtgtacagagacctgaagctggacaacctgctgctggacacagagggctttgtgaagattgctgactttggcctgtgcaaggagggcatgggctacggggacaggaccagcaccttctgtggcaccccagagttcctggcccctgaggtgctgacagagaccagctacaccagggctgtggactggtggggcctgggcgtgctgatctatgagatgctggtgggggagagccccttccctggagatgatgaggaggaggtgtttgacagcatcgtgaatgatgaggtgcgctacccccgcttcctgagcacagaggccatcagcatcatgaggcggctgctgcggaggaaccctgagcggcggctgggcgccagcgagaaggatgctgaagatgtgaagaagcaccccttcttccggctgattgactggagcgccctgatggacaagaaggtgaagccacccttcatccccaccatccggggcagagaagatgtgagcaactttgatgatgagttcaccagcgaggcccccatcctgaccccaccccgggagccccgcatcctgtctgaggaggagcaggagatgttccgggactttgactacatcgctgactggtgctag

SEQ ID NO: 165945 - DNA, 336 bp, Artificial Sequence
  Description of Artificial Sequence: Synthetic coding sequence
atgcacatccacacagatgtgttttctgagcccagggctgtgttctatgctgcctgtgtggtgctgggcctgcagtacctgcacgagcacaagatcgtgtacagagacctgaagctggacaacctgctgctggacacagagggctttgtgaagattgctgactttggcctgtgcaaggagggcatgggctacggggacaggaccagcaccttctgtggcaccccagagttcctggcccctgaggtgctgacagagaccagctacaccagggctgtggactggtggggcctgggcgtgctgatctatgagatgctggtgggggagacctctgtgtag

SEQ ID NO: 165946 - DNA, 2670 bp, Artificial Sequence
  Description of Artificial Sequence: Synthetic coding sequence
atggaggagggcgccccccggcagcccggccccagccagtggcccccagaagatgagaaggaggtgatccggcgggccatccagaaggagctgaagatcaaggagggcgtggagaacctgcggcgggtggccacagacagaagacacctgggccacgtgcagcagctgctgcggagcagcaacagaaggctggagcagctgcacggggagctgcgggagctgcacgcccgcatcctgctgcccggccctggccctggccctgctgagcctgtggccagcggcccccggccctgggccgagcagctgcgggcccggcacctggaggccctgcggcggcagctgcacgtggagctgaaggtgaagcagggcgctgagaacatgacccacacctgtgccagcggcacccccaaggagaggaagctgctggccgccgcccagcagatgctgcgggacagccagctgaaggtggccctgctgaggatgaagatcagcagcctggaggccagcggcagccctgagcccggccctgagctgctggccgaggagctgcagcaccggctgcacgtggaggccgctgtggccgagggcgccaagaatgtggtgaagctgctgagcagcaggaggacccaggacaggaaggccctggccgaggcccaggcccagctgcaggagagcagccagaagctggacctgctgcggctggccctggagcagctgctggagcagctgcccccagcccaccccctgcggagccgggtgacccgggagctgcgggctgctgtgcccggctacccccagcccagcggcacccctgtgaagcccacagccctgaccggcaccctgcaggtgcggctgctgggctgtgagcagctgctgacagctgtgcccggccgcagccctgctgctgccctggccagcagccccagcgagggctggctgcggaccaaggccaagcaccagaggggccgcggggagctggccagcgaggtgctggccgtgctgaaggtggacaacagagtggtgggccagacaggctggggccaggtggccgagcagagctgggaccagaccttcgtcatccccctggagcgggcccgggagctggagattggagtgcactggagggactggaggcagctgtgtggggtggccttcctgcggctggaggacttcctggacaatgcctgccaccagctgagcctgagcctggtgccccagggcctgctgtttgcccaggtgaccttctgtgaccccgtcatcgagcggcggccccggctgcagaggcaggagcgcatcttcagcaagaggcggggccaggacttcctgcgggccagccagatgaacctgggcatggccgcctggggccgcctggtgatgaacctgctgcccccctgcagcagccccagcaccatcagcccccccaagggctgccccaggacccccaccaccctgcgggaggccagtgaccctgccacccccagcaacttcctgcccaagaagacccccctgggggaggagatgaccccaccacccaagccaccccggctgtacctgccccaggagcccaccagcgaggagacccccaggaccaagaggccccacatggagcccaggacccggcggggccccagccccccagccagccccaccaggaagccaccccggctgcaggacttccgctgcctggccgtgctgggccggggccactttgggaaggtgctgctggtgcagttcaagggcaccgggaagtactatgccatcaaggccctgaagaagcaggaggtgctgagcagagatgaaattgagagcctgtactgtgagaagaggatcctggaggccgtgggctgcaccggccaccccttcctgctgagcctgctggcctgcttccagaccagcagccacgcctgctttgtgacagaatttgtgcctggaggagacctgatgatgcagatccatgaagatgtgtttcctgagccccaggcccgcttctacgtggcctgtgtggtgctgggcctgcagttcctgcacgagaagaagatcatctacagagacctgaagctggacaacctgctgctggatgcccagggcttcctgaagattgctgactttggcctgtgcaaggagggcatcggctttggagacaggaccagcaccttctgtggcaccccagagttcctggcccctgaggtgctgacccaggaggcctacaccagggctgtggactggtggggcctgggcgtgctgctgtatgagatgctggtgggggagtgccccttccctggggacacagaggaggaggtgtttgactgcatcgtgaacatggatgccccctacccaggcttcctgtctgtgcagggcctggagttcatccagaagctgctgcagaagtgcccagagaagaggctgggcgctggggagcaggatgctgaggagatcaaggtgcagcccttcttccgcaccaccaactggcaggccctgctggcccggaccatccagcccccatttgtgcccaccctgtgtggccctgctgacctgcgctactttgaaggagagttcaccggcctgcccccagccctgaccccaccagccccccacagcctgctgacagcccggcagcaggccgccttccgggactttgattttgtgtctgagcgcttcctggagccctag

SEQ ID NO: 165947 - DNA, 1725 bp, Artificial Sequence
  Description of Artificial Sequence: Synthetic coding sequence
atgaggcggctgagctcctggaggaagatggccacagctgagaagcagaagcatgatggccgggtgaagattggccactacatcctgggggacaccctgggcgtgggcaccttcggcaaggtgaaggtgggcaagcatgagctgaccggccacaaggtggccgtgaagatcctgaaccggcagaagatccgcagcctggatgtggtgggcaagatcagaagagagatccagaacctgaagctgttccgccacccccacatcatcaagctgtaccaggtgatcagcacccccagcgacatcttcatggtgatggagtatgtgtctggaggagagctgtttgactacatctgcaagaatggaaggaagagtgatgtgcctggggtggtgaagacaggcagcaccaaggagctggatgagaaggagagcagaagactcttccagcagatcctgtctggagtggactactgccaccgccacatggtggtgcaccgggacctgaagccagaaaatgtgctgctggatgcccacatgaatgccaagattgctgactttggcctgagcaacatgatgtctgatggagagttcctgcggaccagctgtggcagccccaactatgctgcccctgaggtgatcagcggccgcctgtatgccggccctgaggtggacatctggagcagcggggtcatcctgtatgccctgctgtgtggcaccctgccctttgatgatgaccacgtgcccaccctcttcaagaagatctgtgatggcatcttctacaccccccagtacctgaaccccagcgtcatcagcctgctgaagcacatgctgcaggtggaccccatgaagagggccaccatcaaggacatccgggagcacgagtggttcaagcaggacctgcccaagtacctgtttcctgaggaccccagctacagcagcaccatgattgatgatgaggccctgaaggaggtgtgtgagaagtttgaatgttctgaggaggaggtgctgagctgcctgtacaacagaaaccaccaggaccccctggccgtggcctaccacctgatcatcgacaacagacgcatcatgaatgaggccaaggacttctacctggccaccagccccccagacagcttcctggatgaccaccacctgacccggccccaccctgagcgggtgcccttcctggtggccgagaccccccgggcccggcacaccctggatgagctgaacccccagaagagcaagcaccagggcgtgaggaaggccaagtggcacctgggcatccgcagccagagccggcccaatgacatcatggccgaggtgtgccgggccatcaagcagctggactatgagtggaaggtggtgaacccctactacctgcgggtgcggaggaagaaccctgtgaccagcacctacagcaagatgagcctgcagctgtaccaggtggacagcaggacctacctgctggacttccgcagcattgatgatgagatcacagaggccaagtctggaacagccaccccccagaggagcggctctgtgagcaactaccgcagctgccagaggagtgacagtgatgctgaggcccagggcaagagcagcgaggtgtccctgaccagctctgtgaccagcctggacagcagccctgtggacctgaccccccggcccggcagccacaccatcgagttctttgagatgtgtgccaacctgatcaagatcctggcccagtag

SEQ ID NO: 165948 - DNA, 1680 bp, Artificial Sequence
  Description of Artificial Sequence: Synthetic coding sequence
atgaggcggctgagctcctggaggaagatggccacagctgagaagcagaagcatgatggccgggtgaagattggccactacatcctgggggacaccctgggcgtgggcaccttcggcaaggtgaaggtgggcaagcatgagctgaccggccacaaggtggccgtgaagatcctgaaccggcagaagatccgcagcctggatgtggtgggcaagatcagaagagagatccagaacctgaagctgttccgccacccccacatcatcaagctgtaccaggtgatcagcacccccagcgacatcttcatggtgatggagtatgtgtctggaggagagctgtttgactacatctgcaagaatggccgcctggatgagaaggagagccggcggctcttccagcagatcctgagcggcgtggactactgccaccgccacatggtggtgcaccgggacctgaagccagaaaatgtgctgctggatgcccacatgaatgccaagattgctgactttggcctgagcaacatgatgtctgatggagagttcctgcggaccagctgtggcagccccaactatgctgcccctgaggtgatcagcggccgcctgtatgccggccctgaggtggacatctggagcagtggagtcatcctgtatgccctgctgtgtggcaccctgccctttgatgatgaccacgtgcccaccctcttcaagaagatctgtgatggcatcttctacaccccccagtacctgaaccccagcgtcatcagcctgctgaagcacatgctgcaggtggaccccatgaagagggccaccatcaaggacatccgggagcacgagtggttcaagcaggacctgcccaagtacctgtttcctgaggaccccagctacagcagcaccatgattgatgatgaggccctgaaggaggtgtgtgagaagtttgagtgcagcgaggaggaggtgctgagctgcctgtacaacagaaaccaccaggaccccctggccgtggcctaccacctgatcatcgacaacagacgcatcatgaatgaggccaaggacttctacctggccaccagccccccagacagcttcctggatgaccaccacctgacccggccccaccctgagcgggtgcccttcctggtggccgagaccccccgggcccggcacaccctggatgagctgaacccccagaagagcaagcaccagggcgtgaggaaggccaagtggcacctgggcatccgcagccagagccggcccaatgacatcatggccgaggtgtgccgggccatcaagcagctggactatgagtggaaggtggtgaacccctactacctgcgggtgcggaggaagaaccctgtgaccagcacctacagcaagatgagcctgcagctgtaccaggtggacagcaggacctacctgctggacttccgcagcattgatgatgagatcacagaggccaagagcggcacagccaccccccagaggagcggctctgtgagcaactaccgcagctgccagaggagtgacagtgatgctgaggcccagggcaagagcagcgaggtgtccctgaccagctctgtgaccagcctggacagcagccctgtggacctgacccccaggcctggcagccacaccatcgagttctttgagatgtgtgccaacctgatcaagatcctggcccagtag

SEQ ID NO: 165949 - DNA, 1659 bp, Artificial Sequence
  Description of Artificial Sequence: Synthetic coding sequence
atggccgagaagcagaagcatgatggccgggtgaagattggccactacgtgctgggggacaccctgggcgtgggcaccttcggcaaggtgaagatcggggagcaccagctgaccggccacaaggtggccgtgaagatcctgaaccggcagaagatccgcagcctggatgtggtgggcaagatcaagcgggagatccagaacctgaagctgttccgccacccccacatcatcaagctgtaccaggtgatcagcacccccacagacttcttcatggtgatggagtatgtgtctggaggagagctgtttgactacatctgcaagcacggccgggtggaggagatggaggcccggcggctcttccagcagatcctgtctgctgtggactactgccaccgccacatggtggtgcaccgggacctgaagccagaaaatgtgctgctggatgcccacatgaatgccaagattgctgactttggcctgagcaacatgatgtctgatggagagttcctgcggaccagctgtggcagccccaactatgctgcccctgaggtgatcagcggccgcctgtatgccggccctgaggtggacatctggagctgtggggtcatcctgtatgccctgctgtgtggcaccctgccctttgatgatgagcacgtgcccaccctcttcaagaagatccggggcggcgtcttctacatccctgagtacctgaacagatctgtggccaccctgctgatgcacatgctgcaggtggaccccctgaagagggccaccatcaaggacatccgggagcacgagtggttcaagcaggacctgcccagctacctgtttcctgaggaccccagctatgatgccaacgtgattgatgatgaggccgtgaaggaggtgtgtgagaagtttgaatgtacagaaagtgaggtgatgaacagcctgtacagcggggacccccaggaccagctggccgtggcctaccacctgatcatcgacaacagacgcatcatgaaccaggccagcgagttctacctggccagcagcccccccagcggcagcttcatggatgattctgccatgcacatccccccaggcctgaagccccaccctgagaggatgccacccctgattgctgacagccccaaggcccgctgccccctggatgccctgaacaccaccaagcccaagagcctggccgtgaagaaggccaagtggcacctgggcatccgcagccagagcaagccctatgacatcatggccgaggtgtaccgggccatgaagcagctggactttgagtggaaggtggtgaatgcctaccacctgcgggtgcggaggaagaaccctgtgactggaaactacgtgaagatgagcctgcagctgtacctggtggacaacagaagctacctgctggacttcaagagcattgatgatgaggtggtggagcagaggagcggcagcagcaccccccagaggagctgcagcgctgctggcctgcaccggcccaggagcagctttgacagcaccacagctgagagccacagcctgagcggcagcctgaccggcagcctgaccggcagcaccctgagctctgtgagcccccggctgggcagccacaccatggacttctttgagatgtgtgccagcctcatcaccaccctggccaggtag

SEQ ID NO: 165950 - DNA, 744 bp, Artificial Sequence
  Description of Artificial Sequence: Synthetic coding sequence
atgctgaccatcacagacttcatcaacatcctgcaccgctactacaagagcgccctggtgcagatctatgagctggaggagcacaagattgagacctggagggaggtgtacctgcaggacagcttcaagcccctggtgtgcatcagccccaatgccagcctgtttgatgctgtgagcagcctcatccggaacaagatccaccggctgcccgtcatcgaccctgagagcggcaacaccctgtacatcctgacccacaagaggatcctgaagttcctgaagctgttcatcacagagttccccaagccagagttcatgagcaagagcctggaggagctgcagatcggcacctacgccaacatcgccatggtgaggaccaccacccctgtgtatgtggccctgggcatctttgtgcagcaccgggtgtctgccctgcctgtggtggatgagaagggccgggtggtggacatctacagcaagtttgatgtgatcaacctggccgctgagaagacctacaacaacctggatgtgtctgtgaccaaggccctgcagcacaggagccactactttgaaggagtgctgaagtgctacctgcacgagaccctggagaccatcatcaaccggctggtggaggccgaggtgcaccggctggtggtggtggatgaaaatgatgtggtgaagggcatcgtgtccctgagtgacatcctgcaggccctggtgctgactggaggagagaagaagccctag

SEQ ID NO: 165951 - DNA, 996 bp, Artificial Sequence
  Description of Artificial Sequence: Synthetic coding sequence
atggagaccgtcatcagcagtgacagcagccctgctgtggagaatgagcacccccaggagaccccagagagcaacaacagcgtgtacaccagcttcatgaagagccaccgctgctatgacctgatccccaccagcagcaagctggtggtgtttgacaccagcctgcaggtgaagaaggccttctttgccctggtgaccaatggagtgcgggccgcccccctgtgggacagcaagaagcagagctttgtgggcatgctgaccatcacagacttcatcaacatcctgcaccgctactacaagagcgccctggtgcagatctatgagctggaggagcacaagattgagacctggagggaggtgtacctgcaggacagcttcaagcccctggtgtgcatcagccccaatgccagcctgtttgatgctgtgagcagcctcatccggaacaagatccaccggctgcccgtcatcgaccctgagagcggcaacaccctgtacatcctgacccacaagaggatcctgaagttcctgaagctgttcatcacagagttccccaagccagagttcatgagcaagagcctggaggagctgcagatcggcacctacgccaacatcgccatggtgaggaccaccacccctgtgtatgtggccctgggcatctttgtgcagcaccgggtgtctgccctgcctgtggtggatgagaagggccgggtggtggacatctacagcaagtttgatgtgatcaacctggccgctgagaagacctacaacaacctggatgtgtctgtgaccaaggccctgcagcacaggagccactactttgaaggagtgctgaagtgctacctgcacgagaccctggagaccatcatcaaccggctggtggaggccgaggtgcaccggctggtggtggtggatgaaaatgatgtggtgaagggcatcgtgtccctgagtgacatcctgcaggccctggtgctgactggaggagagaagaagccctag

SEQ ID NO: 165952 - DNA, 1710 bp, Artificial Sequence
  Description of Artificial Sequence: Synthetic coding sequence
atgggcagcgctgtgatggacaccaagaagaagaaggatgtgagcagccctgggggcagcggcggcaagaagaatgccagccagaagaggaggagcctgcgggtgcacatcccagacctgagcagctttgccatgcccctgctggatggagacctggagggcagcggcaagcacagcagcaggaaggtggacagcccctttggacctggcagccccagcaagggcttcttcagccggggcccccagccccggcccagcagccccatgtctgcccctgtgcggcccaagaccagccctggcagccccaagacagtgttccccttctcctaccaggagagcccccccaggagccccaggaggatgtccttcagcggcatcttccgcagcagcagcaaggagagcagccccaacagcaacccagccaccagccctgggggcatccgcttcttcagccgcagcaggaagaccagcggcctgagcagcagccccagcacccccacccaggtgaccaagcagcacaccttccccctggagagctacaagcatgagcctgagcggctggagaaccgcatctatgccagcagcagccccccagacaccggccagcgcttctgccccagcagcttccagagccccaccaggcctcccctggccagccccacccactacgcccccagcaaggctgctgccctggccgccgccctgggccctgctgaggccggcatgctggagaagctggagtttgaagatgaggccgtggaggacagcgagagcggcgtgtacatgaggttcatgaggagccacaagtgctatgacatcgtgcccaccagcagcaagctggtggtgtttgacaccaccctgcaggtgaagaaggccttctttgccctggtggccaatggagtgcgggccgcccccctgtgggagagcaagaagcagagctttgtgggcatgctgaccatcacagacttcatcaacatcctgcaccgctactacaagagccccatggtgcagatctatgagctggaggagcacaagattgagacctggagggagctgtacctgcaggagaccttcaagcccctggtgaacatcagcccagatgccagcctgtttgatgctgtgtacagcctcatcaagaacaagatccaccggctgcccgtcatcgaccccatctctggaaatgccctgtacatcctgacccacaagaggatcctgaagttcctgcagctgttcatgtctgacatgcccaagccagccttcatgaagcagaacctggatgagctgggcatcggcacctaccacaacatcgccttcatccacccagacacccccatcatcaaggccctgaacatctttgtggagcggcgcatcagcgccctgcctgtggtggatgagagcggcaaggtggtggacatctacagcaagtttgatgtgatcaacctggccgctgagaagacctacaacaacctggacatcaccgtgacccaggccctgcagcacaggagccagtactttgaaggagtggtgaagtgcaacaagctggagatcctggagaccatcgtggaccgcatcgtgcgggcagaggtgcaccggctggtggtggtgaatgaggccgacagcatcgtgggcatcatcagcctgagtgacatcctgcaggccctgatcctgaccccagctggggccaagcagaaggagacagaaacagaatag

SEQ ID NO: 165953 - DNA, 1335 bp, Artificial Sequence
  Description of Artificial Sequence: Synthetic coding sequence
atgaagcgcttcggcagcctgcggagcaacaagaagcacaaggaccagaacagaagcacagagcggcggcagagcgagccccacggcctgtttgccagcggcctgagcagcagccccagcacccccacccaggtgaccaagcagcacaccttccccctggagagctacaagcatgagcctgagcggctggagaaccgcatctatgccagcagcagccccccagacaccggccagcgcttctgccccagcagcttccagagccccaccaggcctcccctggccagccccacccactacgcccccagcaaggctgctgccctggccgccgccctgggccctgctgaggccggcatgctggagaagctggagtttgaagatgaggtggaggacagcgagagcggcgtgtacatgaggttcatgaggagccacaagtgctatgacatcgtgcccaccagcagcaagctggtggtgtttgacaccaccctgcaggtgaagaaggccttctttgccctggtggccaacggggtgcgggccgcccccctgtgggagagcaagaagcagagctttgtgggcatgctgaccatcacagacttcatcaacatcctgcaccgctactacaagagccccatggtgcagatctatgagctggaggagcacaagattgagacctggagggagctgtacctgcaggagaccttcaagcccctggtgaacatcagcccagatgccagcctgtttgatgctgtgtacagcctcatcaagaacaagatccaccggctgcctgtgattgaccccatctctggaaatgccctgtacatcctgacccacaagaggatcctgaagttcctgcagctgttcatgtctgacatgcccaagccagccttcatgaagcagaacctggatgagctgggcatcggcacctaccacaacatcgccttcatccacccagacacccccatcatcaaggccctgaacatctttgtggagcggcgcatcagcgccctgcctgtggtggatgaaagtggcaaggtggtggacatctacagcaagtttgatgtgatcaacctggccgctgagaagacctacaacaacctggacatcaccgtgacccaggccctgcagcacaggagccagtactttgagggcgtggtgaagtgcaacaagctggagatcctggagaccatcgtggacagaattgtgcgggcagaggtgcaccggctggtggtggtgaatgaagctgacagcatcgtgggcatcatcagcctgagtgacatcctgcaggccctgatcctgaccccagctggggccaagcagaaggagacagaaacagaatag

SEQ ID NO: 165954 - DNA, 309 bp, Artificial Sequence
  Description of Artificial Sequence: Synthetic coding sequence
atggccggccaggccttcaggaagttcctgcccctgtttgacagagtgctggtggagaggtctgctgctgagaccgtgaccaagggcggcatcatgctgcctgagaagagccagggcaaggtgctgcaggccaccgtggtggccgtgggcagcggcagcaagggcaagggcggggagatccagcctgtgtctgtgaaggtgggggacaaggtgctgctgcctgaatatggaggcaccaaggtggtgctggatgacaaggactacttcctgttcagagatggagacatcctgggcaagtatgtggactag

SEQ ID NO: 165955 - DNA, 1062 bp, Artificial Sequence
  Description of Artificial Sequence: Synthetic coding sequence
atggagcccggcctggagcacgccctgcggaggacccccagctggagcagcctgggcggcagcgagcaccaggagatgtccttcctggagcaggagaacagcagctcctggcccagccctgctgtgaccagcagcagcgagcgcatccggggcaagagaagagccaaggccctgcgctggacccggcagaagtctgtggaggagggggagcccccaggccagggcgagggccccaggagcaggcctgctgctgagagcacaggcctggaggccaccttccccaagaccacccccctggcccaggccgaccctgctggggtgggcaccccacccaccggctgggactgcctgcccagcgactgcacagccagcgctgctggcagcagcacagatgatgtggagctggccacagagttccctgccacagaggcctgggagtgtgagctggagggcctgctggaggagaggcctgccctgtgcctgagcccccaggcccccttccccaagctgggctgggatgatgagctgaggaagccaggggcccagatctacatgaggttcatgcaggagcacacctgctatgatgccatggccaccagcagcaagctggtgatctttgacaccatgctggagatcaagaaggccttctttgccctggtggccaacggggtgcgggccgcccccctgtgggacagcaagaagcagagctttgtgggcatgctgaccatcacagacttcatcctggtgctgcaccgctactaccgcagccccctgcggagcacctgcaaggccgccagcagcctgtggagccccagcctgctgatgattgcctgcctgaagctgagcacccccagcagcaggacaggcagcatcgcctgcctcttcctgacccgctgccaggccacctacagcaccagcagccacaccaatgcctgcagcagcagctgcaccagcctggtgccctgctgccccggcccccccagcagcacagccctgagcaagatctgggccagcgcccacagcgagacctggctgtggtgctggaggcagcaccccagctag

SEQ ID NO: 165956 - DNA, 1395 bp, Artificial Sequence
  Description of Artificial Sequence: Synthetic coding sequence
atgtccttcctggagcaggagaacagcagctcctggcccagccctgctgtgaccagcagcagcgagcgcatccggggcaagaggcgggccaaggccctgcgctggacccggcagaagtctgtggaggagggggagcccccaggccagggcgagggccccaggagcaggcctgctgctgagagcacaggcctggaggccaccttccccaagaccacccccctggcccaggccgaccctgctggggtgggcaccccacccaccggctgggactgcctgcccagcgactgcacagccagcgctgctggcagcagcacagatgatgtggagctggccacagagttccctgccacagaggcctgggagtgtgagctggagggcctgctggaggagaggcctgccctgtgcctgagcccccaggcccccttccccaagctgggctgggatgatgagctgaggaagccaggggcccagatctacatgaggttcatgcaggagcacacctgctatgatgccatggccaccagcagcaagctggtgatctttgacaccatgctggagatcaagaaggccttctttgccctggtggccaatggagtgcgggccgcccccctgtgggacagcaagaagcagagctttgtgggcatgctgaccatcacagacttcatcctggtgctgcaccgctactaccgcagccccctggtgcagatctatgaaattgagcagcacaagattgagacctggagggagatctacctgcagggctgcttcaagcccctggtgtccatcagccccaatgacagcctgtttgaagctgtgtacaccctcatcaagaaccgcatccaccggctgcctgtgctggaccctgtgtctggaaatgtgctgcacatcctgacccacaagaggctgctgaagttcctgcacatcttcggcagcctgctgccccggcccagcttcctgtaccgcaccatccaggacctgggcatcggcaccttccgggacctggccgtggtgctggagacagcccccatcctgacagccctggacatctttgtggacagaagagtgtctgccctgcctgtggtgaatgaatgtggccaggtggtgggcctgtacagcagatttgatgtgatccacctggccgcccagcagacctacaaccacctggacatgtctgtgggggaggccctgcggcagaggaccctgtgcctggagggcgtgctgagctgccagccccatgagagcctgggggaggtgattgaccgcatcgcccgggagcaggtgcaccggctggtgctggtggatgagacccagcacctgctgggcgtggtgtccctgagtgacatcctgcaggccctggtgctgagccctgctggcattgatgccctgggcgcctag

SEQ ID NO: 165957 - DNA, 1470 bp, Artificial Sequence
  Description of Artificial Sequence: Synthetic coding sequence
atggagcccggcctggagcacgccctgcggaggacccccagctggagcagcctgggcggcagcgagcaccaggagatgtccttcctggagcaggagaacagcagctcctggcccagccctgctgtgaccagcagcagcgagcgcatccggggcaagagaagagccaaggccctgcgctggacccggcagaagtctgtggaggagggggagcccccaggccagggcgagggccccaggagcaggcctgctgctgagagcacaggcctggaggccaccttccccaagaccacccccctggcccaggccgaccctgctggggtgggcaccccacccaccggctgggactgcctgcccagcgactgcacagccagcgctgctggcagcagcacagatgatgtggagctggccacagagttccctgccacagaggcctgggagtgtgagctggagggcctgctggaggagaggcctgccctgtgcctgagcccccaggcccccttccccaagctgggctgggatgatgagctgaggaagccaggggcccagatctacatgaggttcatgcaggagcacacctgctatgatgccatggccaccagcagcaagctggtgatctttgacaccatgctggagatcaagaaggccttctttgccctggtggccaacggggtgcgggccgcccccctgtgggacagcaagaagcagagctttgtgggcatgctgaccatcacagacttcatcctggtgctgcaccgctactaccgcagccccctggtgcagatctatgaaattgagcagcacaagattgagacctggagggagatctacctgcagggctgcttcaagcccctggtgtccatcagccccaatgacagcctgtttgaggccgtgtacaccctcatcaagaaccgcatccaccggctgcctgtgctggaccctgtgtctggaaatgtgctgcacatcctgacccacaagaggctgctgaagttcctgcacatcttcggcagcctgctgccccggcccagcttcctgtaccgcaccatccaggacctgggcatcggcaccttccgggacctggccgtggtgctggagacagcccccatcctgacagccctggacatctttgtggaccggcgggtgtctgccctgcctgtggtgaatgaatgtggccaggtggtgggcctgtacagcagatttgatgtgatccacctggccgcccagcagacctacaaccacctggacatgtctgtgggggaggccctgcggcagaggaccctgtgcctggagggcgtgctgagctgccagccccatgagagcctgggggaggtgattgacagaattgcccgggagcaggtgcaccggctggtgctggtggatgagacccagcacctgctgggcgtggtgtccctgagtgacatcctgcaggccctggtgctgagccctgctggcattgatgccctgggcgcctag

SEQ ID NO: 165958 - DNA, 918 bp, Artificial Sequence
  Description of Artificial Sequence: Synthetic coding sequence
atgaggttcatgcaggagcacacctgctatgatgccatggccaccagcagcaagctggtgatctttgacaccatgctggagatcaagaaggccttctttgccctggtggccaacggggtgcgggccgcccccctgtgggacagcaagaagcagagctttgtgggcatgctgaccatcacagacttcatcctggtgctgcaccgctactaccgcagccccctggtgcagatctatgaaattgagcagcacaagattgagacctggagggagatctacctgcagggctgcttcaagcccctggtgtccatcagccccaatgacagcctgtttgaggccgtgtacaccctcatcaagaaccgcatccaccggctgcctgtgctggaccctgtgtctggaaatgtgctgcacatcctgacccacaagaggctgctgaagttcctgcacatcttcggcagcctgctgccccggcccagcttcctgtaccgcaccatccaggacctgggcatcggcaccttccgggacctggccgtggtgctggagacagcccccatcctgacagccctggacatctttgtggaccggcgggtgtctgccctgcctgtggtgaatgaatgtggccaggtggtgggcctgtacagcagatttgatgtgatccacctggccgcccagcagacctacaaccacctggacatgtctgtgggggaggccctgcggcagaggaccctgtgcctggagggcgtgctgagctgccagccccatgagagcctgggggaggtgattgacagaattgcccgggagcaggtgcaccggctggtgctggtggatgagacccagcacctgctgggcgtggtgtccctgagtgacatcctgcaggccctggtgctgagccctgctggcattgatgccctgggcgcctag

SEQ ID NO: 165959 - DNA, 1056 bp, Artificial Sequence
  Description of Artificial Sequence: Synthetic coding sequence
atgggaaatgctgctgctgccaagaagggcagcgagcaggagagcgtgaaggagttcctggccaaggccaaggaggacttcctgaagaagtgggagagccctgcccagaacacagcccacctggaccagtttgagcgcatcaagaccctgggcaccggcagctttggccgggtgatgctggtgaagcacaaggagaccggcaaccactacgccatgaagatcctggacaagcagaaggtggtgaagctgaagcagatcgagcacaccctgaatgagaagaggatcctgcaggccgtgaacttccccttcctggtgaagctggagttctccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccagcagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggccgccggctacccacccttctttgctgaccagcccatccagatctatgagaagatcgtgtctgggaaggtgcgcttccccagccacttcagcagtgacctgaaggacctgctgaggaacctgctgcaggtggacctgaccaagcgcttcggcaacctgaagaatggagtgaatgacatcaagaaccacaagtggtttgccaccacagactggatcgccatctaccagaggaaggtggaggcccccttcatccccaagttcaagggccctggggacaccagcaactttgatgattatgaggaggaggagatccgggtgtccatcaatgaaaaatgtgggaaggagttcagcgagttctag

SEQ ID NO: 165960 - DNA, 1032 bp, Artificial Sequence; identical to SEQ ID NO: 165929
  Description of Artificial Sequence: Synthetic coding sequence

SEQ ID NO: 165961 - DNA, 1056 bp, Artificial Sequence; identical to SEQ ID NO: 165959
  Description of Artificial Sequence: Synthetic coding sequence

SEQ ID NO: 165962 - DNA, 693 bp, Artificial Sequence
  Description of Artificial Sequence: Synthetic coding sequence
atgctggtgaagcacaaggagaccggcaaccactacgccatgaagatcctggacaagcagaaggtggtgaagctgaagcagatcgagcacaccctgaatgagaagaggatcctgcaggccgtgaacttccccttcctggtgaagctggagttctccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccagcagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggccgccggctacccacccttctttgctgaccagcccatccagatctatgagaagatcgtgtctgggaaggtgcgcagcggctgtggggacacagccctggaggagacagacaggagcctgctgacccaccccatcccctggggcgccctgctggtggtgcgcatcatctag

SEQ ID NO: 165963 - DNA, 1074 bp, Artificial Sequence
  Description of Artificial Sequence: Synthetic coding sequence
atgggcctgagcaggaagagcagtgatgccagcgcctgcagcagcagcgagatcagtgactttgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggccgccggctacccacccttctttgctgaccagcccatccagatctatgagaagatcgtgtctgggaaggtgcgcttccccagccacttcagcagtgacctgaaggacctgctgaggaacctgctgcaggtggacctgaccaagcgcttcggcaacctgaagaatggagtgtctgacatcaagacccacaagtggtttgccaccacagactggatcgccatctaccagaggaaggtggaggcccccttcatccccaagttccggggcagcggggacaccagcaactttgatgattatgaggaggaggacatccgggtgtccatcacagagaagtgtgccaaggagtttggagagttctag

SEQ ID NO: 165964 - DNA, 795 bp, Artificial Sequence
  Description of Artificial Sequence: Synthetic coding sequence
atgtctgccaggaagagcagtgatgccagcgcctgcagcagcagcgagatcagtgacagctttgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggccgccggctacccacccttctttgctgaccagcccatccagatctatgagaagatcgtgtctgggaagcagaacttctag

SEQ ID NO: 165965 - DNA, 942 bp, Artificial Sequence
  Description of Artificial Sequence: Synthetic coding sequence
atgccagacctgaagatcctgaagggcaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggccgccggctacccacccttctttgctgaccagcccatccagatctatgagaagatcgtgtctgggaaggtgcgcttccccagccacttcagcagtgacctgaaggacctgctgaggaacctgctgcaggtggacctgaccaagcgcttcggcaacctgaagaatggagtgtctgacatcaagacccacaagtggtttgccaccacagactggatcgccatctaccagaggaaggtggaggcccccttcatccccaagttccggggcagcggggacaccagcaactttgatgattatgaggaggaggacatccgggtgtccatcacagagaagtgtgccaaggagtttggagagttctag

SEQ ID NO: 165966 - DNA, 1068 bp, Artificial Sequence
  Description of Artificial Sequence: Synthetic coding sequence
atgggcctgagcaggaagagcagtgatgccagcgcctgcagcagcagcgagatctctgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggccgccggctacccacccttctttgctgaccagcccatccagatctatgagaagatcgtgtctgggaaggtgcgcttccccagccacttcagcagtgacctgaaggacctgctgaggaacctgctgcaggtggacctgaccaagcgcttcggcaacctgaagaatggagtgtctgacatcaagacccacaagtggtttgccaccacagactggatcgccatctaccagaggaaggtggaggcccccttcatccccaagttccggggcagcggggacaccagcaactttgatgattatgaggaggaggacatccgggtgtccatcacagagaagtgtgccaaggagtttggagagttctag

SEQ ID NO: 165967 - DNA, 738 bp, Artificial Sequence
  Description of Artificial Sequence: Synthetic coding sequence
atgggcctgctgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggccgccggctacccacccttctttgctgaccagcccatccagatctatgagaagatcgtgtctgggaagaacttctag

SEQ ID NO: 165968 - DNA, 1197 bp, Artificial Sequence
  Description of Artificial Sequence: Synthetic coding sequence
atggccgcctaccgggagcccccctgcaaccagtacacaggcaccaccacagccctgcagaagctggagggctttgccagccgcctcttccaccgccacagcaaaggaacagcccatgaccagaagacagccctggagaatgacagcctgcacttcagcgagcacacagccctgtgggaccgctccatgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggagaattggccgcttcagcgagccccacgcccgcttctatgctgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggctgctggctacccacccttctttgctgaccagcccatccagatctatgagaagatcgtgtctgggaaggtgcgcttccccagccacttcagcagtgacctgaaggacctgctgaggaacctgctgcaggtggacctgaccaagagatttggaaacctgaagaatggagtgtctgacatcaagacccacaagtggtttgccaccacagactggatcgccatctaccagaggaaggtggaggcccccttcatccccaagttccggggcagcggggacaccagcaactttgatgattatgaggaggaggacatccgggtgtccatcacagagaagtgtgccaaggagtttggagagttctag

SEQ ID NO: 165969 - DNA, 774 bp, Artificial Sequence
  Description of Artificial Sequence: Synthetic coding sequence
atgggaaatgctgccacagccaagaagggcagcgaggtggagagcgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggccgccggctacccacccttctttgctgaccagcccatccagatctatgagaagatcgtgtctgggaagaacttctag

SEQ ID NO: 165970 - DNA, 1056 bp, Artificial Sequence
  Description of Artificial Sequence: Synthetic coding sequence
atgggaaatgctgccacagccaagaagggcagcgaggtggagagcgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggccgccggctacccacccttctttgctgaccagcccatccagatctatgagaagatcgtgtctgggaaggtgcgcttccccagccacttcagcagtgacctgaaggacctgctgaggaacctgctgcaggtggacctgaccaagcgcttcggcaacctgaagaatggagtgtctgacatcaagacccacaagtggtttgccaccacagactggatcgccatctaccagaggaaggtggaggcccccttcatccccaagttccggggcagcggggacaccagcaactttgatgattatgaggaggaggacatccgggtgtccatcacagagaagtgtgccaaggagtttggagagttctag

SEQ ID NO: 165971 - DNA, 1077 bp, Artificial Sequence
  Description of Artificial Sequence: Synthetic coding sequence
atgggcctgagcaggaagagcagtgatgccagcgcctgcagcagcagcgagatcagtgacagctttgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggagaattggccgcttcagcgagccccacgcccgcttctatgctgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggctgctggctacccacccttctttgctgaccagcccatccagatctatgagaagatcgtgtctgggaaggtgcgcttccccagccacttcagcagtgacctgaaggacctgctgaggaacctgctgcaggtggacctgaccaagagatttggaaacctgaagaatggagtgtctgacatcaagacccacaagtggtttgccaccacagactggatcgccatctaccagaggaaggtggaggcccccttcatccccaagttccggggcagcggggacaccagcaactttgatgattatgaggaggaggacatccgggtgtccatcacagagaagtgtgccaaggagtttggagagttctag

SEQ ID NO: 165972 - DNA, 966 bp, Artificial Sequence
  Description of Artificial Sequence: Synthetic coding sequence
atgtctgccaggaagagcagtgatgccagcgcctgcagcagcagcgagatctctgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggccgccggctacccacccttctttgctgaccagcccatccagatctatgagaagatcgtgtctgggaaggtgcgcttccccagccacttcagcagtgacctgaaggacctgctgaggaacctgctgcaggtggacctgaccaagcgcttcggcaacctgaagaatggagtgtctgacatcaagacccacaagtggtttgccaccacagactggatcgccatctaccagaggaaggtggaggcccccttcatccccaagttccggggcagcggggacaccagcaactttgatgattatgaggaggaggacatccgggtgtccatcacagagaagtgtgccaaggagtttggagagttctag

SEQ ID NO: 165973 - DNA, 630 bp, Artificial Sequence
  Description of Artificial Sequence: Synthetic coding sequence
atgtctgcctgcagcagcagcgagatctctgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggagaattggccgcttcagcgagccccacgcccgcttctatgctgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagtag

SEQ ID NO: 165974 - DNA, 594 bp, Artificial Sequence
  Description of Artificial Sequence: Synthetic coding sequence
atgtctgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggagaattggccgcttcagcgagccccacgcccgcttctatgctgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatctag

SEQ ID NO: 165975 - DNA, 645 bp, Artificial Sequence
  Description of Artificial Sequence: Synthetic coding sequence
atgggcctgagctgcagcagcagcgagatctctgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccagagtacctggcccctgagatcatcctgagcaagggctacaacaagtag

SEQ ID NO: 165976 - DNA, 561 bp, Artificial Sequence
  Description of Artificial Sequence: Synthetic coding sequence
atgggcctgagcaggaagagcagtgatgccagcgcctgcagcagcagcgagatctctgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggcgcatcggccgcttcagcgagccccacgcccgcttctacgccgcccagatcgtgctgacctttgagtacctgcacagcctggacctgatctacagagacctgaagccagagaacctgctgattgaccaccagggctacatccagtag

SEQ ID NO: 165977 - DNA, 528 bp, Artificial Sequence
  Description of Artificial Sequence: Synthetic coding sequence
atgggcctgagcaggaagagcagtgatgccagcgcctgcagcagcagcgagatcagtgacagctttgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggagaattggccgcttcagcgagccccacgcccgcttctatgctgcccagatcgtgctgacctttgagtacctgcacagcctggacctgatctacagagacctgtag

SEQ ID NO: 165978 - DNA, 621 bp, Artificial Sequence
  Description of Artificial Sequence: Synthetic coding sequence
atgtctgccaggaagagcagtgatgccagcgcctgcagcagcagcgagatctctgtgaaggagttcctggccaaggccaaggaggacttcctgaagaagtgggagaaccccacccagaacaatgccggcctggaggactttgagaggaagaagaccctgggcaccggcagctttggccgggtgatgctggtgaagcacaaggccacagagcagtactatgccatgaagatcctggacaagcagaaggtggtgaagctgaagcagatcgagcacaccctgaatgagaagaggatcctgcaggccgtgaacttccccttcctggtgcggctggagtatgccttcaaggacaacagcaacctgtacatggtgatggagtatgtgcctggaggagagatgttcagccacctgcggagaattggccgcttcagcgagccccacgcccgcttctatgctgcccagatcgtgctgacctttgagtacctgcacagcctggacctgatctacagagacctgaagccagagaacctgctgattgaccaccagggctacatccaggtgacagactttggatttgccaagagggtgaagggccgcacctggaccctgtgtggcaccccctag

SEQ ID NO: 165979 - DNA, 1056 bp, Artificial Sequence
  Description of Artificial Sequence: Synthetic coding sequence
atgggaaatgccccagccaagaaggacacagagcaggaggagagcgtgaatgagttcctggccaaggcccggggggacttcctgtaccgctggggcaacccagcccagaacacagccagcagtgaccagtttgagcggctgcggaccctgggcatgggcagctttggccgggtgatgctggtgcgccaccaggagaccggcggccactacgccatgaagatcctgaacaagcagaaggtggtgaagatgaagcaggtggagcacatcctgaatgagaagaggatcctgcaggccatcgacttccccttcctggtgaagctgcagttctccttcaaggacaacagctacctgtacctggtgatggagtatgtgcctggaggagagatgttcagccggctgcagagggtgggccgcttcagcgagccccacgcctgcttctacgccgcccaggtggtgctggccgtgcagtacctgcacagcctggacctgatccaccgggacctgaagccagagaacctgctgattgaccagcagggctacctgcaggtgacagactttggatttgccaagagggtgaagggccgcacctggaccctgtgtggcaccccagagtacctggcccctgagatcatcctgagcaagggctacaacaaggctgtggactggtgggccctgggcgtgctgatctatgagatggctgtgggcttcccccccttctatgctgaccagcccatccagatctatgagaagatcgtgtctggccgggtgcgcttccccagcaagctgagcagtgacctgaagcacctgctgcggagcctgctgcaggtggacctgaccaagcgcttcggcaacctgagaaatggagtgggggacatcaagaaccacaagtggtttgccaccacctcctggatcgccatctatgagaagaaggtggaggcccccttcatccccaagtacacaggccctggagatgccagcaactttgatgattatgaggaggaggagctgcgcatcagcatcaatgaaaaatgtgccaaggagttcagcgagttctag

SEQ ID NO: 165980 - DNA, 1146 bp, Artificial Sequence; identical to SEQ ID NO: 165930
  Description of Artificial Sequence: Synthetic coding sequence

SEQ ID NO: 165981 - DNA, 1146 bp, Artificial Sequence; identical to SEQ ID NO: 165930
  Description of Artificial Sequence: Synthetic coding sequence

SEQ ID NO: 165982 - DNA, 1146 bp, Artificial Sequence; identical to SEQ ID NO: 165930
  Description of Artificial Sequence: Synthetic coding sequence

SEQ ID NO: 165983 - DNA, 1146 bp, Artificial Sequence; identical to SEQ ID NO: 165930
  Description of Artificial Sequence: Synthetic coding sequence

SEQ ID NO: 165984 - DNA, 243 bp, Artificial Sequence
  Description of Artificial Sequence: Synthetic coding sequence
atgggcagcaccctgaggaagaggaagatgtatgaggagttcctgagcaaggtgtccatcctggagagcctggagaagtgggagcggctgactgtggctgatgccctggagcctgtgcagtttgaagatggagagaagatcgtggtgcagggcgagcctggagatgacttctacatcatcacagagaagaacctgcccggggtggtggcccacgcctgcaaccccagctacctgggcggctag

SEQ ID NO: 165985 - DNA, 1146 bp, Artificial Sequence
  Description of Artificial Sequence: Synthetic coding sequence
atggccagccccccagcctgccccagtgaagaagatgagagcctgaagggctgtgagctgtatgtgcagctgcacggcatccagcaggtgctgaaggactgcatcgtgcacctgtgcatcagcaagccagagcggcccatgaagttcctgcgggagcactttgagaagctggagaaggaggagaaccggcagatcctggcccggcagaagagcaacagccagagcgacagccatgatgaggaggtgagccccaccccacccaaccctgtggtgaaggccaggagaagaagaggaggagtgtctgctgaggtgtacacagaggaggatgctgtgtcctatgtgaggaaggtgatccccaaggactacaagaccatgacagccctggccaaggccatcagcaagaatgtgctgtttgcccacctggatgacaatgaaagaagtgacatctttgatgccatgtttcctgtgacccacatcgccggggagaccgtcatccagcagggcaatgaaggagacaacttctacgtggtggaccagggcgaggtggatgtgtatgtgaatggagagtgggtgaccaacatcagcgagggcggcagctttggagagctggccctgatctacggcaccccccgggccgccaccgtgaaggccaagacagacctgaagctgtggggcatcgaccgggacagctaccgccgcatcctgatgggcagcaccctgaggaagaggaagatgtatgaggagttcctgagcaaggtgtccatcctggagagcctggagaagtgggagcggctgactgtggctgatgccctggagcctgtgcagtttgaagatggagagaagatcgtggtgcagggcgagcctggagatgacttctacatcatcacagagggcacagcctctgtgctgcagaggaggagccccaatgaggagtatgtggaggtgggccgcctgggccccagcgactactttggagaaattgccctgctgctgaaccggccccgggccgccaccgtggtggcccggggccccctgaagtgtgtgaagctggaccggcccaggtttgagcgggtgctgggcccctgcagcgagatcctgaagaggaacatccagcgctacaacagcttcatcagcctgactgtgtag

SEQ ID NO: 165986 - DNA, 1146 bp, Artificial Sequence; identical to SEQ ID NO: 165985
  Description of Artificial Sequence: Synthetic coding sequence

SEQ ID NO: 165987 - DNA, 1146 bp, Artificial Sequence; identical to SEQ ID NO: 165985
  Description of Artificial Sequence: Synthetic coding sequence

SEQ ID NO: 165988 - DNA, 498 bp, Artificial Sequence
  Description of Artificial Sequence: Synthetic coding sequence
atggccagccccccagcctgccccagtgaagaagatgagagcctgaagggctgtgagctgtatgtgcagctgcacggcatccagcaggtgctgaaggactgcatcgtgcacctgtgcatcagcaagccagagcggcccatgaagttcctgcgggagcactttgagaagctggagaaggaggagaaccggcagatcctggcccggcagaagagcaacagccagagcgacagccatgatgaggaggtgagccccaccccacccaaccctgtggtgaaggccaggagaagaagaggaggagtgtctgctgaggtgtacacagaggaggatgctgtgtcctatgtgaggaaggtgatccccaaggactacaagaccatgacagccctggccaaggccatcagcaagaatgtgctgtttgcccacctggatgacaatgaaagaagtgacatctttgatgccatgtttcctgtgacccacatcgccggggagaccgtcatctag

SEQ ID NO: 165989 - DNA, 894 bp, Artificial Sequence
  Description of Artificial Sequence: Synthetic coding sequence
atggccagccccccagcctgccccagtgaagaagatgagagcctgaagggctgtgagctgtatgtgcagctgcacggcatccagcaggtgctgaaggactgcatcgtgcacctgtgcatcagcaagccagagcggcccatgaagttcctgcgggagcactttgagaagctggagaaggaggagaaccggcagatcctggcccggcagaagagcaacagccagagcgacagccatgatgaggaggtgagccccaccccacccaaccctgtggtgaaggccaggagaagaagaggaggagtgtctgctgaggtgtacacagaggaggatgctgtgtcctatgtgaggaaggtgatccccaaggactacaagaccatgacagccctggccaaggccatcagcaagaatgtgctgtttgcccacctggatgacaatgaaagaagtgacatctttgatgccatgtttcctgtgacccacatcgccggggagaccgtcatccagcagggcaatgaaggagacaacttctacgtggtggaccagggcgaggtggatgtgtatgtgaatggagagtgggtgaccaacatcagcgagggcggcagctttggagagctggccctgatctacggcaccccccgggccgccaccgtgaaggccaagacagacctgaagctgtggggcatcgaccgggacagctaccgccgcatcctgatgggcagcaccctgaggaagaggaagatgtatgaggagttcctgagcaaggtgtccatcctggagagcctggagaagtgggagcggctgactgtggctgatgccctggagcctgtgcagtttgaagatggagagaagatcgtggtgcagggcgagcctggagatgacttctacatcatcacagaatag

SEQ ID NO: 165990 - DNA, 177 bp, Artificial Sequence
  Description of Artificial Sequence: Synthetic coding sequence
atggccagccccccagcctgccccagtgaagaagatgagagcctgaagggctgtgagctgtatgtgcagctgcacggcatccagcaggtgctgaaggactgcatcgtgcacctgtgcatcagcaagccagagcggcccatgaagttcctgcgggagcactttgagaagctggagtag

SEQ ID NO: 165991 - DNA, 1146 bp, Artificial Sequence; identical to SEQ ID NO: 165985
  Description of Artificial Sequence: Synthetic coding sequence

SEQ ID NO: 165992 - DNA, 1146 bp, Artificial Sequence; identical to SEQ ID NO: 165985
  Description of Artificial Sequence: Synthetic coding sequence

SEQ ID NO: 165993 - DNA, 1215 bp, Artificial Sequence
  Description of Artificial Sequence: Synthetic coding sequence
atgagccacatccagatccccccaggcctgacagagctgctgcagggctacacagtggaggtgctgcggcagcagcccccagacctggtggagtttgctgtggagtacttcacccggctgcgggaggcccgggccccagcctctgtgctgcctgctgccaccccccggcagagcctgggccaccccccacctgagcccggccctgacagagtggctgatgccaagggggacagcgagagcgaggaggatgaggacctggaggtgcctgtgcccagccgcttcaacagaagagtgtctgtgtgtgccgagacctacaacccagatgaggaggaggaggacacagaccccagggtcatccaccccaagacagatgagcagcgctgccgcctgcaggaggcctgcaaggacatcctgctcttcaagaacctggaccaggagcagctgagccaggtgctggatgccatgtttgaaagaattgtgaaggcagatgaacatgtgattgaccagggagatgatggagacaacttctacgtgattgagcggggcacctatgacatcctggtgaccaaggacaaccagaccaggtctgtgggccagtatgacaacagaggcagctttggagagctggccctgatgtacaacaccccccgggccgccaccatcgtggccaccagcgagggcagcctgtggggcctggacagagtgaccttccgccgcatcatcgtgaagaacaatgccaagaagaggaagatgtttgagagcttcatcgagagcgtgcccctgctgaagagcctggaggtgtctgagaggatgaagatcgtggatgtgattggagagaagatctacaaggatggagagcgcatcatcacccagggcgagaaggctgacagcttctacatcattgaaagtggagaggtgtccatcctgatccgcagcaggaccaagagcaacaaggatggcggcaaccaggaggtggagatcgcccgctgccacaagggccagtactttggagagctggccctggtgaccaacaagccccgggccgccagcgcctatgctgtgggagatgtgaagtgcctggtgatggatgtgcaggcctttgagcggctgctgggcccctgcatggacatcatgaagaggaacatcagccactatgaggagcagctggtgaagatgtttggcagctctgtggacctgggcaacctgggccagtag

SEQ ID NO: 165994 - DNA, 1149 bp, Artificial Sequence
  Description of Artificial Sequence: Synthetic coding sequence
atgagccacatccagatccccccaggcctgacagagctgctgcagggctacacagtggaggtgctgcggcagcagcccccagacctggtggagtttgctgtggagtacttcacccggctgcgggaggcccgggccccagcctctgtgctgcctgctgccaccccccggcagagcctgggccaccccccacctgagcccggccctgacagagtggctgatgccaagggggacagcgagagcgaggaggatgaggacctggaggtgcctgtgcccagccgcttcaacagaagagtgtctgtgtgtgccgagacctacaacccagatgaggaggaggaggacacagaccccagggtcatccaccccaagacagatgagcagcgctgccgcctgcaggaggcctgcaaggacatcctgctcttcaagaacctggaccaggagcagctgagccaggtgctggatgccatgtttgaaagaattgtgaaggcagatgaacatgtgattgaccagggagatgatggagacaacttctacgtgattgagcggggcacctatgacatcctggtgaccaaggacaaccagaccaggtctgtgggccagtatgacaacagaggcagctttggagagctggccctgatgtacaacaccccccgggccgccaccatcgtggccaccagcgagggcagcctgtggggcctggacagagtgaccttccgccgcatcatcgtgaagaacaatgccaagaagaggaagatgtttgagagcttcatcgagagcgtgcccctgctgaagagcctggaggtgtctgagaggatgaagatcgtggatgtgattggagagaagatctacaaggatggagagcgcatcatcacccagaccaagagcaacaaggatggcggcaaccaggaggtggagatcgcccgctgccacaagggccagtactttggagagctggccctggtgaccaacaagccccgggccgccagcgcctatgctgtgggagatgtgaagtgcctggtgatggatgtgcaggcctttgagcggctgctgggcccctgcatggacatcatgaagaggaacatcagccactatgaggagcagctggtgaagatgtttggcagctctgtggacctgggcaacctgggccagtag

SEQ ID NO: 165995 - DNA, 1215 bp, Artificial Sequence; identical to SEQ ID NO: 165993
  Description of Artificial Sequence: Synthetic coding sequence

SEQ ID NO: 165996 - DNA, 1257 bp, Artificial Sequence
  Description of Artificial Sequence: Synthetic coding sequence
atgagcattgagatcccagctggcctgacagagctgctgcagggcttcaccgtggaggtgctgcggcaccagcctgctgacctgctggagtttgccctgcagcacttcacccggctgcagcaggagaatgaaaggaagggcacagccaggtttggacatgagggccgcacctggggagacctgggcgctgctgctgggggcggcacccccagcaagggcgtgaactttgctgaggagcccatgcagagcgacagtgaagatggagaggaggaggaggccgccccagcagatgctggggccttcaatgcccctgtgatcaaccgcttcacccggcgggcctctgtgtgtgccgaggcctacaacccagatgaggaggaggatgatgctgagagccgcatcatccaccccaagacagatgaccagaggaaccggctgcaggaggcctgcaaggacatcctgctcttcaagaacctggaccctgagcagatgagccaggtgctggatgccatgtttgagaagctggtgaaggatggagagcacgtgattgaccagggagatgatggagacaacttctacgtgattgaccggggcacctttgacatctacgtgaagtgtgatggagtgggccgctgtgtgggcaactatgacaacagaggcagctttggagagctggccctgatgtacaacacccccagggctgccaccatcacagccaccagccctggggccctgtggggcctggacagagtgaccttccgccgcatcatcgtgaagaacaatgccaagaagaggaagatgtatgagagcttcatcgagagcctgcccttcctgaagagcctggagttcagcgagcggctgaaggtggtggatgtgattggcaccaaggtgtacaatgatggagagcagatcatcgcccagggcgacagcgctgacagcttcttcatcgtggagagcggggaggtgaagatcaccatgaagaggaagggcaagtctgaggtggaggagaatggagctgtggagatcgcccgctgcagccggggccagtactttggagagctggccctggtgaccaacaagccccgggccgccagcgcccacgccatcggcaccgtgaagtgcctggccatggatgtgcaggcctttgagcggctgctgggcccctgcatggagatcatgaagaggaacatcgccacctatgaggagcagctggtggccctgtttggcaccaacatggacatcgtggagcccacagcctag

SEQ ID NO: 165997 - DNA, 1218 bp, Artificial Sequence
  Description of Artificial Sequence: Synthetic coding sequence
atgagcattgagatcccagctggcctgacagagctgctgcagggcttcaccgtggaggtgctgcggcaccagcctgctgacctgctggagtttgccctgcagcacttcacccggctgcagcaggagaatgaaaggaagggcacagccaggtttggacatgagggccgcacctggggagacctgggcgctgctgctgggggcggcacccccagcaagggcgtgaactttgctgaggaggccgccccagcagatgctggggccttcaatgcccctgtgatcaaccgcttcacccggcgggcctctgtgtgtgccgaggcctacaacccagatgaggaggaggatgatgctgagagccgcatcatccaccccaagacagatgaccagaggaaccggctgcaggaggcctgcaaggacatcctgctcttcaagaacctggaccctgagcagatgagccaggtgctggatgccatgtttgagaagctggtgaaggatggagaacatgtgattgaccagggagatgatggagacaacttctacgtgattgaccggggcacctttgacatctacgtgaagtgtgatggagtgggccgctgtgtgggcaactatgacaacagaggcagctttggagagctggccctgatgtacaacaccccccgggccgccaccatcacagccaccagccctggggccctgtggggcctggacagagtgaccttccgccgcatcatcgtgaagaacaatgccaagaagaggaagatgtatgagagcttcatcgagagcctgcccttcctgaagagcctggagttcagcgagcggctgaaggtggtggatgtgattggcaccaaggtgtacaatgatggagagcagatcatcgcccagggcgacagcgctgacagcttcttcatcgtggagagcggggaggtgaagatcaccatgaagaggaagggcaagtctgaggtggaggagaatggagctgtggagatcgcccgctgcagccggggccagtactttggagagctggccctggtgaccaacaagcccagggctgccagcgcccacgccatcggcaccgtgaagtgcctggccatggatgtgcaggcctttgagcggctgctgggcccctgcatggagatcatgaagagaaatattgccacctatgaggagcagctggtggccctgtttggcaccaacatggacatcgtggagcccacagcctag

SEQ ID NO: 165998 - DNA, 1257 bp, Artificial Sequence; identical to SEQ ID NO: 165996
  Description of Artificial Sequence: Synthetic coding sequence

SEQ ID NO: 165999 - DNA, 1170 bp, Artificial Sequence
  Description of Artificial Sequence: Synthetic coding sequence
atggagaagcagaacatgttcctgcacggcagctacatcctgcgggaggatgtgaggacagccaacgtgattgctgctgaggccgtgacctgcctggtgattgaccgggacagcttcaagcacctgattggaggcctggatgatgtgagcaacaaggcctatgaagatgctgaggccaaggccaagtatgaagctgaggccgccttctttgccaacctgaagctgagtgacttcaacatcatcgacaccctgggcgtgggcggcttcggccgggtggagctggtgcagctgaagtctgaggagagcaagacctttgccatgaagatcctgaagaagaggcacatcgtggacacccggcagcaggagcacatccgctctgagaagcagatcatgcagggcgcccacagcgacttcatcgtgcggctgtaccgcaccttcaaggacagcaagtacctgtacatgctgatggaggcctgcctgggcggggagctgtggaccatcctgcgggaccggggcagctttgaggacagcaccacccgcttctacacagcctgtgtggtggaggcctttgcctacctgcacagcaagggcatcatctacagagacctgaagccagagaacctgatcctggaccaccggggctacgccaagctggtggactttggatttgccaagaagattggatttgggaagaagacctggaccttctgtggcaccccagaatatgtggcccctgagatcatcctgaacaagggccatgacatctctgctgactactggagcctgggcatcctgatgtatgagctgctgaccggcagcccccccttcagcggccctgaccccatgaagacctacaacatcatcctgcggggcatcgacatgattgagttccccaagaagatcgccaagaatgctgccaacctgatcaagaagctgtgccgggacaaccccagcgagcggctgggcaacctgaagaatggagtgaaggacatccagaagcacaagtggtttgagggcttcaactgggagggcctgaggaagggcaccctgaccccacccatcatccccagcgtggccagccccacagacaccagcaactttgacagcttccctgaggacaatgatgagcccccaccagatgacaacagcggctgggacatcgacttctag

SEQ ID NO: 166000 - DNA, 852 bp, Artificial Sequence
  Description of Artificial Sequence: Synthetic coding sequence
atgaagatcctgaagaagaggcacatcgtggacacccggcagcaggagcacatccgctctgagaagcagatcatgcagggcgcccacagcgacttcatcgtgcggctgtaccgcaccttcaaggacagcaagtacctgtacatgctgatggaggcctgcctgggcggggagctgtggaccatcctgcgggaccggggcagctttgaggacagcaccacccgcttctacacagcctgtgtggtggaggcctttgcctacctgcacagcaagggcatcatctacagagacctgaagccagagaacctgatcctggaccaccggggctacgccaagctggtggactttggatttgccaagaagattggatttgggaagaagacctggaccttctgtggcaccccagaatatgtggcccctgagatcatcctgaacaagggccatgacatctctgctgactactggagcctgggcatcctgatgtatgagctgctgaccggcagcccccccttcagcggccctgaccccatgaagacctacaacatcatcctgcggggcatcgacatgattgagttccccaagaagatcgccaagaatgctgccaacctgatcaagaagctgtgccgggacaaccccagcgagcggctgggcaacctgaagaatggagtgaaggacatccagaagcacaagtggtttgagggcttcaactgggagggcctgaggaagggcaccctgaccccacccatcatccccagcgtggccagccccacagacaccagcaactttgacagcttccctgaggacaatgatgagcccccaccagatgacaacagcggctgggacatcgacttctag

SEQ ID NO: 166001 - DNA, 546 bp, Artificial Sequence
  Description of Artificial Sequence: Synthetic coding sequence
agctgcatcatcaaggagggagatgtgggcagcctggtgtatgtgatggaggatggcaaggtggaggtgaccaaggagggcgtgaagctgtgcaccatgggccctgggaaggtgtttggagagctggccatcctgtacaactgcaccaggacagccaccgtgaagaccctggtgaatgtgaagctgtgggccatcgaccggcagtgcttccagaccatcatgatgaggacaggcctcatcaagcacacagagtacatggagttcctgaagtctgtgcccaccttccagagcctgcctgaggagatcctgagcaagctggctgatgtgctggaggagacccactatgaaaatggagagtacatcatccggcagggcgcccggggggacaccttcttcatcatcagcaagggcaccgtgaatgtgacccgggaggacagccccagtgaagatcctgtgttcctgcggaccctgggcaaaggagactggtttggagagaaggccctgcagggctggacctggaacctgtttgaatatgtggtggagtag

SEQ ID NO: 166002 - DNA, 2061 bp, Artificial Sequence
  Description of Artificial Sequence: Synthetic coding sequence
atgggcaccctgcgggacctgcagtatgccctgcaggagaagattgaggagctgcggcagagagatgccctgattgatgagctggagctggagctggaccagaaggatgagctgatccagaagctgcagaatgagctggacaagtacagaagtgtcatccggcctgccacccagcaggcccagaagcagagcgccagcaccctgcagggcgagcccaggaccaagaggcaggccatctctgctgagcccacagcctttgacatccaggacctgagccacgtgaccctgcccttctaccccaagagcccccagagcaaggacctgatcaaggaggccatcctggacaatgacttcatgaagaacctggagctgagccagatccaggagatcgtggactgcatgtaccctgtggagtatggcaaggacagctgcatcatcaaggagggagatgtgggcagcctggtgtatgtgatggaggatggcaaggtggaggtgaccaaggagggcgtgaagctgtgcaccatgggccctgggaaggtgtttggagagctggccatcctgtacaactgcaccaggacagccaccgtgaagaccctggtgaatgtgaagctgtgggccatcgaccggcagtgcttccagaccatcatgatgaggacaggcctcatcaagcacacagagtacatggagttcctgaagtctgtgcccaccttccagagcctgcctgaggagatcctgagcaagctggctgatgtgctggaggagacccactatgaaaatggagagtacatcatccggcagggcgcccggggggacaccttcttcatcatcagcaagggcaccgtgaatgtgacccgggaggacagccccagtgaagatcctgtgttcctgcggaccctgggcaaaggagactggtttggagagaaggccctgcagggagaagatgtgaggacagccaacgtgattgctgctgaggccgtgacctgcctggtgattgaccgggacagcttcaagcacctgattggaggcctggatgatgtgagcaacaaggcctatgaagatgctgaggccaaggccaagtatgaggccgaggccgccttctttgccaacctgaagctgagtgacttcaacatcatcgacaccctgggcgtgggcggcttcggccgggtggagctggtgcagctgaagtctgaggagagcaagacctttgccatgaagatcctgaagaagaggcacatcgtggacacccggcagcaggagcacatccgctctgagaagcagatcatgcagggcgcccacagcgacttcatcgtgcggctgtaccgcaccttcaaggacagcaagtacctgtacatgctgatggaggcctgcctgggcggggagctgtggaccatcctgcgggaccggggcagctttgaggacagcaccacccgcttctacacagcctgtgtggtggaggcctttgcctacctgcacagcaagggcatcatctacagagacctgaagccagaaaatctcatcctggaccaccggggctacgccaagctggtggactttggatttgccaagaagattggatttgggaagaagacctggaccttctgtggcaccccagaatatgtggcccctgagatcatcctgaacaagggccatgacatctctgctgactactggagcctgggcatcctgatgtatgagctgctgaccggcagcccccccttcagcggccctgaccccatgaagacctacaacatcatcctgcggggcatcgacatgattgagttccccaagaagatcgccaagaatgctgccaacctgatcaagaagctgtgccgggacaaccccagcgagcggctgggcaacctgaagaatggagtgaaggacatccagaagcacaagtggtttgagggcttcaactgggagggcctgaggaagggcaccctgaccccacccatcatccccagcgtggccagccccacagacaccagcaactttgacagcttcccagaagataatgatgagcccccaccagatgacaacagcggctgggacatcgacttctag

SEQ ID NO: 166003 - DNA, 1980 bp, Artificial Sequence
  Description of Artificial Sequence: Synthetic coding sequence
atgctgaaggaggagcgcatcaaggagctggagaagaggctgtctgagaaggaggaggagatccaggagctgaagaggaagctgcacaagtgccagagcgtgctgcctgtgcccagcacccacatcggccccaggaccacccgggcccagggcatctctgctgagccccagacctaccgctccttccatgacctgcggcaggccttcaggaagttcaccaagtctgagaggagcaaggacctgatcaaggaggccatcctggacaatgacttcatgaagaacctggagctgagccagatccaggagatcgtggactgcatgtaccctgtggagtatggcaaggacagctgcatcatcaaggagggagatgtgggcagcctggtgtatgtgatggaggatggcaaggtggaggtgaccaaggagggcgtgaagctgtgcaccatgggccctgggaaggtgtttggagagctggccatcctgtacaactgcaccaggacagccaccgtgaagaccctggtgaatgtgaagctgtgggccatcgaccggcagtgcttccagaccatcatgatgaggacaggcctcatcaagcacacagagtacatggagttcctgaagtctgtgcccaccttccagagcctgcctgaggagatcctgagcaagctggctgatgtgctggaggagacccactatgaaaatggagagtacatcatccggcagggcgcccggggggacaccttcttcatcatcagcaaaggaacagtgaatgtgacccgggaggacagccccagcgaggaccccgtcttcctgcggaccctgggcaagggggactggtttggagagaaggccctgcagggagaagatgtgaggacagccaacgtgattgctgctgaggccgtgacctgcctggtgattgaccgggacagcttcaagcacctgattggaggcctggatgatgtgagcaacaaggcctatgaagatgctgaggccaaggccaagtatgaagctgaggccgccttctttgccaacctgaagctgagtgacttcaacatcatcgacaccctgggcgtgggcggcttcggccgggtggagctggtgcagctgaagtctgaggagagcaagacctttgccatgaagatcctgaagaagaggcacatcgtggacacccggcagcaggagcacatccgctctgagaagcagatcatgcagggcgcccacagcgacttcatcgtgcggctgtaccgcaccttcaaggacagcaagtacctgtacatgctgatggaggcctgcctgggcggggagctgtggaccatcctgcgggaccggggcagctttgaggacagcaccacccgcttctacacagcctgtgtggtggaggcctttgcctacctgcacagcaagggcatcatctacagagacctgaagccagagaacctgatcctggaccaccggggctacgccaagctggtggactttggatttgccaagaagattggatttgggaagaagacctggaccttctgtggcaccccagaatatgtggcccctgagatcatcctgaacaagggccatgacatctctgctgactactggagcctgggcatcctgatgtatgagctgctgaccggcagcccccccttcagcggccctgaccccatgaagacctacaacatcatcctgcggggcatcgacatgattgagttccccaagaagatcgccaagaatgctgccaacctgatcaagaagctgtgccgggacaaccccagcgagcggctgggcaacctgaagaatggagtgaaggacatccagaagcacaagtggtttgagggcttcaactgggagggcctgaggaagggcaccctgaccccacccatcatccccagcgtggccagccccacagacaccagcaactttgacagcttccctgaggacaatgatgagcccccaccagatgacaacagcggctgggacatcgacttctag

SEQ ID NO: 166004 - DNA, 2016 bp, Artificial Sequence
  Description of Artificial Sequence: Synthetic coding sequence
atgtctgagctggaggaggactttgccaagatcctgatgctgaaggaggagcgcatcaaggagctggagaagaggctgtctgagaaggaggaggagatccaggagctgaagaggaagctgcacaagtgccagagcgtgctgcctgtgcccagcacccacatcggccccaggaccacccgggcccagggcatctctgctgagccccagacctaccgctccttccatgacctgcggcaggccttcaggaagttcaccaagtctgagaggagcaaggacctgatcaaggaggccatcctggacaatgacttcatgaagaacctggagctgagccagatccaggagatcgtggactgcatgtaccctgtggagtatggcaaggacagctgcatcatcaaggagggagatgtgggcagcctggtgtatgtgatggaggatggcaaggtggaggtgaccaaggagggcgtgaagctgtgcaccatgggccctgggaaggtgtttggagagctggccatcctgtacaactgcaccaggacagccaccgtgaagaccctggtgaatgtgaagctgtgggccatcgaccggcagtgcttccagaccatcatgatgaggacaggcctcatcaagcacacagagtacatggagttcctgaagtctgtgcccaccttccagagcctgcctgaggagatcctgagcaagctggctgatgtgctggaggagacccactatgaaaatggagagtacatcatccggcagggcgcccggggggacaccttcttcatcatcagcaaaggaacagtgaatgtgacccgggaggacagccccagcgaggaccccgtcttcctgcggaccctgggcaagggggactggtttggagagaaggccctgcagggagaagatgtgaggacagccaacgtgattgctgctgaggccgtgacctgcctggtgattgaccgggacagcttcaagcacctgattggaggcctggatgatgtgagcaacaaggcctatgaagatgctgaggccaaggccaagtatgaagctgaggccgccttctttgccaacctgaagctgagtgacttcaacatcatcgacaccctgggcgtgggcggcttcggccgggtggagctggtgcagctgaagtctgaggagagcaagacctttgccatgaagatcctgaagaagaggcacatcgtggacacccggcagcaggagcacatccgctctgagaagcagatcatgcagggcgcccacagcgacttcatcgtgcggctgtaccgcaccttcaaggacagcaagtacctgtacatgctgatggaggcctgcctgggcggggagctgtggaccatcctgcgggaccggggcagctttgaggacagcaccacccgcttctacacagcctgtgtggtggaggcctttgcctacctgcacagcaagggcatcatctacagagacctgaagccagagaacctgatcctggaccaccggggctacgccaagctggtggactttggatttgccaagaagattggatttgggaagaagacctggaccttctgtggcaccccagaatatgtggcccctgagatcatcctgaacaagggccatgacatctctgctgactactggagcctgggcatcctgatgtatgagctgctgaccggcagcccccccttcagcggccctgaccccatgaagacctacaacatcatcctgcggggcatcgacatgattgagttccccaagaagatcgccaagaatgctgccaacctgatcaagaagctgtgccgggacaaccccagcgagcggctgggcaacctgaagaatggagtgaaggacatccagaagcacaagtggtttgagggcttcaactgggagggcctgaggaagggcaccctgaccccacccatcatccccagcgtggccagccccacagacaccagcaactttgacagcttccctgaggacaatgatgagcccccaccagatgacaacagcggctgggacatcgacttctag

SEQ ID NO: 166005 - DNA, 2289 bp, Artificial Sequence
  Description of Artificial Sequence: Synthetic coding sequence
atgggaaatggatctgtgaagcccaagcacagcaagcacccagatggccacagcggcaacctgaccacagatgccctgaggaacaaggtgacagagctggagcgggagctgcggaggaaggatgctgagatccaggagcgggagtaccacctgaaggagctgcgggagcagctgagcaagcagacagtggccatcgccgagctgacagaggagctgcagaacaagtgcatccagctgaacaagctgcaggatgtggtgcacatgcagggcggcagccccctgcaggccagcccagacaaggtgcccctggaggtgcacaggaagaccagcggcctggtgtccctgcacagccggcggggggccaaggccggcgtgtctgctgagcccaccaccaggacctatgacctgaacaagcccccagagttctcctttgagaaggcccgggtgaggaaggacagcagcgagaagaagctgatcacagatgccctgaacaagaaccagttcctgaagaggctggacccccagcagatcaaggacatggtggagtgcatgtatggaagaaactaccagcagggcagctacatcatcaagcagggcgagcccggcaaccacatctttgtgctggccgagggccgcctggaggtgttccagggcgagaagctgctgagcagcatccccatgtggaccacctttggagagctggccatcctgtacaactgcaccaggacagcctctgtgaaggccatcaccaacgtgaagacctgggccctggaccgggaggtgttccagaacatcatgagaagaacagcccaggccagagatgagcagtacagaaacttcctgcggtctgtgtccctgctgaagaacctgcctgaggacaagctgaccaagatcatcgactgcctggaggtggagtactatgacaagggggactacatcatccgggagggggaggagggcagcaccttcttcatcctggccaagggcaaggtgaaggtgacccagagcacagagggccatgaccagccccagctgatcaagaccctgcagaagggggagtactttggagagaaggccctgatcagtgatgatgtgcgcagcgccaacatcatcgccgaggagaatgatgtggcctgcctggtgattgaccgggagaccttcaaccagacagtgggcacctttgaggagctgcagaagtacctggagggctacgtggccaacctgaacagagatgatgagaagagacatgccaagaggtccatgagcaactggaagctgagcaaggccctgagcctggagatgatccagctgaaggagaaggtggcccgcttcagcagcagcagccccttccagaacctggagatcatcgccaccctgggcgtgggcggcttcggccgggtggagctggtgaaggtgaagaatgaaaatgtggcctttgccatgaagtgcatcaggaagaagcacatcgtggacaccaagcagcaggagcacgtgtacagcgagaagaggatcctggaggagctgtgcagccccttcatcgtgaagctgtaccgcaccttcaaggacaacaagtatgtgtacatgctgctggaggcctgcctgggcggggagctgtggagcatcctgcgggaccggggcagctttgatgagcccaccagcaagttctgtgtggcctgtgtgacagaggcctttgactacctgcaccggctgggcatcatctacagagacctgaagccagagaacctgatcctggatgctgagggctacctgaagctggtggactttggatttgccaagaagattggcagcggccagaagacctggaccttctgtggcaccccagaatatgtggcccctgaggtgatcctgaacaagggccatgacttctctgtggacttctggagcctgggcatcctggtgtatgagctgctgactggaaacccccccttctctggagtggaccagatgatgacctacaacctgatcctgaagggcatcgagaagatggacttccccaggaagatcaccaggaggcctgaggacctgatccggcggctgtgccggcagaaccccacagagcggctgggcaacctgaagaatggcatcaatgacatcaagaagcaccgctggctgaatggcttcaactgggagggcctgaaggcccggagcctgcccagccccctgcagcgggagctgaagggccccatcgaccacagctactttgacaagtacccacctgagaagggcatgcccccagatgagctgagcggctgggacaaggacttctag

SEQ ID NO: 166006 - DNA, 2289 bp, Artificial Sequence; identical to SEQ ID NO: 166005
  Description of Artificial Sequence: Synthetic coding sequence

SEQ ID NO: 166007 - DNA, 2202 bp, Artificial Sequence
  Description of Artificial Sequence: Synthetic coding sequence
atgggaaatggatctgtgaagcccaagcacagcaagcacccagatggccacagcggcaacctgaccacagatgccctgaggaacaaggtgacagagctggagcgggagctgcggaggaaggatgctgagatccaggagcgggagtaccacctgaaggagctgcgggagcagctgagcaagcagacagtggccatcgccgagctgacagaggagctgcagaacaagtgcatccagctgaacaagctgcaggatgtggtgcacatgcagggcggcagccccctgcaggccagcccagacaaggtgcccctggaggtgcacaggaagaccagcggcctggtgtccctgcacagccggcggggggccaaggccggcgtgtctgctgagcccaccaccaggacctatgacctgaacaagcccccagagttctcctttgagaaggcccgggtgaggaaggacagcagcgagaagaagctgatcacagatgccctgaacaagaaccagttcctgaagaggctggacccccagcagatcaaggacatggtggagtgcatgtatggaagaaactaccagcagggcagctacatcatcaagcagggcgagcccggcaaccacatctttgtgctggccgagggccgcctggaggtgttccagggcgagaagctgctgagcagcatccccatgtggaccacctttggagagctggccatcctgtacaactgcaccaggacagcctctgtgaaggccatcaccaacgtgaagacctgggccctggaccgggaggtgttccagaacatcatgagaagaacagcccaggccagagatgagcagtacagaaacttcctgcggtctgtgtccctgctgaagaacctgcctgaggacaagctgaccaagatcatcgactgcctggaggtggagtactatgacaagggggactacatcatccgggagggggaggagggcagcaccttcttcatcctggccaagggcaaggtgaaggtgacccagagcacagagggccatgaccagccccagctgatcaagaccctgcagaagggggagtactttggagagaaggccctgatcagtgatgatgtgcgcagcgccaacatcatcgccgaggagaatgatgtggcctgcctggtgattgaccgggagaccttcaaccagacagtgggcacctttgaggagctgcagaagtacctggagggctacgtggccaacctgaacagagatgatgagaagagacatgccaagaggtccatgagcaactggaagctgagcaaggccctgagcctggagatgatccagctgaaggagaaggtgaaggtgaagaatgaaaatgtggcctttgccatgaagtgcatcaggaagaagcacatcgtggacaccaagcagcaggagcacgtgtacagcgagaagaggatcctggaggagctgtgcagccccttcatcgtgaagctgtaccgcaccttcaaggacaacaagtatgtgtacatgctgctggaggcctgcctgggcggggagctgtggagcatcctgcgggaccggggcagctttgatgagcccaccagcaagttctgtgtggcctgtgtgacagaggcctttgactacctgcaccggctgggcatcatctacagagacctgaagccagaaaatctcatcctggatgctgagggctacctgaagctggtggactttggatttgccaagaagattggcagcggccagaagacctggaccttctgtggcaccccagaatatgtggcccctgaggtgatcctgaacaagggccatgacttctctgtggacttctggagcctgggcatcctggtgtatgagctgctgaccggcaacccccccttcagcggcgtggaccagatgatgacctacaacctgatcctgaagggcatcgagaagatggacttccccaggaagatcacccggcggccagaagatctcatccggcggctgtgccggcagaaccccacagagcggctgggcaacctgaagaatggcatcaatgacatcaagaagcaccgctggctgaatggcttcaactgggagggcctgaaggcccggagcctgcccagccccctgcagcgggagctgaagggccccatcgaccacagctactttgacaagtacccacctgagaagggcatgcccccagatgagctgagcggctgggacaaggacttctag

SEQ ID NO: 166008 - DNA, 1029 bp, Artificial Sequence
  Description of Artificial Sequence: Synthetic coding sequence
atgagcaactggaagctgagcaaggccctgagcctggagatgatccagctgaaggagaaggtggcccgcttcagcagcagcagccccttccagaacctggagatcatcgccaccctgggcgtgggcggcttcggccgggtggagctggtgaaggtgaagaatgaaaatgtggcctttgccatgaagtgcatcaggaagaagcacatcgtggacaccaagcagcaggagcacgtgtacagcgagaagaggatcctggaggagctgtgcagccccttcatcgtgaagctgtaccgcaccttcaaggacaacaagtatgtgtacatgctgctggaggcctgcctgggcggggagctgtggagcatcctgcgggaccggggcagctttgatgagcccaccagcaagttctgtgtggcctgtgtgacagaggcctttgactacctgcaccggctgggcatcatctacagagacctgaagccagagaacctgatcctggatgctgagggctacctgaagctggtggactttggatttgccaagaagattggcagcggccagaagacctggaccttctgtggcaccccagaatatgtggcccctgaggtgatcctgaacaagggccatgacttctctgtggacttctggagcctgggcatcctggtgtatgagctgctgactggaaacccccccttctctggagtggaccagatgatgacctacaacctgatcctgaagggcatcgagaagatggacttccccaggaagatcaccaggaggcctgaggacctgatccggcggctgtgccggcagaaccccacagagcggctgggcaacctgaagaatggcatcaatgacatcaagaagcaccgctggctgaatggcttcaactgggagggcctgaaggcccggagcctgcccagccccctgcagcgggagctgaagggccccatcgaccacagctactttgacaagtacccacctgagaagggcatgcccccagatgagctgagcggctgggacaaggacttctag

SEQ ID NO: 166009 - DNA, 942 bp, Artificial Sequence
  Description of Artificial Sequence: Synthetic coding sequence
atgagccagagccgccacagagctgaggccccacccctggagcgggaggacagcggcaccttcagcctgggcaagatgatcacagccaagccaggcaagacccccatccaggtgctgcacgagtatggcatgaagaccaagaacatccctgtgtatgaatgtgagaggagtgatgtgcagatccacgtgcccaccttcaccttccgggtgacagtgggggacatcacctgcaccggggagggcaccagcaagaagctggccaagcacagagctgctgaggccgccatcaacatcctgaaggccaatgccagcatctgctttgctgtgcctgaccccctgatgccagaccccagcaagcagcccaagaaccagctgaaccccatcggcagcctgcaggagctggccatccaccacggctggaggctgcctgagtacaccctgagccaggagggcggccctgcccacaagcgggagtacaccaccatctgccgcctggagagcttcatggagactggaaaaggagccagcaagaagcaggccaagagaaatgctgctgagaagttcctggccaagttcagcaacatcagccctgagaaccacatcagcctgaccaacgtggtgggccacagcctgggctgcacctggcacagcctgaggaacagccctggagagaagatcaacctgctgaagaggagcctgctgagcatccccaacacagactacatccagctgctgtctgagatcgccaaggagcagggcttcaacatcacctacctggacattgatgagctgagcgccaacggccagtaccagtgcctggccgagctgagcaccagccccatcaccgtgtgccacggcagcggcatcagctgtggaaatgcccagagtgatgctgcccacaatgccctgcagtacctgaagatcatcgccgagaggaagtag

SEQ ID NO: 166010 - DNA, 909 bp, Artificial Sequence
  Description of Artificial Sequence: Synthetic coding sequence
atgcagagcacccccttctgtggcttctgcagcctgggcaagatgatcacagccaagccaggcaagacccccatccaggtgctgcatgaatatggcatgaagaccaagaacatccctgtgtatgaatgtgagaggagtgatgtgcagatccacgtgcccaccttcaccttccgggtgacagtgggggacatcacctgcacaggagagggcaccagcaagaagctggccaagcacagagctgctgaggccgccatcaacatcctgaaggccaatgccagcatctgctttgctgtgcctgaccccctgatgccagaccccagcaagcagcccaagaaccagctgaaccccatcggcagcctgcaggagctggccatccaccacggctggaggctgcctgagtacaccctgagccaggagggcggccctgcccacaagcgggagtacaccaccatctgccgcctggagagcttcatggagaccgggaagggggccagcaagaagcaggccaagagaaatgctgctgagaagttcctggccaagttcagcaacatcagccctgagaaccacatcagcctgaccaacgtggtgggccacagcctgggctgcacctggcacagcctgaggaacagccctggagagaagatcaacctgctgaagaggagcctgctgagcatccccaacacagactacatccagctgctgtctgaaattgccaaggagcagggcttcaacatcacctacctggacattgatgagctgagcgccaacggccagtaccagtgcctggccgagctgagcaccagccccatcaccgtgtgccacggcagcggcatcagctgtggaaatgcccagagtgatgctgcccacaatgccctgcagtacctgaagatcatcgccgagaggaagtag

SEQ ID NO: 166011 - DNA, 603 bp, Artificial Sequence
  Description of Artificial Sequence: Synthetic coding sequence
atgccagaccccagcaagcagcccaagaaccagctgaaccccatcggcagcctgcaggagctggccatccaccacggctggaggctgcctgagtacaccctgagccaggagggcggccctgcccacaagcgggagtacaccaccatctgccgcctggagagcttcatggagaccgggaagggggccagcaagaagcaggccaagagaaatgctgctgagaagttcctggccaagttcagcaacatcagccctgagaaccacatcagcctgaccaacgtggtgggccacagcctgggctgcacctggcacagcctgaggaacagccctggagagaagatcaacctgctgaagaggagcctgctgagcatccccaacacagactacatccagctgctgtctgaaattgccaaggagcagggcttcaacatcacctacctggacattgatgagctgagcgccaacggccagtaccagtgcctggccgagctgagcaccagccccatcaccgtgtgccacggcagcggcatcagctgtggaaatgcccagagtgatgctgcccacaatgccctgcagtacctgaagatcatcgccgagaggaagtag

SEQ ID NO: 166012 - DNA, 867 bp, Artificial Sequence
  Description of Artificial Sequence: Synthetic coding sequence
atgatcacagccaagccaggcaagacccccatccaggtgctgcatgaatatggcatgaagaccaagaacatccctgtgtatgaatgtgagaggagtgatgtgcagatccacgtgcccaccttcaccttccgggtgacagtgggggacatcacctgcacaggagagggcaccagcaagaagctggccaagcacagagctgctgaggccgccatcaacatcctgaaggccaatgccagcatctgctttgctgtgcctgaccccctgatgccagaccccagcaagcagcccaagaaccagctgaaccccatcggcagcctgcaggagctggccatccaccacggctggaggctgcctgagtacaccctgagccaggagggcggccctgcccacaagcgggagtacaccaccatctgccgcctggagagcttcatggagaccgggaagggggccagcaagaagcaggccaagagaaatgctgctgagaagttcctggccaagttcagcaacatcagccctgagaaccacatcagcctgaccaacgtggtgggccacagcctgggctgcacctggcacagcctgaggaacagccctggagagaagatcaacctgctgaagaggagcctgctgagcatccccaacacagactacatccagctgctgtctgaaattgccaaggagcagggcttcaacatcacctacctggacattgatgagctgagcgccaacggccagtaccagtgcctggccgagctgagcaccagccccatcaccgtgtgccacggcagcggcatcagctgtggaaatgcccagagtgatgctgcccacaatgccctgcagtacctgaagatcatcgccgagaggaagtag

SEQ ID NO: 166013 - DNA, 1077 bp, Artificial Sequence
  Description of Artificial Sequence: Synthetic coding sequence
atggaggcccctggcctggcccaggccgctgctgctgagagtgacagcaggaaggtggccgaggagaccccagatggagccccagccctgtgccccagccctgaggccctgagccctgagccccctgtgtacagcctgcaggactttgacaccctggccaccgtgggcaccggcaccttcggccgggtgcacctggtgaaggagaagacagccaagcacttctttgccctgaaggtgatgagcatcccagatgtgatccggctgaagcaggagcagcacgtgcacaatgagaagtctgtgctgaaggaggtgagccaccccttcctgatccgcctcttctggacctggcatgatgagcgcttcctgtacatgctgatggagtatgtgcctggaggagagctgttctcctacctgaggaacagaggccgcttcagcagcaccaccggcctcttctacagcgctgagatcatctgtgccatcgagtacctgcacagcaaggagatcgtgtacagagacctgaagccagagaacatcctgctggacagagatggccacatcaagctgacagactttggatttgccaagaagctggtggacaggacctggaccctgtgtggcaccccagagtacctggcccctgaggtgatccagagcaaaggacatggccgggctgtggactggtgggccctgggcatcctgatctttgagatgctgagcggcttcccccccttctttgatgacaaccccttcggcatctaccagaagatcctggccggcaagattgacttccccaggcacctggacttccacgtgaaggacctgatcaagaagctgctggtggtggacaggacccggcggctgggcaacatgaagaatggagccaatgatgtgaagcaccaccgctggttccgctctgtggactgggaggccgtgccccagaggaagctgaagccacccatcgtgcccaagattgctggagatggagacaccagcaactttgagacctacccagaaaatgactgggacacagctgcccctgtgccccagaaggacctggagatcttcaagaacttctag

SEQ ID NO: 166014 - DNA, 1983 bp, Artificial Sequence
  Description of Artificial Sequence: Synthetic coding sequence
atggatgactggaagcccagccccctcatcaagccctttggagccaggaagaagaggtcctggtacctgacctggaagtacaagctgaccaaccagagggccctgcggcgcttctgccagacaggagctgtgctcttcctgctggtgaccgtcatcgtgaacatcaagctgatcctggacacccggcgggccatcagcgaggccaatgaagatcctgagcctgagcaggactatgatgaggccctgggccgcctggagcccccaagaagaagaggcagcggcccccggcgggtgctggatgtggaggtgtacagcagccgcagcaaggtgtatgtggccgtggatggcaccaccgtgctggaggatgaggcccgggagcagggccggggcatccacgtgattgtgctgaaccaggccaccggccacgtgatggccaagagggtgtttgacacctacagcccccatgaagatgaggccatggtgctcttcctgaacatggtggcccctggccgggtgctgatctgcaccgtgaaggatgagggcagcttccacctgaaggacacagccaaggccctgctgcggagcctgggcagccaggccggccctgccctgggctggagggacacctgggcctttgtgggcaggaagggcggccctgtgtttggagagaagcacagcaagagccctgccctgagctcctggggagaccctgtgctgctgaagacagatgtgcccctgagcagcgctgaggaggccgagtgccactgggccgacacagagctgaacagaagaagaagacgcttctgcagcaaggtggagggctacggctctgtgtgcagctgcaaggaccccacccccatcgagttctccccagaccccctgcctgacaacaaggtgctgaatgtgcctgtggccgtgattgctggcaaccggcccaactacctgtacaggatgctgcggagcctgctgagcgcccagggcgtgagcccccagatgatcaccgtcttcattgatggctactatgaggagcccatggatgtggtggccctgtttggcctgcggggcatccagcacacccccatcagcatcaagaatgcccgggtgtcccagcactacaaggccagcctgacagccaccttcaacctcttccctgaggccaagtttgctgtggtgctggaggaggacctggacattgctgtggacttcttctccttcctgagccagagcatccacctgctggaggaggatgacagcctgtactgcatcagcgcctggaatgaccagggctatgagcacacagcagaagatcctgccctgctgtacagagtggagaccatgcctggcctgggctgggtgctgcggcgcagcctgtacaaggaggagctggagcccaagtggcccaccccagagaagctgtgggactgggacatgtggatgaggatgcctgagcagaggcggggccgggagtgcatcatcccagatgtgagccgcagctaccactttggaattgtgggcctgaacatgaatggctacttccacgaggcctacttcaagaagcacaagttcaacacagtgcctggggtgcagctgagaaatgtggacagcctgaagaaggaggcctatgaggtggaggtgcaccggctgctgtctgaggccgaggtgctggaccacagcaagaacccctgtgaagattccttcctgcctgacacagagggccacacctacgtggccttcatccgcatggagaaggatgatgacttcaccacctggacccagctggccaagtgcctgcacatctgggacctggatgtgcggggcaaccaccggggcctgtggaggctcttcaggaagaagaaccacttcctgatggtgggcgtgcctgccagcccctacagcgtgaagaagccacccagcgtgacccccatcttcctggagcccccacccaaggaggagggcgcccctggggcccctgagcagacctag

SEQ ID NO: 166015 - DNA, 2247 bp, Artificial Sequence
  Description of Artificial Sequence: Synthetic coding sequence
atggatgactggaagcccagccccctcatcaagccctttggagccaggaagaagaggtcctggtacctgacctggaagtacaagctgaccaaccagagggccctgcggcgcttctgccagacaggagctgtgctcttcctgctggtgaccgtcatcgtgaacatcaagctgatcctggacacccggcgggccatcagcgaggccaatgaagatcctgagcctgagcaggactatgatgaggccctgggccgcctggagcccccaagaagaagaggcagcggcccccggcgggtgctggatgtggaggtgtacagcagccgcagcaaggtgtatgtggccgtggatggcaccaccgtgctggaggatgaggcccgggagcagggccggggcatccacgtgattgtgctgaaccaggccaccggccacgtgatggccaagagggtgtttgacacctacagcccccatgaagatgaggccatggtgctcttcctgaacatggtggcccctggccgggtgctgatctgcaccgtgaaggatgagggcagcttccacctgaaggacacagccaaggccctgctgcggagcctgggcagccaggccggccctgccctgggctggagggacacctgggcctttgtgggcaggaagggcggccctgtgtttggagagaagcacagcaagagccctgccctgagctcctggggagaccctgtgctgctgaagacagatgtgcccctgagcagcgctgaggaggccgagtgccactgggccgacacagagctgaacagaagaagaagacgcttctgcagcaaggtggagggctacggctctgtgtgcagctgcaaggaccccacccccatcgagttctccccagaccccctgcctgacaacaaggtgctgaatgtgcctgtggccgtgattgctggcaaccggcccaactacctgtacaggatgctgcggagcctgctgagcgcccagggcgtgagcccccagatgatcaccgtcttcattgatggctactatgaggagcccatggatgtggtggccctgtttggcctgcggggcatccagcacacccccatcagcatcaagaatgcccgggtgtcccagcactacaaggccagcctgacagccaccttcaacctcttccctgaggccaagtttgctgtggtgctggaggaggacctggacattgctgtggacttcttctccttcctgagccagagcatccacctgctggaggaggatgacagcctgtactgcatcagcgcctggaatgaccagggctatgagcacacagcagaagatcctgccctgctgtacagagtggagaccatgcctggcctgggctgggtgctgcggcgcagcctgtacaaggaggagctggagcccaagtggcccaccccagagaagctgtgggactgggacatgtggatgaggatgcctgagcagaggcggggccgggagtgcatcatcccagatgtgagccgcagctaccactttggaattgtgggcctgaacatgaatggctacttccacgaggcctacttcaagaagcacaagttcaacacagtgcctggggtgcagctgagaaatgtggacagcctgaagaaggaggcctatgaggtggaggtgcaccggctgctgtctgaggccgaggtgctggaccacagcaagaacccctgtgaagattccttcctgcctgacacagagggccacacctacgtggccttcatccgcatggagaaggatgatgacttcaccacctggacccagctggccaagtgcctgcacatctgggacctggatgtgcggggcaaccaccggggcctgtggaggctcttcaggaagaagaaccacttcctgatgtctgaggaggccaccctgagccaccccaacttccctggggccacccccaagggcggcggcagccccaggagccccaggacagacatgaggcctcctcctggcccctgtggggccggccctggcagcgagagcaacctcttcatcgactgcccagagggcctggagaaccggcccaacctggagggcctggacttcttcctgggctggaatgctgccctgcgggtgggcctggccctgacccaggagacagctgtgcccaacccctggacaggccctgctggggcccacatgctgacccagacccacagcgagaccctgcggcactggaccaggcctcccctgagcctgctgtttgtgcagatcagcaaggccggctag

SEQ ID NO: 166016 - DNA, 2247 bp, Artificial Sequence; identical to SEQ ID NO: 166015
  Description of Artificial Sequence: Synthetic coding sequence

SEQ ID NO: 166017 - DNA, 603 bp, Artificial Sequence
  Description of Artificial Sequence: Synthetic coding sequence
atggatgactggaagcccagccccctcatcaagccctttggagccaggaagaagaggtcctggtacctgacctggaagtacaagctgaccaaccagagggccctgcggcgcttctgccagacaggagctgtgctcttcctgctggtgaccgtcatcgtgaacatcaagctgatcctggacacccggcgggccatcagcgaggccaatgaagatcctgagcctgagcaggactatgatgaggccctgggccgcctggagcccccaagaagaagaggcagcggcccccggcgggtgctggatgtggaggtgtacagcagccgcagcaaggtgtatgtggccgtggatggcaccaccgtgctggaggatgaggcccgggagcagggccggggcatccacgtgattgtgctgaaccaggccaccggccacgtgatggccaagagggtgtttgacacctacagcccccatgaagatgaggccatggtgctcttcctgaacatggtggcccctggccgggtgctgatctgcaccgtgaaggtgctgagcagcggcaggaacatcctgaaccacctgcccagcctgcccggcggcacccagagctgctag

SEQ ID NO: 166018 - DNA, 1917 bp, Artificial Sequence
  Description of Artificial Sequence: Synthetic coding sequence
atggagggcaccaaggagatcaaggtgagcaacagacgcatccaggagcactggacaggagctgtgctcttcctgctggtgaccgtcatcgtgaacatcaagctgatcctggacacccggcgggccatcagcgaggccaatgaagatcctgagcctgagcaggactatgatgaggccctgggccgcctggagcccccaagaagaagaggcagcggcccccggcgggtgctggatgtggaggtgtacagcagccgcagcaaggtgtatgtggccgtggatggcaccaccgtgctggaggatgaggcccgggagcagggccggggcatccacgtgattgtgctgaaccaggccaccggccacgtgatggccaagagggtgtttgacacctacagcccccatgaagatgaggccatggtgctcttcctgaacatggtggcccctggccgggtgctgatctgcaccgtgaaggatgagggcagcttccacctgaaggacacagccaaggccctgctgcggagcctgggcagccaggccggccctgccctgggctggagggacacctgggcctttgtgggcaggaagggcggccctgtgtttggagagaagcacagcaagagccctgccctgagctcctggggagaccctgtgctgctgaagacagatgtgcccctgagcagcgctgaggaggccgagtgccactgggccgacacagagctgaacagaagaagaagacgcttctgcagcaaggtggagggctacggctctgtgtgcagctgcaaggaccccacccccatcgagttctccccagaccccctgcctgacaacaaggtgctgaatgtgcctgtggccgtgattgctggcaaccggcccaactacctgtacaggatgctgcggagcctgctgagcgcccagggcgtgagcccccagatgatcaccgtcttcattgatggctactatgaggagcccatggatgtggtggccctgtttggcctgcggggcatccagcacacccccatcagcatcaagaatgcccgggtgtcccagcactacaaggccagcctgacagccaccttcaacctcttccctgaggccaagtttgctgtggtgctggaggaggacctggacattgctgtggacttcttctccttcctgagccagagcatccacctgctggaggaggatgacagcctgtactgcatcagcgcctggaatgaccagggctatgagcacacagcagaagatcctgccctgctgtacagagtggagaccatgcctggcctgggctgggtgctgcggcgcagcctgtacaaggaggagctggagcccaagtggcccaccccagagaagctgtgggactgggacatgtggatgaggatgcctgagcagaggcggggccgggagtgcatcatcccagatgtgagccgcagctaccactttggaattgtgggcctgaacatgaatggctacttccacgaggcctacttcaagaagcacaagttcaacacagtgcctggggtgcagctgagaaatgtggacagcctgaagaaggaggcctatgaggtggaggtgcaccggctgctgtctgaggccgaggtgctggaccacagcaagaacccctgtgaagattccttcctgcctgacacagagggccacacctacgtggccttcatccgcatggagaaggatgatgacttcaccacctggacccagctggccaagtgcctgcacatctgggacctggatgtgcggggcaaccaccggggcctgtggaggctcttcaggaagaagaaccacttcctgatggtgggcgtgcctgccagcccctacagcgtgaagaagccacccagcgtgacccccatcttcctggagcccccacccaaggaggagggcgcccctggggcccctgagcagacctag

SEQ ID NO: 166019 - DNA, 861 bp, Artificial Sequence
  Description of Artificial Sequence: Synthetic coding sequence
atgtctgacagcgagaagctgaacctggacagcatcatcggccgcctgctggagggggacatccacggccagtactatgacctgctgcggctgtttgaatatggaggcttccccccagagagcaactacctgttcctgggggactatgtggaccggggcaagcagagcctggagaccatctgcctgctgctggcctacaagatcaagtacccagagaacttcttcctgctgcggggcaaccatgaatgtgccagcatcaaccgcatctacggcttctatgatgagtgcaagaggcgctacaacatcaagctgtggaagaccttcacagactgcttcaactgcctgcccatcgccgccatcgtggatgagaagatcttctgctgccacggcggcctgagcccagacctgcagagcatggagcagatccgccgcatcatgaggcccacagatgtgcctgaccagggcctgctgtgtgacctgctgtggagcgaccctgacaaggatgtgcagggctggggagaaaatgaccggggcgtgtccttcacctttggagctgaggtggtggccaagttcctgcacaagcatgacctggacctgatctgccgggcccaccaggtggtggaggatggctatgagttctttgccaagaggcagctggtgaccctcttcagcgcccccaactactgtggggagtttgacaatgctggggccatgatgtctgtggatgagaccctgatgtgcagcttccagatcctgaagccagctgacaagaacaagggcaagtatggccagttcagcggcctgaaccctgggggccggcccatcaccccaccaagaaattctgccaaggccaagaagtag

SEQ ID NO: 166020 - DNA, 1548 bp, Artificial Sequence
  Description of Artificial Sequence: Synthetic coding sequence
atggccgagctggagcacctgggcggcaagagagctgagagcgccaggatgagaagagctgagcagctgcggcgctggaggggcagcctgacagagcaggagcctgctgagaggagaggagctggccggcagcccctgacccggcggggcagcccccgggtgcgctttgaagatggagctgtgttcctggccgcctgcagcagcggggacacagatgaggtgaggaagctgctggcccggggagctgacatcaacacagtgaatgtggatggcctgacagccctgcaccaggcctgcattgatgagaacctggacatggtgaagttcctggtggagaacagagccaacgtgaaccagcaggacaatgaaggctggacccccctgcacgccgccgccagctgtggctacctgaacattgctgagtacttcatcaaccacggggcctctgtgggcatcgtgaacagcgagggggaggtgcccagcgacctggccgaggagcccgccatgaaggacctgctgctggagcaggtgaagaagcagggcgtggacctggagcagagcaggaaggaggaggagcagcagatgctgcaggatgcccggcagtggctgaacagcggcaagattgaagatgtgcggcaggcccggagcggggccacagccctgcacgtggccgccgccaagggctacagcgaggtgctgcggctgctgatccaggccggctatgagctgaatgtgcaggactatgatggctggacccccctgcacgccgccgcccactggggcgtgaaggaggcctgcagcatcctggccgaggccctgtgtgacatggacatccggaacaagctgggccagaccccatttgatgtggctgatgagggcctggtggagcacctggagctgctgcagaagaagcagaatgtgctgcggtctgagaaggagaccaggaacaagctgattgaaagtgacctgaacagcaagatccagagcggcttcttcaagaacaaggagaagatgctgtatgaggaggagacccccaagagccaggagatggaggaggagaacaaggagagcagcagcagcagcagcgaggaggaggagggggaggatgaggccagcgagagcgagacagagaaggaggccgacaagaagccagaggcctttgtgaaccacagcaacagcgagagcaagagcagcatcacagagcagatcccagccccagcccagaacaccttcagcgccagcagcgcccggcgcttcagcagcggcctcttcaacaagccagaggagcccaaggatgagagccccagctcctggaggctgggcctgaggaagacaggcagccacaacatgctgtctgaggtggccaacagccgggagcccatccgggaccggggcagcagcatctaccgcagcagcagcagcccccgcatcagcgccctgctggacaacaaggacaaggtgcagtttggccgggtgtggggcaacagcaaggctgtgttcttcttccacgagaacagcatcctgggcaccaatgaaaacatcttctag

SEQ ID NO: 166021 - DNA, 4125 bp, Artificial Sequence
  Description of Artificial Sequence: Synthetic coding sequence
atgctgaagacagagagcagtggagagaggaccaccctgcggagcgccagcccccacagaaatgcctacagaacagagttccaggccctgaagagcacctttgacaagcccaagagtgatggagagcagaagaccaaggagggggagggcagccagcagagccggggcaggaaatatggcagcaatgtgaaccgcatcaagaacctcttcatgcagatgggcatggagcccaatgaaaatgctgctgtgattgccaagacccggggcaagggcggccacagcagcccccagaggaggatgaagcccaaggagttcctggagaagacagatggctctgtggtgaagctggagagctctgtgtctgagcgcatcagcagatttgacaccatgtatgatggccccagctacagcaagttcacagagaccaggaagatgtttgagaggtctgtgcatgaaagtggccagaacaaccgctacagccccaagaaggagaaggccggcggcagcgagccccaggatgagtggggcggcagcaagagcaacagaggcagcacagacagcctggacagcctgagcagcaggacagaagctgtgagccccaccgtgtcccagctgtctgctgtgtttgagaacacagacagccccagcgccatcatcagcgagaaggccgagaacaatgagtacagcgtgacaggccactaccccctgaacctgcccagcgtgacagtgaccaacctggacaccttcggccacctgaaggacagcaacagctggccacccagcaacaagaggggcgtggacacagaagatgcccacaagagcaatgccacccctgtgcctgaggtggccagcaagagcaccagcctggccagcatccctggagaggagatccagcagagcaaggagcctgaggacagcaccagcaaccagcagaccccagacagcattgacaaggatggccctgaggagccctgtgccgagagcaaggccatgcccaagtctgagatccccagcccccagagccagctgctggaggatgctgaggccaacctggtgggccgggaggccgccaagcagcagaggaaggagctggccggcggggacttcaccagcccagatgccagcgccagcagctgtgggaaggaggtgcctgaggacagcaacaactttgatggcagccacgtgtacatgcacagcgactacaacgtgtacagagtgcgcagccgctacaacagcgactggggcgagactggaacagagcaggatgaggaggaggacagtgatgaaaattcctactaccagcctgacatggagtacagcgagatcgtgggcctgcctgaggaggaggagatcccagccaacaggaagatcaagttcagcagcgcccccatcaaggtgttcaacacctacagcaatgaagattatgacagaagaaatgatgaggtggaccctgtggccgccagcgcagaatatgagctggagaagagggtggagaagctggagctgtttcctgtggagctggagaaggatgaagatggcctgggcatcagcatcatcggcatgggcgtgggcgcagatgctggcctggagaagctgggcatctttgtgaagacagtgacagagggcggggccgcccagagagatggccgcatccaggtgaatgaccagatcgtggaggtggatggcatcagcctggtgggcgtgacccagaactttgctgccaccgtgctgaggaacaccaagggaaatgtgcgcttcgtcatcggccgggagaagccaggccaggtgtctgaggtggcccagctgatcagccagaccctggagcaggagcggcggcagcgggagctgctggagcagcactacgcccagtatgatgctgatgatgatgagaacacagtggccgagctgcagggcatgagcggcaactgcaacaacaacaacaactacttcctgaagacaggagaatatgccacagatgaggaggaggatgaggtgggccctgtgctgcccggcagtgacatggccatcgaggtgtttgagctgcctgaaaatgaagacatgttcagccccagcgagctggacaccagcaagctgagccacaagttcaaggagctgcagatcaagcatgctgtgacagaggccgagatccagaagctgaagaccaagctgcaggccgcagaaaatgagaaggtgcgctgggagctggagaagacccagctgcagcagaacatcgaggagaacaaggagaggatgctgaagctggagagctactggattgaggcccagaccctgtgccacacagtgaatgagcacctgaaggagacccagagccagtaccaggccctggagaagaagtacaacaaggccaagaagctgatcaaggacttccagcagaaggagctggacttcatcaagaggcaggaggccgagaggaagaagattgaggacctggagaaggcccacctggtggaggtgcagggcctgcaggtgcgcatccgggacctggaggccgaggtgttccggctgctgaagcagaatggcacccaggtgaacaacaacaacaacatctttgaaagaaggaccagcctgggggaggtgtccaagggggacaccatggagaacctggatggcaagcagaccagctgccaggacggcctgagccaggacctgaatgaagctgtgcctgagacagagcggctggacagcaaggccctgaagacccgggcccagctgtctgtgaagaacagacggcagaggcccagcaggacccggctgtatgacagcgtgagcagcacagatggagaggacagcctggagaggaagcccagcaacagcttctacaaccacatgcacatcaccaagctgctgccccccaagggcctgcggaccagcagccctgagagtgacagcggcgtgccccccctgacccctgtggacagcaatgtgcccttcagcagtgaccacatcgccgagttccaggaggagcccctggaccctgagatgggccccctgagctccatgtggggagacaccagcctcttcagcaccagcaagagtgaccatgatgtggaggagagcccctgccaccaccagaccaccaacaagaagatcctgcgggagaaggatgatgccaaggaccccaagagcctgcgggccagcagcagcctggccgtgcagggcggcaagatcaagaggaagtttgtggacctgggcgcccccctgcggaggaacagcagcaagggcaagaagtggaaggagaaggagaaggaggccagccgcttctctgctggcagccgcatcttccggggccgcctggagaactggacccccaagccctgcagcacagcccagaccagcaccaggagcccctgcatgcccttctcctggttcaatgacagcaggaagggcagctacagcttcaggaacctgcctgcccccaccagcagcctgcagcccagccctgagaccctcatcagtgacaagaagggcagcaaggtggagaacacctggatcaccaaggccaacaagaggaaccccaaccccagcagcagcagcatcttcggccgccacagccagctgatgtctgtggtgtggatccaggagaccaacaacttcaccttcaatgatgacttcagccccagcagcaccagcagcgctgacctgagcggcctgggcgctgagcccaagaccccaggcctgagccagagcctggccctgagcagtgatgagatcctggatgatggccagagccccaagcacagccagtgccagaacagagctgtgcaggagtggagcgtgcagcaggtgagccactggctgatgagcctgaacctggagcagtatgtgtctgagttcagcgcccagaacatcactggagagcagctgctgcagctggatggcaacaagctgaaggccctgggcatgacagccagccaggacagagctgtggtgaagaagaagctgaaggagatgaagatgagcctggagaaggccaggaaggcccaggagaagatggagaagcagcgggagaagctgcggaggaaggagcaggagcagatgcagaggaagagcaagaagacagagaagatgaccagcaccacagctgagggcgctggggagcagtag

SEQ ID NO: 166022 - DNA, 1026 bp, Artificial Sequence
  Description of Artificial Sequence: Synthetic coding sequence
atgtctgacagcgagaagctgaacctggacagcatcatcggccgcctgctggagggcagccgggtgctgaccccccactgtgcccctgtgcagggcagcaggcctgggaagaatgtgcagctgacagaaaatgagatccggggcctgtgcctgaagagccgggagatcttcctgagccagcccatcctgctggagctggaggcccccctgaagatctgtggggacatccacggccagtactatgacctgctgcggctgtttgaatatggaggcttccccccagagagcaactacctgttcctgggggactatgtggaccggggcaagcagagcctggagaccatctgcctgctgctggcctacaagatcaagtacccagagaacttcttcctgctgcggggcaaccatgaatgtgccagcatcaaccgcatctacggcttctatgatgagtgcaagaggcgctacaacatcaagctgtggaagaccttcacagactgcttcaactgcctgcccatcgccgccatcgtggatgagaagatcttctgctgccacggcggcctgagcccagacctgcagagcatggagcagatccgccgcatcatgaggcccacagatgtgcctgaccagggcctgctgtgtgacctgctgtggagcgaccctgacaaggatgtgcagggctggggagaaaatgacagaggagtgtccttcaccttcggggctgaggtggtggccaagttcctgcacaagcatgacctggacctgatctgccgggcccaccaggtggtggaggatggctatgagttctttgccaagaggcagctggtgaccctcttcagcgcccccaactactgtggggagtttgacaatgctggggccatgatgtctgtggatgagaccctgatgtgcagcttccagatcctgaagccagctgacaagaacaagggcaagtatggccagttcagcggcctgaaccctgggggccggcccatcaccccacccaggaacagcgccaaggccaagaagtag

SEQ ID NO: 166023 - DNA, 993 bp, Artificial Sequence
  Description of Artificial Sequence: Synthetic coding sequence
atgtctgacagcgagaagctgaacctggacagcatcatcggccgcctgctggaggtgcagggcagcaggcctgggaagaatgtgcagctgacagaaaatgagatccggggcctgtgcctgaagagccgggagatcttcctgagccagcccatcctgctggagctggaggcccccctgaagatctgtggggacatccacggccagtactatgacctgctgcggctgtttgaatatggaggcttccccccagagagcaactacctgttcctgggggactatgtggaccggggcaagcagagcctggagaccatctgcctgctgctggcctacaagatcaagtacccagagaacttcttcctgctgcggggcaaccatgaatgtgccagcatcaaccgcatctacggcttctatgatgagtgcaagaggcgctacaacatcaagctgtggaagaccttcacagactgcttcaactgcctgcccatcgccgccatcgtggatgagaagatcttctgctgccacggcggcctgagcccagacctgcagagcatggagcagatccgccgcatcatgaggcccacagatgtgcctgaccagggcctgctgtgtgacctgctgtggagcgaccctgacaaggatgtgcagggctggggagaaaatgaccggggcgtgtccttcacctttggagctgaggtggtggccaagttcctgcacaagcatgacctggacctgatctgccgggcccaccaggtggtggaggatggctatgagttctttgccaagaggcagctggtgaccctcttcagcgcccccaactactgtggggagtttgacaatgctggggccatgatgtctgtggatgagaccctgatgtgcagcttccagatcctgaagccagctgacaagaacaagggcaagtatggccagttcagcggcctgaaccctgggggccggcccatcaccccaccaagaaattctgccaaggccaagaagtag

SEQ ID NO: 166024 - DNA, 1245 bp, Artificial Sequence
  Description of Artificial Sequence: Synthetic coding sequence
atgaggcagagagctgacagaagatccatggtgtccaccagcggggccgccacagccagcagcgctgctggccccagcagaggagctgcccacagccccagcagcgccccccacgccagccgccaccggccccccttcagcagccgggccaccggcctgctgcagcagaggcagcactgtgtgcaccactgcacccagctgtgcccccgggtgcagaccccctgcctgcccccacctccagccccagccacagagctgcacagctacctgcagcagggcggggagcggggcctgctggacaccaccccaggcacagctggctggggcaccagcgccactggagctgtgcagggcagcaggcctgggaagaatgtgcagctgacagaaaatgagatccggggcctgtgcctgaagagccgggagatcttcctgagccagcccatcctgctggagctggaggcccccctgaagatctgtggggacatccacggccagtactatgacctgctgcggctgtttgaatatggaggcttccccccagagagcaactacctgttcctgggggactatgtggaccggggcaagcagagcctggagaccatctgcctgctgctggcctacaagatcaagtacccagagaacttcttcctgctgcggggcaaccatgaatgtgccagcatcaaccgcatctacggcttctatgatgagtgcaagaggcgctacaacatcaagctgtggaagaccttcacagactgcttcaactgcctgcccatcgccgccatcgtggatgagaagatcttctgctgccacggcggcctgagcccagacctgcagagcatggagcagatccgccgcatcatgaggcccacagatgtgcctgaccagggcctgctgtgtgacctgctgtggagcgaccctgacaaggatgtgcagggctggggagaaaatgacagaggagtgtccttcaccttcggggctgaggtggtggccaagttcctgcacaagcatgacctggacctgatctgccgggcccaccaggtggtggaggatggctatgagttctttgccaagaggcagctggtgaccctcttcagcgcccccaactactgtggggagtttgacaatgctggggccatgatgtctgtggatgagaccctgatgtgcagcttccagatcctgaagccagctgacaagaacaagggcaagtatggccagttcagcggcctgaaccctgggggccgctag

SEQ ID NO: 166025 - DNA, 984 bp, Artificial Sequence
  Description of Artificial Sequence: Synthetic coding sequence
atggctgatggagagctgaatgtggacagcctcatcacccggctgctggaggtgcggggctgcaggcctgggaagatcgtgcagatgacagaggccgaggtgcggggcctgtgcatcaagagccgggagatcttcctgagccagcccatcctgctggagctggaggcccccctgaagatctgtggggacatccacggccagtacacagacctgctgcggctgtttgaatatggaggcttccccccagaggccaactacctgttcctgggggactatgtggaccggggcaagcagagcctggagaccatctgcctgctgctggcctacaagatcaagtacccagagaacttcttcctgctgcggggcaaccatgaatgtgccagcatcaaccgcatctacggcttctatgatgagtgcaagaggcgcttcaacatcaagctgtggaagaccttcacagactgcttcaactgcctgcccatcgccgccatcgtggatgagaagatcttctgctgccacggcggcctgagcccagacctgcagagcatggagcagatccgccgcatcatgaggcccacagatgtgcctgacaccggcctgctgtgtgacctgctgtggagcgaccctgacaaggatgtgcagggctggggagaaaatgacagaggagtgtccttcaccttcggggctgatgtggtgtccaagttcctgaacagacatgacctggacctgatctgccgggcccaccaggtggtggaggatggctatgagttctttgccaagaggcagctggtgaccctcttcagcgcccccaactactgtggggagtttgacaatgctgggggcatgatgtctgtggatgagaccctgatgtgcagcttccagatcctgaagcccagcgagaagaaggccaagtaccagtatggaggcctgaacagcggccggcctgtgaccccacccaggacagccaacccccccaagaagaggtag

SEQ ID NO: 166026 - DNA, 984 bp, Artificial Sequence; identical to SEQ ID NO: 166025
  Description of Artificial Sequence: Synthetic coding sequence

SEQ ID NO: 166027 - DNA, 984 bp, Artificial Sequence; identical to SEQ ID NO: 166025
  Description of Artificial Sequence: Synthetic coding sequence

SEQ ID NO: 166028 - DNA, 378 bp, Artificial Sequence
  Description of Artificial Sequence: Synthetic coding sequence
atggctgatggagagctgaatgtggacagcctcatcacccggctgctggaggtgcggggctgcaggcctgggaagatcgtgcagatgacagaggccgaggtgcggggcctgtgcatcaagagccgggagatcttcctgagccagcccatcctgctggagctggaggcccccctgaagatctgtggggacatccacggccagtacacagacctgctgcggctgtttgaatatggaggcttccccccagaggccaactacctgttcctgggggactatgtggaccggggcaagcagagcctggagaccatctgcctgctgctggcctacaagatcaagtacccagagaacttcttcctgctgcggggcaaccacgagtag

SEQ ID NO: 166029 - DNA, 417 bp, Artificial Sequence
  Description of Artificial Sequence: Synthetic coding sequence
atggctgatggagagctgaatgtggacagcctcatcacccggctgctggaggtgcggggctgcaggcctgggaagatcgtgcagatgacagaggccgaggtgcggggcctgtgcatcaagagccgggagatcttcctgagccagcccatcctgctggagctggaggcccccctgaagatctgtggggacatccacggccagtacacagacctgctgcggctgtttgaatatggaggcttccccccagaggccaactacctgttcctgggggactatgtggaccggggcaagcagagcctggagaccatctgcctgctgctggcctacaagatcaagtacccagagaacttcttcctgctgcggggcaaccatgaatgtgccagcatcaaccgcatctacggcttctatgatgaatag

SEQ ID NO: 166030 - DNA, 510 bp, Artificial Sequence
  Description of Artificial Sequence: Synthetic coding sequence
atgacagaggccgaggtgcggggcctgtgcatcaagagccgggagatcttcctgagccagcccatcctgctggagctggaggcccccctgaagatctgtggggacatccacggccagtacacagacctgctgcggctgtttgaatatggaggcttccccccagaggccaactacctgttcctgggggactatgtggaccggggcaagcagagcctggagaccatctgcctgctgctggcctacaagatcaagtacccagagaacttcttcctgctgcggggcaaccatgaatgtgccagcatcaaccgcatctacggcttctatgatgagtgcaagaggcgcttcaacatcaagctgtggaagaccttcacagactgcttcaactgcctgcccatcgccgccatcgtggatgagaagatcttctgctgccacggcggcctgagcccagacctgcagagcatggagcagatccgccgcatcatgaggcccacagatgtgcctgacacctag

SEQ ID NO: 166031 - DNA, 972 bp, Artificial Sequence
  Description of Artificial Sequence: Synthetic coding sequence
atggctgacctggacaagctgaacatcgacagcatcatccagaggctgctggaggtgcggggcagcaagccaggcaagaatgtgcagctgcaggagaatgagatccggggcctgtgcctgaagagccgggagatcttcctgagccagcccatcctgctggagctggaggcccccctgaagatctgtggggacatccacggccagtactatgacctgctgcggctgtttgaatatggaggcttccccccagagagcaactacctgttcctgggggactatgtggaccggggcaagcagagcctggagaccatctgcctgctgctggcctacaagatcaagtacccagagaacttcttcctgctgcggggcaaccatgaatgtgccagcatcaaccgcatctacggcttctatgatgagtgcaagaggcgctacaacatcaagctgtggaagaccttcacagactgcttcaactgcctgcccatcgccgccatcgtggatgagaagatcttctgctgccacggcggcctgagcccagacctgcagagcatggagcagatccgccgcatcatgaggcccacagatgtgcctgaccagggcctgctgtgtgacctgctgtggagcgaccctgacaaggatgtgctgggctggggagaaaatgaccggggcgtgtccttcacctttggagctgaggtggtggccaagttcctgcacaagcatgacctggacctgatctgccgggcccaccaggtggtggaggatggctatgagttctttgccaagaggcagctggtgaccctcttcagcgcccccaactactgtggggagtttgacaatgctggggccatgatgtctgtggatgagaccctgatgtgcagcttccagatcctgaagccagctgagaagaagaagcccaatgccaccaggcctgtgaccccaccccggggcatgatcaccaagcaggccaagaagtag

SEQ ID NO: 166032 - DNA, 1014 bp, Artificial Sequence
  Description of Artificial Sequence: Synthetic coding sequence
atggctgacctggacaagctgaacatcgacagcatcatccagaggctgctggaggtgcggggcagcaagccaggcaagaatgtgcagctgcaggagaatgagatccggggcctgtgcctgaagagccgggagatcttcctgagccagcccatcctgctggagctggaggcccccctgaagatctgtggggacatccacggccagtactatgacctgctgcggctgtttgaatatggaggcttccccccagagagcaactacctgttcctgggggactatgtggaccggggcaagcagagcctggagaccatctgcctgctgctggcctacaagatcaagtacccagagaacttcttcctgctgcggggcaaccatgaatgtgccagcatcaaccgcatctacggcttctatgatgagtgcaagaggcgctacaacatcaagctgtggaagaccttcacagactgcttcaactgcctgcccatcgccgccatcgtggatgagaagatcttctgctgccacggcggcctgagcccagacctgcagagcatggagcagatccgccgcatcatgaggcccacagatgtgcctgaccagggcctgctgtgtgacctgctgtggagcgaccctgacaaggatgtgctgggctggggagaaaatgaccggggcgtgtccttcacctttggagctgaggtggtggccaagttcctgcacaagcatgacctggacctgatctgccgggcccaccaggtggtggaggatggctatgagttctttgccaagaggcagctggtgaccctcttcagcgcccccaactactgtggggagtttgacaatgctggggccatgatgtctgtggatgagaccctgatgtgcagcttccagatcctgaagccagctgagaagaagaagcccaatgccaccaggcctgtgaccccaccccgggtggccagcggcctgaaccccagcatccagaaggccagcaactacagaaacaacacagtgctgtatgaatag

SEQ ID NO: 166033 - DNA, 999 bp, Artificial Sequence
  Description of Artificial Sequence: Synthetic coding sequence
atgttcctgcccctgtacctgaacctggtgctgtactttgtgttctggctgcactggaccaactgtgacttcagcctggccgtgcggggcagcaagccaggcaagaatgtgcagctgcaggagaatgagatccggggcctgtgcctgaagagccgggagatcttcctgagccagcccatcctgctggagctggaggcccccctgaagatctgtggggacatccacggccagtactatgacctgctgcggctgtttgaatatggaggcttccccccagagagcaactacctgttcctgggggactatgtggaccggggcaagcagagcctggagaccatctgcctgctgctggcctacaagatcaagtacccagagaacttcttcctgctgcggggcaaccatgaatgtgccagcatcaaccgcatctacggcttctatgatgagtgcaagaggcgctacaacatcaagctgtggaagaccttcacagactgcttcaactgcctgcccatcgccgccatcgtggatgagaagatcttctgctgccacggcggcctgagcccagacctgcagagcatggagcagatccgccgcatcatgaggcccacagatgtgcctgaccagggcctgctgtgtgacctgctgtggagcgaccctgacaaggatgtgctgggctggggagaaaatgacagaggagtgtccttcaccttcggggctgaggtggtggccaagttcctgcacaagcatgacctggacctgatctgccgggcccaccaggtggtggaggatggctatgagttctttgccaagaggcagctggtgaccctcttcagcgcccccaactactgtggggagtttgacaatgctggggccatgatgtctgtggatgagaccctgatgtgcagcttccagatcctgaagccagctgagaagaagaagcccaatgccaccaggcctgtgaccccaccccggggcatgatcaccaagcaggccaagaagtag

SEQ ID NO: 166034 - DNA, 426 bp, Artificial Sequence
  Description of Artificial Sequence: Synthetic coding sequence
atggagcagatccgccgcatcatgaggcccacagatgtgcctgaccagggcctgctgtgtgacctgctgtggagcgaccctgacaaggatgtgctgggctggggagaaaatgaccggggcgtgtccttcacctttggagctgaggtggtggccaagttcctgcacaagcatgacctggacctgatctgccgggcccaccaggtggtggaggatggctatgagttctttgccaagaggcagctggtgaccctcttcagcgcccccaactactgtggggagtttgacaatgctggggccatgatgtctgtggatgagaccctgatgtgcagcttccagatcctgaagccagctgagaagaagaagcccaatgccaccaggcctgtgaccccaccccggggcatgatcaccaagcaggccaagaagtag

SEQ ID NO: 166035 - DNA, 225 bp, Artificial Sequence
  Description of Artificial Sequence: Synthetic coding sequence
atgggcagaagaagcagcaagtgctgctgcatctatgagaagccccgggccttcggggagagcagcacagaaagtgatgaggaggaggaggagggctgcggccacacccactgtgtgcggggccacaggaagggcagaagaagagccaccctgggccccacccccaccaccccaccccagcccccagaccccagccagcccccacctggccccatgcagcactag

SEQ ID NO: 166036 - DNA, 225 bp, Artificial Sequence; identical to SEQ ID NO: 166035
  Description of Artificial Sequence: Synthetic coding sequence

SEQ ID NO: 166037 - DNA, 225 bp, Artificial Sequence; identical to SEQ ID NO: 166035
  Description of Artificial Sequence: Synthetic coding sequence

SEQ ID NO: 166038 - DNA, 225 bp, Artificial Sequence; identical to SEQ ID NO: 166035
  Description of Artificial Sequence: Synthetic coding sequence

SEQ ID NO: 166039 - DNA, 381 bp, Artificial Sequence
  Description of Artificial Sequence: Synthetic coding sequence
atggccgaggccggggccggcctgtctgaaacagtgacagagaccaccgtgacagtgaccacagagcctgagaacagaagcctgaccatcaagctgaggaagaggaagccagagaagaaggtggagtggaccagtgacacagtggacaatgagcacatgggcagaagaagcagcaagtgctgctgcatctatgagaagccccgggccttcggggagagcagcacagaaagtgatgaggaggaggaggagggctgcggccacacccactgtgtgcggggccacaggaagggcagaagaagagccaccctgggccccacccccaccaccccaccccagcccccagaccccagccagcccccacctggccccatgcagcactag

SEQ ID NO: 166040 - DNA, 225 bp, Artificial Sequence; identical to SEQ ID NO: 166035
  Description of Artificial Sequence: Synthetic coding sequence

SEQ ID NO: 166041 - DNA, 381 bp, Artificial Sequence; identical to SEQ ID NO: 166039
  Description of Artificial Sequence: Synthetic coding sequence

SEQ ID NO: 166042 - DNA, 225 bp, Artificial Sequence; identical to SEQ ID NO: 166035
  Description of Artificial Sequence: Synthetic coding sequence

SEQ ID NO: 166043 - DNA, 225 bp, Artificial Sequence; identical to SEQ ID NO: 166035
  Description of Artificial Sequence: Synthetic coding sequence

SEQ ID NO: 166044 - DNA, 225 bp, Artificial Sequence; identical to SEQ ID NO: 166035
  Description of Artificial Sequence: Synthetic coding sequence

SEQ ID NO: 166045 - DNA, 225 bp, Artificial Sequence; identical to SEQ ID NO: 166035
  Description of Artificial Sequence: Synthetic coding sequence

SEQ ID NO: 166046 - DNA, 225 bp, Artificial Sequence; identical to SEQ ID NO: 166035
  Description of Artificial Sequence: Synthetic coding sequence

SEQ ID NO: 166047 - DNA, 225 bp, Artificial Sequence; identical to SEQ ID NO: 166035
  Description of Artificial Sequence: Synthetic coding sequence

SEQ ID NO: 166048 - DNA, 225 bp, Artificial Sequence; identical to SEQ ID NO: 166035
  Description of Artificial Sequence: Synthetic coding sequence

SEQ ID NO: 166049 - DNA, 225 bp, Artificial Sequence; identical to SEQ ID NO: 166035
  Description of Artificial Sequence: Synthetic coding sequence

SEQ ID NO: 166050 - DNA, 225 bp, Artificial Sequence; identical to SEQ ID NO: 166035
  Description of Artificial Sequence: Synthetic coding sequence

SEQ ID NO: 166051 - DNA, 225 bp, Artificial Sequence; identical to SEQ ID NO: 166035
  Description of Artificial Sequence: Synthetic coding sequence

SEQ ID NO: 166052 - DNA, 225 bp, Artificial Sequence; identical to SEQ ID NO: 166035
  Description of Artificial Sequence: Synthetic coding sequence

SEQ ID NO: 166053 - DNA, 225 bp, Artificial Sequence; identical to SEQ ID NO: 166035
  Description of Artificial Sequence: Synthetic coding sequence

SEQ ID NO: 166054 - DNA, 225 bp, Artificial Sequence; identical to SEQ ID NO: 166035
  Description of Artificial Sequence: Synthetic coding sequence

SEQ ID NO: 166055 - DNA, 225 bp, Artificial Sequence; identical to SEQ ID NO: 166035
  Description of Artificial Sequence: Synthetic coding sequence

SEQ ID NO: 166056 - DNA, 225 bp, Artificial Sequence; identical to SEQ ID NO: 166035
  Description of Artificial Sequence: Synthetic coding sequence

SEQ ID NO: 166057 - DNA, 381 bp, Artificial Sequence; identical to SEQ ID NO: 166039
  Description of Artificial Sequence: Synthetic coding sequence

SEQ ID NO: 166058 - DNA, 381 bp, Artificial Sequence; identical to SEQ ID NO: 166039
  Description of Artificial Sequence: Synthetic coding sequence

SEQ ID NO: 166059 - DNA, 225 bp, Artificial Sequence; identical to SEQ ID NO: 166035
  Description of Artificial Sequence: Synthetic coding sequence

SEQ ID NO: 166060 - DNA, 225 bp, Artificial Sequence; identical to SEQ ID NO: 166035
  Description of Artificial Sequence: Synthetic coding sequence

SEQ ID NO: 166061 - DNA, 225 bp, Artificial Sequence; identical to SEQ ID NO: 166035
  Description of Artificial Sequence: Synthetic coding sequence

SEQ ID NO: 166062 - DNA, 381 bp, Artificial Sequence; identical to SEQ ID NO: 166039
  Description of Artificial Sequence: Synthetic coding sequence

SEQ ID NO: 166063 - DNA, 225 bp, Artificial Sequence; identical to SEQ ID NO: 166035
  Description of Artificial Sequence: Synthetic coding sequence

SEQ ID NO: 166064 - DNA, 225 bp, Artificial Sequence; identical to SEQ ID NO: 166035
  Description of Artificial Sequence: Synthetic coding sequence

SEQ ID NO: 166065 - DNA, 381 bp, Artificial Sequence; identical to SEQ ID NO: 166039
  Description of Artificial Sequence: Synthetic coding sequence

SEQ ID NO: 166066 - DNA, 225 bp, Artificial Sequence; identical to SEQ ID NO: 166035
  Description of Artificial Sequence: Synthetic coding sequence

SEQ ID NO: 166067 - DNA, 225 bp, Artificial Sequence; identical to SEQ ID NO: 166035
  Description of Artificial Sequence: Synthetic coding sequence

SEQ ID NO: 166068 - DNA, 225 bp, Artificial Sequence; identical to SEQ ID NO: 166035
  Description of Artificial Sequence: Synthetic coding sequence

SEQ ID NO: 166069 - DNA, 225 bp, Artificial Sequence; identical to SEQ ID NO: 166035
  Description of Artificial Sequence: Synthetic coding sequence

SEQ ID NO: 166070 - DNA, 225 bp, Artificial Sequence; identical to SEQ ID NO: 166035
  Description of Artificial Sequence: Synthetic coding sequence

SEQ ID NO: 166071 - DNA, 225 bp, Artificial Sequence; identical to SEQ ID NO: 166035
  Description of Artificial Sequence: Synthetic coding sequence

SEQ ID NO: 166072 - DNA, 381 bp, Artificial Sequence; identical to SEQ ID NO: 166039
  Description of Artificial Sequence: Synthetic coding sequence

SEQ ID NO: 166073 - DNA, 225 bp, Artificial Sequence; identical to SEQ ID NO: 166035
  Description of Artificial Sequence: Synthetic coding sequence

SEQ ID NO: 166074 - DNA, 225 bp, Artificial Sequence; identical to SEQ ID NO: 166035
  Description of Artificial Sequence: Synthetic coding sequence

SEQ ID NO: 166075 - DNA, 225 bp, Artificial Sequence; identical to SEQ ID NO: 166035
  Description of Artificial Sequence: Synthetic coding sequence

SEQ ID NO: 166076 - DNA, 225 bp, Artificial Sequence; identical to SEQ ID NO: 166035
  Description of Artificial Sequence: Synthetic coding sequence

SEQ ID NO: 166077 - DNA, 225 bp, Artificial Sequence; identical to SEQ ID NO: 166035
  Description of Artificial Sequence: Synthetic coding sequence

SEQ ID NO: 166078 - DNA, 225 bp, Artificial Sequence; identical to SEQ ID NO: 166035
  Description of Artificial Sequence: Synthetic coding sequence

SEQ ID NO: 166079 - DNA, 381 bp, Artificial Sequence; identical to SEQ ID NO: 166039
  Description of Artificial Sequence: Synthetic coding sequence

SEQ ID NO: 166080 - DNA, 225 bp, Artificial Sequence; identical to SEQ ID NO: 166035
  Description of Artificial Sequence: Synthetic coding sequence

SEQ ID NO: 166081 - DNA, 225 bp, Artificial Sequence; identical to SEQ ID NO: 166035
  Description of Artificial Sequence: Synthetic coding sequence

SEQ ID NO: 166082 - DNA, 225 bp, Artificial Sequence; identical to SEQ ID NO: 166035
  Description of Artificial Sequence: Synthetic coding sequence

SEQ ID NO: 166083 - DNA, 444 bp, Artificial Sequence
  Description of Artificial Sequence: Synthetic coding sequence
atggctgacagcggcacagctggaggagctgccctggccgccccagcccctggccctggcagcggcggccctggcccccgggtgtacttccagagccccccaggagctgctggggagggccctggaggagcagatgatgagggccctgtgcggcggcagggcaaggtgacagtgaagtatgacaggaaggagctgaggaagaggctgaacctggaggagtggatcctggagcagctgacccggctgtatgactgccaggaggaggagatccctgagctggagattgatgtggatgagctgctggacatggagagtgatgatgcccgggccgcccgggtgaaggagctgctggtggactgctacaagcccacagaggccttcatcagcggcctgctggacaagatccggggcatgcagaagctgagcaccccccagaagaagtag

SEQ ID NO: 166084 - DNA, 498 bp, Artificial Sequence
  Description of Artificial Sequence: Synthetic coding sequence
atgtctgtggccaccggcagcagcgagacagctggaggagccagcggcggcggggcccgggtcttcttccagagcccccggggcggggccggcggcagccctggcagcagcagcggcagcggcagcagcagagaagattctgcccctgtggccacagctgctgctgctggccaggtgcagcagcagcagcagaggaggcaccagcagggcaaggtgacagtgaagtatgacaggaaggagctgaggaagaggctggtgctggaggagtggatcgtggagcagctgggccagctgtatggctgtgaggaggaggagatgcctgaggtggagattgatattgatgacctgctggatgctgacagtgatgaggagcgggccagcaagctgcaggaggccctggtggactgctacaagcccacagaggagttcatcaaggagctgctgagccgcatccggggcatgaggaagctgagccccccccagaagaagtctgtgtag

SEQ ID NO: 166085 - DNA, 438 bp, Artificial Sequence
  Description of Artificial Sequence: Synthetic coding sequence
atgctgagcagcagccctgccagctgcaccagccccagcccagatggagagaacccctgcaagaaggtgcactgggccagcggcagaagaaggaccagcagcacagattctgagagcaagagccacccagacagcagcaagatccccaggagccggcggcccagccggctgactgtgaagtatgaccggggccagctgcagcgctggctggagatggagcagtgggtggatgcccaggtgcaggagctgttccaggaccaggccaccccatctgagcctgagattgacctggaggccctgatggacctgagcacagaggagcagaagacccagctggaggccatcctgggcaactgcccccggcccacagaggccttcatcagcgagctgctgagccagctgaagaagctgcggcggctgagccggccccagaagtag

SEQ ID NO: 166086 - DNA, 603 bp, Artificial Sequence
  Description of Artificial Sequence: Synthetic coding sequence
atgctgagcagcagccctgccagctgcaccagccccagcccagatggagagaacccctgcaagaaggtgcactgggccagcggcagaagaaggaccagcagcacagattctgagagcaagagccacccagacagcagcaagatccccaggagccggcggcccagccggctgactgtgaagtatgaccggggccagctgcagcgctggctggagatggagcagtgggtggatgcccaggtgcaggagctgttccagagcctggccctgagcccccggctggagtgcagcggggtcatccacagcctgcagctgctgcccccaggcttcaaccgcttcagctgcctgagctcctggagctcctgggactatggcatcaagcagcccctgctgagcctgcggctgacctggaagctgtcctggatctacccccagaggagccggcggctgtcctggaggcccttcctgggcacagccccagccccccagaggctgctgagcctgagctgcagcgtgaacagcaggaacagcggggacagcgctggcctgaggaacaagccagagcggcccagcctggccgccagcgccctgcccggcctgccctag

SEQ ID NO: 166087 - DNA, 516 bp, Artificial Sequence
  Description of Artificial Sequence: Synthetic coding sequence
atggagcaggacaacagccccaggaagatccagttcaccgtgcccctgctggagccccacctggaccctgaggccgctgagcagatcagaagaagaagacccaccccagccaccctggtgctgaccagtgaccagagcagccctgagattgatgaggaccgcatccccaacccccacctgaagagcaccctggccatgagcccccggcagaggaagaagatgacccgcatcacccccaccatgaaggagctgcagatgatggtggagcaccacctgggccagcagcagcagggcgaggagcctgagggcgctgctgagagcacagagacccaggagagcaggcctcctggcatcccagacacagaggtggagagccggctgggcaccagcggcacagccaagaagacagctgagtgcatccccaagacccatgagcggggcagcaaggagcccagcaccaaggagcccagcacccacatcccccccctggacagcaagggggccaacagcgtgtag

SEQ ID NO: 166088 - DNA, 462 bp, Artificial Sequence
  Description of Artificial Sequence: Synthetic coding sequence
atggagcaggacaacagccccaggaagatccagttcaccgtgcccctgctggagccccacctggaccctgaggccgctgagcagatcagaagaagaagacccaccccagccaccctggtgctgaccagtgaccagagcagccctgagattgatgaggaccgcatccccaacccccacctgaagaagctgcagaatgccagcctgaagctgacccgggaggccgtgaggaacccagcccagaagaacccccagcccatctaccaccactggatcccccgggagcccacccgctgccaccggcggggcggcaccggcggccagaagtctgtgggcggcttcccctgcagcacccacaccctggcccccttctacgtgttcaccaggagcatcctgctgctgaagagaggagagaggatgagccaccccctggagcccagagatgaccccaccaagatgccctag

SEQ ID NO: 166089 - DNA, 330 bp, Artificial Sequence
  Description of Artificial Sequence: Synthetic coding sequence
atggagcccaacagccccaagaagatccagtttgctgtgcctgtgttccagagccagatcgcccctgaggccgctgagcagatcaggaagagaagacccaccccagccagcctggtgatcctgaatgagcacaaccccccagaaattgatgacaagaggggccccaacacccagggcgagctgcagaatgccagccccaagcagaggaagcagagcgtgtacaccccacccaccatcaagggcgtgaagcacctgaagggccagaatgaaagtgccttccctgaggaggaggagggcaccaatgaaagagaggagcagagggaccactag

SEQ ID NO: 166090 - DNA, 330 bp, Artificial Sequence; identical to SEQ ID NO: 166089
  Description of Artificial Sequence: Synthetic coding sequence

SEQ ID NO: 166091 - DNA, 330 bp, Artificial Sequence; identical to SEQ ID NO: 166089
  Description of Artificial Sequence: Synthetic coding sequence

SEQ ID NO: 166092 - DNA, 618 bp, Artificial Sequence
  Description of Artificial Sequence: Synthetic coding sequence
atggccgccagcacagccagccaccggcccatcaagggcatcctgaagaacaagaccagcaccaccagctccatggtggccagcgctgagcagcccagaggaaatgtggatgaggagctgagcaagaagagccagaagtgggatgagatgaacatcctggccacctaccaccctgctgacaaggactatggcctgatgaagattgatgagcccagcaccccctaccacagcatgatgggagatgatgaagatgcctgcagcgacacagaggccacagaggccatggccccagacatcctggccaggaagctggccgctgctgagggcctggagcccaagtaccgcatccaggagcaggagagcagcggggaggaggacagcgacctgagccctgaggagcgggagaagaagaggcagtttgagatgaagaggaagctgcactacaatgaaggcctgaacatcaagctggcccggcagctgatcagcaaggacctgcatgatgatgatgaagatgaggagatgctggagacagcagatggagagagcatgaacacagaggagagcaaccagggcagcacccccagcgaccagcagcagaacaagctgcggagcagctag

SEQ ID NO: 166093 - DNA, 3093 bp, Artificial Sequence
  Description of Artificial Sequence: Synthetic coding sequence
atgaagatggctgatgccaagcagaagagaaatgagcagctgaagcgctggattggcagcgagacagacctggagccccctgtggtgaagaggcagaagaccaaggtgaagtttgatgatggagctgtgttcctggccgcctgcagcagcggggacacagatgaggtgctgaagctgctgcacagaggagctgacatcaactatgccaacgtggatggcctgacagccctgcaccaggcctgcattgatgacaacgtggacatggtgaagttcctggtggagaatggagccaacatcaaccagcctgacaatgaaggctggatccccctgcacgccgccgccagctgtggctacctggacattgctgagttcctgattggccagggcgcccacgtgggcgctgtgaacagcgagggggacacccccctggacattgctgaggaggaggccatggaggagctgctgcagaatgaggtgaaccggcagggcgtggacatcgaggccgccaggaaggaggaggagcgcatcatgctgagagatgcccggcagtggctgaacagcggccacatcaatgatgtgagacatgccaagagcggcggcacagccctgcacgtggccgccgccaagggctacacagaggtgctgaagctgctgatccaggccggctatgatgtgaacatcaaggactatgatggctggacccccctgcacgccgccgcccactggggcaaggaggaggcctgccgcatcctggtggacaacctgtgtgacatggagatggtgaacaaggtgggccagacagcctttgatgtggctgatgaggacatcctgggctacctggaggagctgcagaagaagcagaacctgctgcacagcgagaagagggacaagaagagccccctcatcgagagcacagccaacatggacaacaaccagagccagaagaccttcaagaacaaggagaccctcatcatcgagcctgagaagaatgccagccgcatcgagagcctggagcaggagaaggtggatgaggaggaggagggcaagaaggatgagagcagctgcagcagtgaagaagatgaggaggatgattctgagagcgaggccgagacagacaagaccaagcccctggcctctgtgaccaatgccaacaccagcagcacccaggccgcccctgtggccgtgaccacccccaccgtgagcagcggccaggccacccccaccagccccatcaagaagttccccaccacagccaccaagatcagccccaaggaggaggagaggaaggatgagagccctgccacctggaggctgggcctgaggaagacaggcagctatggagccctggccgagatcacagccagcaaggagggccagaaggagaaggacacagctggggtgaccaggtctgccagcagcccccggctgagcagcagcctggacaacaaggagaaggagaaggacagcaagggcacccggctggcctacgtggcccccaccatcccccggcggctggccagcaccagtgacatcgaggagaaggaaaatagagacagcagcagcctgcggaccagcagcagctacaccaggaggaagtgggaggatgacctgaagaagaacagctctgtgaatgaaggcagcacctaccacaagagctgcagctttggaagacggcaggatgacctgatcagcagctctgtgcccagcaccaccagcacccccaccgtgaccagcgctgctggcctgcagaagagcctgctgagcagcaccagcaccaccaccaagatcaccaccggcagcagcagcgctggcacccagagcagcaccagcaaccggctgtgggccgaggacagcacagagaaggagaaggacagcgtgcccacagctgtgaccatccctgtggcccccaccgtggtgaatgctgctgccagcaccaccaccctgaccaccaccacagctggcaccgtgagcagcaccacagaggtgcgggagcggcggcgcagctacctgacccctgtgagagatgaggagagcgagagccagaggaaggcccggagccggcaggcccggcagagcagaagaagcacccagggcgtgaccctgacagacctgcaggaggccgagaagaccatcggccgcagccgcagcaccaggacccgggagcaggagaatgaggagaaggagaaggaggagaaggagaagcaggacaaggagaagcaggaggagaagaaggagagcgagaccagcagagaagatgagtacaagcagaagtacagcaggacctatgatgagacctaccagcgctacagacctgtgtccaccagcagcagcaccacccccagcagcagcctgagcaccatgagcagcagcctgtatgccagcagccagctgaaccggcccaacagcctggtgggcatcaccagcgcctacagccggggcatcaccaaggaaaatgaaagagaaggagagaagcgggaggaggagaaggagggggaggacaagagccagcccaagagcatccgggagcggcggcggccccgggagaagaggaggagcactggagtgtccttctggacccaggacagtgatgaaaatgagcaggagcagcagagcgacacagaggagggcagcaacaagaaggagacccagacagacagcatcagccgctatgagaccagcagcaccagcgctggggacagatatgacagcctgctgggccgcagcggcagctacagctacctggaggagaggaagccctacagcagccggctggagaaggatgacagcacagacttcaagaagctgtatgagcagatcctggccgagaatgagaagctgaaggcccagctgcatgacaccaacatggagctgacagacctgaagctgcagctggagaaggccacccagaggcaggagagatttgctgacaggagcctgctggagatggagaagcgggagcggcgggccctggagcggcgcatcagcgagatggaggaggagctgaagatgctgcctgacctgaaggctgacaaccagaggctgaaggatgaaaatggagccctgatccgggtcatcagcaagctgagcaagtag

SEQ ID NO: 166094 - DNA, 2916 bp, Artificial Sequence
  Description of Artificial Sequence: Synthetic coding sequence
atgaagatggctgatgccaagcagaagagaaatgagcagctgaagcgctggattggcagcgagacagacctggagccccctgtggtgaagaggcagaagaccaaggtgaagtttgatgatggagctgtgttcctggccgcctgcagcagcggggacacagatgaggtgctgaagctgctgcacagaggagctgacatcaactatgccaacgtggatggcctgacagccctgcaccaggcctgcattgatgacaacgtggacatggtgaagttcctggtggagaatggagccaacatcaaccagcctgacaatgaaggctggatccccctgcacgccgccgccagctgtggctacctggacattgctgagttcctgattggccagggcgcccacgtgggcgctgtgaacagcgagggggacacccccctggacattgctgaggaggaggccatggaggagctgctgcagaatgaggtgaaccggcagggcgtggacatcgaggccgccaggaaggaggaggagcgcatcatgctgagagatgcccggcagtggctgaacagcggccacatcaatgatgtgagacatgccaagagcggcggcacagccctgcacgtggccgccgccaagggctacacagaggtgctgaagctgctgatccaggccggctatgatgtgaacatcaaggactatgatggctggacccccctgcacgccgccgcccactggggcaaggaggaggcctgccgcatcctggtggacaacctgtgtgacatggagatggtgaacaaggtgggccagacagcctttgatgtggctgatgaggacatcctgggctacctggaggagctgcagaagaagcagaacctgctgcacagcgagaagagggacaagaagagccccctcatcgagagcacagccaacatggacaacaaccagagccagaagaccttcaagaacaaggagaccctcatcatcgagcctgagaagaatgccagccgcatcgagagcctggagcaggagaaggtggatgaggaggaggagggcaagaaggatgagagcagctgcagcagtgaagaagatgaggaggatgattctgagagcgaggccgagacagacaagaccaagcccctggcctctgtgaccaatgccaacaccagcagcacccaggccgcccctgtggccgtgaccacccccaccgtgagcagcggccaggccacccccaccagccccatcaagaagttccccaccacagccaccaagatcagccccaaggaggaggagaggaaggatgagagccctgccacctggaggctgggcctgaggaagacaggcagctatggagccctggccgagatcacagccagcaaggagggccagaaggagaaggacacagctggggtgaccaggtctgccagcagcccccggctgagcagcagcctggacaacaaggagaaggagaaggacagcaagggcacccggctggcctacgtggcccccaccatcccccggcggctggccagcaccagtgacatcgaggagaaggaaaatagagacagcagcagcctgcggaccagcagcagctacaccaggaggaagtgggaggatgacctgaagaagaacagctctgtgaatgaaggcagcacctaccacaagagctgcagctttggaagacggcaggatgacctgatcagcagctctgtgcccagcaccaccagcacccccaccgtgaccagcgctgctggcctgcagaagagcctgctgagcagcaccagcaccaccaccaagatcaccaccggcagcagcagcgctggcacccagagccgcagctacctgacccctgtgagagatgaggagagcgagagccagaggaaggcccggagccggcaggcccggcagagccgccgcagcacccagggcgtgaccctgacagacctgcaggaggccgagaagaccatcggccgcagccgcagcaccaggacccgggagcaggagaatgaggagaaggagaaggaggagaaggagaagcaggacaaggagaagcaggaggagaagaaggagagcgagaccagccgggaggatgagtacaagcagaagtacagcaggacctatgatgagacctaccagcgctacagacctgtgtccaccagcagcagcaccacccccagcagcagcctgagcaccatgagcagcagcctgtatgccagcagccagctgaaccggcccaacagcctggtgggcatcaccagcgcctacagccggggcatcaccaaggaaaatgaaagagaaggagagaagcgggaggaggagaaggagggggaggacaagagccagcccaagagcatccgggagaggagaagaccccgggagaagagaagaagcactggagtgtccttctggacccaggacagtgatgaaaatgagcaggagcagcagagcgacacagaggagggcagcaacaagaaggagacccaggtgaacaccatcaccctgtatgagaccagcagcaccagcgctggggacagatatgacagcctgctgggccgcagcggcagctacagctacctggaggagaggaagccctacagcagccggctggagaaggatgacagcacagacttcaagaagctgtatgagcagatcctggctgaaaatgagaagctgaaggcccagctgcatgacaccaacatggagctgacagacctgaagctgcagctggagaaggccacccagaggcaggagagatttgctgacaggagcctgctggagatggagaagcgggagcggcgggccctggagcggcgcatcagcgagatggaggaggagctgaagatgctgcctgacctgaaggctgacaaccagaggctgaaggatgaaaatggagccctgatccgggtcatcagcaagctgagcaagtag

SEQ ID NO: 166095 - DNA, 2925 bp, Artificial Sequence
  Description of Artificial Sequence: Synthetic coding sequence
atgaagatggctgatgccaagcagaagagaaatgagcagctgaagcgctggattggcagcgagacagacctggagccccctgtggtgaagaggcagaagaccaaggtgaagtttgatgatggagctgtgttcctggccgcctgcagcagcggggacacagatgaggtgctgaagctgctgcacagaggagctgacatcaactatgccaacgtggatggcctgacagccctgcaccaggcctgcattgatgacaacgtggacatggtgaagttcctggtggagaatggagccaacatcaaccagcctgacaatgaaggctggatccccctgcacgccgccgccagctgtggctacctggacattgctgagttcctgattggccagggcgcccacgtgggcgctgtgaacagcgagggggacacccccctggacattgctgaggaggaggccatggaggagctgctgcagaatgaggtgaaccggcagggcgtggacatcgaggccgccaggaaggaggaggagcgcatcatgctgagagatgcccggcagtggctgaacagcggccacatcaatgatgtgagacatgccaagagcggcggcacagccctgcacgtggccgccgccaagggctacacagaggtgctgaagctgctgatccaggccggctatgatgtgaacatcaaggactatgatggctggacccccctgcacgccgccgcccactggggcaaggaggaggcctgccgcatcctggtggacaacctgtgtgacatggagatggtgaacaaggtgggccagacagcctttgatgtggctgatgaggacatcctgggctacctggaggagctgcagaagaagcagaacctgctgcacagcgagaagagggacaagaagagccccctcatcgagagcacagccaacatggacaacaaccagagccagaagaccttcaagaacaaggagaccctcatcatcgagcctgagaagaatgccagccgcatcgagagcctggagcaggagaaggtggatgaggaggaggagggcaagaaggatgagagcagctgcagcagtgaagaagatgaggaggatgattctgagagcgaggccgagacagacaagaccaagcccctggcctctgtgaccaatgccaacaccagcagcacccaggccgcccctgtggccgtgaccacccccaccgtgagcagcggccaggccacccccaccagccccatcaagaagttccccaccacagccaccaagatcagccccaaggaggaggagaggaaggatgagagccctgccacctggaggctgggcctgaggaagacaggcagctatggagccctggccgagatcacagccagcaaggagggccagaaggagaaggacacagctggggtgaccaggtctgccagcagcccccggctgagcagcagcctggacaacaaggagaaggagaaggacagcaagggcacccggctggcctacgtggcccccaccatcccccggcggctggccagcaccagtgacatcgaggagaaggaaaatagagacagcagcagcctgcggaccagcagcagctacaccaggaggaagtgggaggatgacctgaagaagaacagctctgtgaatgaaggcagcacctaccacaagagcaccagcaaccggctgtgggccgaggacagcacagagaaggagaaggacagcgtgcccacagctgtgaccatccctgtggcccccaccgtggtgaatgctgctgccagcaccaccaccctgaccaccaccacagctggcaccgtgagcagcaccacagaggtgcgggagcggcggcgcagctacctgacccctgtgagagatgaggagagcgagagccagaggaaggcccggagccggcaggcccggcagagcagaagaagcacccagggcgtgaccctgacagacctgcaggaggccgagaagaccatcggccgcagccgcagcaccaggacccgggagcaggagaatgaggagaaggagaaggaggagaaggagaagcaggacaaggagaagcaggaggagaagaaggagagcgagaccagcagagaagatgagtacaagcagaagtacagcaggacctatgatgagacctaccagcgctacagacctgtgtccaccagcagcagcaccacccccagcagcagcctgagcaccatgagcagcagcctgtatgccagcagccagctgaaccggcccaacagcctggtgggcatcaccagcgcctacagccggggcatcaccaaggaaaatgaaagagaaggagagaagcgggaggaggagaaggagggggaggacaagagccagcccaagagcatccgggagcggcggcggccccgggagaagaggaggagcactggagtgtccttctggacccaggacagtgatgaaaatgagcaggagcagcagagcgacacagaggagggcagcaacaagaaggagacccaggtgaacaccatcaccctgtatgagaccagcagcaccagcgctggggacagatatgacagcctgctgggccgcagcggcagctacagctacctggaggagaggaagccctacagcagccggctggagaaggatgacagcacagacttcaagaagctgtatgagcagatcctggccgagaatgagaagctgaaggcccagctgcatgacaccaacatggagctgacagacctgaagctgcagctggagaaggccacccagaggcaggagagatttgctgacaggagcctgctggagatggagaagcgggagcggcgggccctggagcggcgcatcagcgagatggaggaggagctgaagatgctgcctgacctgaaggctgacaaccagaggctgaaggatgaaaatggagccctgatccgggtcatcagcaagctgagcaagtag

SEQ ID NO: 166096 - DNA, 2988 bp, Artificial Sequence
  Description of Artificial Sequence: Synthetic coding sequence
atgaagatggctgatgccaagcagaagagaaatgagcagctgaagcgctggattggcagcgagacagacctggagccccctgtggtgaagaggcagaagaccaaggtgaagtttgatgatggagctgtgttcctggccgcctgcagcagcggggacacagatgaggtgctgaagctgctgcacagaggagctgacatcaactatgccaacgtggatggcctgacagccctgcaccaggcctgcattgatgacaacgtggacatggtgaagttcctggtggagaatggagccaacatcaaccagcctgacaatgaaggctggatccccctgcacgccgccgccagctgtggctacctggacattgctgagttcctgattggccagggcgcccacgtgggcgctgtgaacagcgagggggacacccccctggacattgctgaggaggaggccatggaggagctgctgcagaatgaggtgaaccggcagggcgtggacatcgaggccgccaggaaggaggaggagcgcatcatgctgagagatgcccggcagtggctgaacagcggccacatcaatgatgtgagacatgccaagagcggcggcacagccctgcacgtggccgccgccaagggctacacagaggtgctgaagctgctgatccaggccggctatgatgtgaacatcaaggactatgatggctggacccccctgcacgccgccgcccactggggcaaggaggaggcctgccgcatcctggtggacaacctgtgtgacatggagatggtgaacaaggtgggccagacagcctttgatgtggctgatgaggacatcctgggctacctggaggagctgcagaagaagcagaacctgctgcacagcgagaagagggacaagaagagccccctcatcgagagcacagccaacatggacaacaaccagagccagaagaccttcaagaacaaggagaccctcatcatcgagcctgagaagaatgccagccgcatcgagagcctggagcaggagaaggtggatgaggaggaggagggcaagaaggatgagagcagctgcagcagtgaagaagatgaggaggatgattctgagagcgaggccgagacagacaagaccaagcccctggcctctgtgaccaatgccaacaccagcagcacccaggccgcccctgtggccgtgaccacccccaccgtgagcagcggccaggccacccccaccagccccatcaagaagttccccaccacagccaccaagatcagccccaaggaggaggagaggaaggatgagagccctgccacctggaggctgggcctgaggaagacaggcagctatggagccctggccgagatcacagccagcaaggagggccagaaggagaaggacacagctggggtgaccaggtctgccagcagcccccggctgagcagcagcctggacaacaaggagaaggagaaggacagcaagggcacccggctggcctacgtggcccccaccatcccccggcggctggccagcaccagtgacatcgaggagaaggaaaatagagacagcagcagcctgcggaccagcagcagctacaccaggaggaagtgggaggatgacctgaagaagaacagctctgtgaatgaaggcagcacctaccacaagagctgcagctttggaagacggcaggatgacctgatcagcagctctgtgcccagcaccaccagcacccccaccgtgaccagcgctgctggcctgcagaagagcctgctgagcagcaccagcaccaccaccaagatcaccaccggcagcagcagcgctggcacccagagcagcaccagcaaccggctgtgggccgaggacagcacagagaaggagaaggacagcgtgcccacagctgtgaccatccctgtggcccccaccgtggtgaatgctgctgccagcaccaccaccctgaccaccaccacagctggcaccgtgagcagcaccacagaggtgcgggagcggcggcgcagctacctgacccctgtgagagatgaggagagcgagagccagaggaaggcccggagccggcaggcccggcagagcagaagaagcacccagggcgtgaccctgacagacctgcaggaggccgagaagaccatcggccgcagccgcagcaccaggacccgggagcaggagaatgaggagaaggagaaggaggagaaggagaagcaggacaaggagaagcaggaggagaagaaggagagcgagaccagcagagaagatgagtacaagcagaagtacagcaggacctatgatgagacctaccagcgctacagacctgtgtccaccagcagcagcaccacccccagcagcagcctgagcaccatgagcagcagcctgtatgccagcagccagctgaaccggcccaacagcctggtgggcatcaccagcgcctacagccggggcatcaccaaggaaaatgaaagagaaggagagaagcgggaggaggagaaggagggggaggacaagagccagcccaagagcatccgggagcggcggcggccccgggagaagaggaggagcactggagtgtccttctggacccaggacagtgatgaaaatgagcaggagcagcagagcgacacagaggagggcagcaacaagaaggagacccaggtgaacaccatcaccctgtatgagaccagcagcaccagcgctggggacagatatgacagcctgctgggccgcagcggcagctacagctacctggaggagaggaagccctacagcagccggctggagaaggatgacagcacagacttcaagaagaggcaggagagatttgctgacaggagcctgctggagatggagaagcgggagcggcgggccctggagcggcgcatcagcgagatggaggaggagctgaagatgctgcctgacctgaaggctgacaaccagaggctgaaggatgaaaatggagccctgatccgggtcatcagcaagctgagcaagtag

SEQ ID NO: 166097 - DNA, 2988 bp, Artificial Sequence
  Description of Artificial Sequence: Synthetic coding sequence
atgaagatggctgatgccaagcagaagagaaatgagcagctgaagcgctggattggcagcgagacagacctggagccccctgtggtgaagaggcagaagaccaaggtgaagtttgatgatggagctgtgttcctggccgcctgcagcagcggggacacagatgaggtgctgaagctgctgcacagaggagctgacatcaactatgccaacgtggatggcctgacagccctgcaccaggcctgcattgatgacaacgtggacatggtgaagttcctggtggagaatggagccaacatcaaccagcctgacaatgaaggctggatccccctgcacgccgccgccagctgtggctacctggacattgctgagttcctgattggccagggcgcccacgtgggcgctgtgaacagcgagggggacacccccctggacattgctgaggaggaggccatggaggagctgctgcagaatgaggtgaaccggcagggcgtggacatcgaggccgccaggaaggaggaggagcgcatcatgctgagagatgcccggcagtggctgaacagcggccacatcaatgatgtgagacatgccaagagcggcggcacagccctgcacgtggccgccgccaagggctacacagaggtgctgaagctgctgatccaggccggctatgatgtgaacatcaaggactatgatggctggacccccctgcacgccgccgcccactggggcaaggaggaggcctgccgcatcctggtggacaacctgtgtgacatggagatggtgaacaaggtgggccagacagcctttgatgtggctgatgaggacatcctgggctacctggaggagctgcagaagaagcagaacctgctgcacagcgagaagagggacaagaagagccccctcatcgagagcacagccaacatggacaacaaccagagccagaagaccttcaagaacaaggagaccctcatcatcgagcctgagaagaatgccagccgcatcgagagcctggagcaggagaaggtggatgaggaggaggagggcaagaaggatgagagcagctgcagcagtgaagaagatgaggaggatgattctgagagcgaggccgagacagacaagaccaagcccctggcctctgtgaccaatgccaacaccagcagcacccaggccgcccctgtggccgtgaccacccccaccgtgagcagcggccaggccacccccaccagccccatcaagaagttccccaccacagccaccaagatcagccccaaggaggaggagaggaaggatgagagccctgccacctggaggctgggcctgaggaagacaggcagctatggagccctggccgagatcacagccagcaaggagggccagaaggagaaggacacagctggggtgaccaggtctgccagcagcccccggctgagcagcagcctggacaacaaggagaaggagaaggacagcaagggcacccggctggcctacgtggcccccaccatcccccggcggctggccagcaccagtgacatcgaggagaaggaaaatagagacagcagcagcctgcggaccagcagcagctacaccaggaggaagtgggaggatgacctgaagaagaacagctctgtgaatgaaggcagcacctaccacaagagctgcagctttggaagacggcaggatgacctgatcagcagctctgtgcccagcaccaccagcacccccaccgtgaccagcgctgctggcctgcagaagagcctgctgagcagcaccagcaccaccaccaagatcaccaccggcagcagcagcgctggcacccagagcagcaccagcaaccggctgtgggccgaggacagcacagagaaggagaaggacagcgtgcccacagctgtgaccatccctgtggcccccaccgtggtgaatgctgctgccagcaccaccaccctgaccaccaccacagctggcaccgtgagcagcaccacagaggtgcgggagcggcggcgcagctacctgacccctgtgagagatgaggagagcgagagccagaggaaggcccggagccggcaggcccggcagagcagaagaagcacccagggcgtgaccctgacagacctgcaggaggccgagaagaccatcggccgcagccgcagcaccaggacccgggagcaggagaatgaggagaaggagaaggaggagaaggagaagcaggacaaggagaagcaggaggagaagaaggagagcgagaccagcagagaagatgagtacaagcagaagtacagcaggacctatgatgagacctaccagcgctacagacctgtgtccaccagcagcagcaccacccccagcagcagcctgagcaccatgagcagcagcctgtatgccagcagccagctgaaccggcccaacagcctggtgggcatcaccagcgcctacagccggggcatcaccaaggaaaatgaaagagaaggagagaagcgggaggaggagaaggagggggaggacaagagccagcccaagagcatccgggagcggcggcggccccgggagaagaggaggagcactggagtgtccttctggacccaggacagtgatgaaaatgagcaggagcagcagagcgacacagaggagggcagcaacaagaaggagacccagacagacagcatcagccgctatgagaccagcagcaccagcgctggggacagatatgacagcctgctgggccgcagcggcagctacagctacctggaggagaggaagccctacagcagccggctggagaaggatgacagcacagacttcaagaagaggcaggagagatttgctgacaggagcctgctggagatggagaagcgggagcggcgggccctggagcggcgcatcagcgagatggaggaggagctgaagatgctgcctgacctgaaggctgacaaccagaggctgaaggatgaaaatggagccctgatccgggtcatcagcaagctgagcaagtag

SEQ ID NO: 166098 - DNA, 3093 bp, Artificial Sequence; identical to SEQ ID NO: 166093
  Description of Artificial Sequence: Synthetic coding sequence

SEQ ID NO: 166099 - DNA, 3093 bp, Artificial Sequence
  Description of Artificial Sequence: Synthetic coding sequence
atgaagatggctgatgccaagcagaagagaaatgagcagctgaagcgctggattggcagcgagacagacctggagccccctgtggtgaagaggcagaagaccaaggtgaagtttgatgatggagctgtgttcctggccgcctgcagcagcggggacacagatgaggtgctgaagctgctgcacagaggagctgacatcaactatgccaacgtggatggcctgacagccctgcaccaggcctgcattgatgacaacgtggacatggtgaagttcctggtggagaatggagccaacatcaaccagcctgacaatgaaggctggatccccctgcacgccgccgccagctgtggctacctggacattgctgagttcctgattggccagggcgcccacgtgggcgctgtgaacagcgagggggacacccccctggacattgctgaggaggaggccatggaggagctgctgcagaatgaggtgaaccggcagggcgtggacatcgaggccgccaggaaggaggaggagcgcatcatgctgagagatgcccggcagtggctgaacagcggccacatcaatgatgtgagacatgccaagagcggcggcacagccctgcacgtggccgccgccaagggctacacagaggtgctgaagctgctgatccaggccggctatgatgtgaacatcaaggactatgatggctggacccccctgcacgccgccgcccactggggcaaggaggaggcctgccgcatcctggtggacaacctgtgtgacatggagatggtgaacaaggtgggccagacagcctttgatgtggctgatgaggacatcctgggctacctggaggagctgcagaagaagcagaacctgctgcacagcgagaagagggacaagaagagccccctcatcgagagcacagccaacatggacaacaaccagagccagaagaccttcaagaacaaggagaccctcatcatcgagcctgagaagaatgccagccgcatcgagagcctggagcaggagaaggtggatgaggaggaggagggcaagaaggatgagagcagctgcagcagtgaagaagatgaggaggatgattctgagagcgaggccgagacagacaagaccaagcccctggcctctgtgaccaatgccaacaccagcagcacccaggccgcccctgtggccgtgaccacccccaccgtgagcagcggccaggccacccccaccagccccatcaagaagttccccaccacagccaccaagatcagccccaaggaggaggagaggaaggatgagagccctgccacctggaggctgggcctgaggaagacaggcagctatggagccctggccgagatcacagccagcaaggagggccagaaggagaaggacacagctggggtgaccaggtctgccagcagcccccggctgagcagcagcctggacaacaaggagaaggagaaggacagcaagggcacccggctggcctacgtggcccccaccatcccccggcggctggccagcaccagtgacatcgaggagaaggaaaatagagacagcagcagcctgcggaccagcagcagctacaccaggaggaagtgggaggatgacctgaagaagaacagctctgtgaatgaaggcagcacctaccacaagagctgcagctttggaagacggcaggatgacctgatcagcagctctgtgcccagcaccaccagcacccccaccgtgaccagcgctgctggcctgcagaagagcctgctgagcagcaccagcaccaccaccaagatcaccaccggcagcagcagcgctggcacccagagcagcaccagcaaccggctgtgggccgaggacagcacagagaaggagaaggacagcgtgcccacagctgtgaccatccctgtggcccccaccgtggtgaatgctgctgccagcaccaccaccctgaccaccaccacagctggcaccgtgagcagcaccacagaggtgcgggagcggcggcgcagctacctgacccctgtgagagatgaggagagcgagagccagaggaaggcccggagccggcaggcccggcagagcagaagaagcacccagggcgtgaccctgacagacctgcaggaggccgagaagaccatcggccgcagccgcagcaccaggacccgggagcaggagaatgaggagaaggagaaggaggagaaggagaagcaggacaaggagaagcaggaggagaagaaggagagcgagaccagcagagaagatgagtacaagcagaagtacagcaggacctatgatgagacctaccagcgctacagacctgtgtccaccagcagcagcaccacccccagcagcagcctgagcaccatgagcagcagcctgtatgccagcagccagctgaaccggcccaacagcctggtgggcatcaccagcgcctacagccggggcatcaccaaggaaaatgaaagagaaggagagaagcgggaggaggagaaggagggggaggacaagagccagcccaagagcatccgggagcggcggcggccccgggagaagaggaggagcactggagtgtccttctggacccaggacagtgatgaaaatgagcaggagcagcagagcgacacagaggagggcagcaacaagaaggagacccaggtgaacaccatcaccctgtatgagaccagcagcaccagcgctggggacagatatgacagcctgctgggccgcagcggcagctacagctacctggaggagaggaagccctacagcagccggctggagaaggatgacagcacagacttcaagaagctgtatgagcagatcctggccgagaatgagaagctgaaggcccagctgcatgacaccaacatggagctgacagacctgaagctgcagctggagaaggccacccagaggcaggagagatttgctgacaggagcctgctggagatggagaagcgggagcggcgggccctggagcggcgcatcagcgagatggaggaggagctgaagatgctgcctgacctgaaggctgacaaccagaggctgaaggatgaaaatggagccctgatccgggtcatcagcaagctgagcaagtag

SEQ ID NO: 166100 - DNA, 2832 bp, Artificial Sequence
  Description of Artificial Sequence: Synthetic coding sequence
atggtgaagttcctggtggagaatggagccaacatcaaccagcctgacaatgaaggctggatccccctgcatgctgctgccagctgtggctacctggacattgctgagttcctgattggccagggcgcccacgtgggcgctgtgaacagcgagggggacacccccctggacattgctgaggaggaggccatggaggagctgctgcagaatgaggtgaaccggcagggcgtggacattgaagctgccaggaaggaggaggagcgcatcatgctgagagatgcccggcagtggctgaacagcggccacatcaatgatgtgagacatgccaagagcggcggcacagccctgcacgtggccgccgccaagggctacacagaggtgctgaagctgctgatccaggccggctatgatgtgaacatcaaggactatgatggctggacccccctgcatgctgctgcccactggggcaaggaggaggcctgccgcatcctggtggacaacctgtgtgacatggagatggtgaacaaggtgggccagacagcctttgatgtggctgatgaggacatcctgggctacctggaggagctgcagaagaagcagaacctgctgcacagcgagaagagggacaagaagagccccctgattgagagcacagccaacatggacaacaaccagagccagaagaccttcaagaacaaggagaccctcatcatcgagcctgagaagaatgccagcagaattgagagcctggagcaggagaaggtggatgaggaggaggagggcaagaaggatgagagcagctgcagcagcgaggaggatgaagaagatgacagcgagagcgaggccgagacagacaagaccaagcccctggcctctgtgaccaatgccaacaccagcagcacccaggccgcccctgtggccgtgaccacccccaccgtgagcagcggccaggccacccccaccagccccatcaagaagttccccaccacagccaccaagatcagccccaaggaggaggagaggaaggatgagagccctgccacctggaggctgggcctgaggaagacaggcagctatggagccctggccgagatcacagccagcaaggagggccagaaggagaaggacacagctggggtgaccaggtctgccagcagcccccggctgagcagcagcctggacaacaaggagaaggagaaggacagcaagggcacccggctggcctacgtggcccccaccatcccccggcggctggccagcaccagtgacatcgaggagaaggagaacagagacagcagcagcctgcggaccagcagcagctacaccaggaggaagtgggaggatgacctgaagaagaacagctctgtgaatgaaggcagcacctaccacaagagctgcagctttggccggcggcaggatgacctgatcagcagctctgtgcccagcaccaccagcacccccaccgtgaccagcgctgctggcctgcagaagagcctgctgagcagcaccagcaccaccaccaagatcaccaccggcagcagcagcgctggcacccagagcagcaccagcaaccggctgtgggccgaggacagcacagagaaggagaaggacagcgtgcccacagctgtgaccatccctgtggcccccaccgtggtgaatgctgctgccagcaccaccaccctgaccaccaccacagctggcaccgtgagcagcaccacagaggtgcgggagaggagaagaagctacctgacccctgtgagagatgaggagagcgagagccagaggaaggcccggagccggcaggcccggcagagccgccgcagcacccagggcgtgaccctgacagacctgcaggaggccgagaagaccatcggccgcagccgcagcaccaggacccgggagcaggagaatgaggagaaggagaaggaggagaaggagaagcaggacaaggagaagcaggaggagaagaaggagagcgagaccagccgggaggatgagtacaagcagaagtacagcaggacctatgatgagacctaccagcgctacagacctgtgtccaccagcagcagcaccacccccagcagcagcctgagcaccatgagcagcagcctgtatgccagcagccagctgaaccggcccaacagcctggtgggcatcaccagcgcctacagccggggcatcaccaaggaaaatgaaagagaaggagagaagcgggaggaggagaaggagggggaggacaagagccagcccaagagcatccgggagaggagaagaccccgggagaagagaagaagcactggagtgtccttctggacccaggacagtgatgaaaatgagcaggagcagcagagcgacacagaggagggcagcaacaagaaggagacccagacagacagcatcagccgctatgagaccagcagcaccagcgctggggacagatatgacagcctgctgggccgcagcggcagctacagctacctggaggagaggaagccctacagcagccggctggagaaggatgacagcacagacttcaagaagctgtatgagcagatcctggctgaaaatgagaagctgaaggcccagctgcatgacaccaacatggagctgacagacctgaagctgcagctggagaaggccacccagaggcaggagagatttgctgacaggagcctgctggagatggagaagcgggagcggcgggccctggagcggcgcatcagcgagatggaggaggagctgaagatgctgcctgacctgaaggctgacaaccagaggctgaaggatgaaaatggagccctgatccgggtcatcagcaagctgagcaagtag

SEQ ID NO: 166101 - DNA, 2925 bp, Artificial Sequence
  Description of Artificial Sequence: Synthetic coding sequence
atgaagatggctgatgccaagcagaagagaaatgagcagctgaagcgctggattggcagcgagacagacctggagccccctgtggtgaagaggcagaagaccaaggtgaagtttgatgatggagctgtgttcctggccgcctgcagcagcggggacacagatgaggtgctgaagctgctgcacagaggagctgacatcaactatgccaacgtggatggcctgacagccctgcaccaggcctgcattgatgacaacgtggacatggtgaagttcctggtggagaatggagccaacatcaaccagcctgacaatgaaggctggatccccctgcacgccgccgccagctgtggctacctggacattgctgagttcctgattggccagggcgcccacgtgggcgctgtgaacagcgagggggacacccccctggacattgctgaggaggaggccatggaggagctgctgcagaatgaggtgaaccggcagggcgtggacatcgaggccgccaggaaggaggaggagcgcatcatgctgagagatgcccggcagtggctgaacagcggccacatcaatgatgtgagacatgccaagagcggcggcacagccctgcacgtggccgccgccaagggctacacagaggtgctgaagctgctgatccaggccggctatgatgtgaacatcaaggactatgatggctggacccccctgcacgccgccgcccactggggcaaggaggaggcctgccgcatcctggtggacaacctgtgtgacatggagatggtgaacaaggtgggccagacagcctttgatgtggctgatgaggacatcctgggctacctggaggagctgcagaagaagcagaacctgctgcacagcgagaagagggacaagaagagccccctcatcgagagcacagccaacatggacaacaaccagagccagaagaccttcaagaacaaggagaccctcatcatcgagcctgagaagaatgccagccgcatcgagagcctggagcaggagaaggtggatgaggaggaggagggcaagaaggatgagagcagctgcagcagtgaagaagatgaggaggatgattctgagagcgaggccgagacagacaagaccaagcccctggcctctgtgaccaatgccaacaccagcagcacccaggccgcccctgtggccgtgaccacccccaccgtgagcagcggccaggccacccccaccagccccatcaagaagttccccaccacagccaccaagatcagccccaaggaggaggagaggaaggatgagagccctgccacctggaggctgggcctgaggaagacaggcagctatggagccctggccgagatcacagccagcaaggagggccagaaggagaaggacacagctggggtgaccaggtctgccagcagcccccggctgagcagcagcctggacaacaaggagaaggagaaggacagcaagggcacccggctggcctacgtggcccccaccatcccccggcggctggccagcaccagtgacatcgaggagaaggaaaatagagacagcagcagcctgcggaccagcagcagctacaccaggaggaagtgggaggatgacctgaagaagaacagctctgtgaatgaaggcagcacctaccacaagagcaccagcaaccggctgtgggccgaggacagcacagagaaggagaaggacagcgtgcccacagctgtgaccatccctgtggcccccaccgtggtgaatgctgctgccagcaccaccaccctgaccaccaccacagctggcaccgtgagcagcaccacagaggtgcgggagcggcggcgcagctacctgacccctgtgagagatgaggagagcgagagccagaggaaggcccggagccggcaggcccggcagagcagaagaagcacccagggcgtgaccctgacagacctgcaggaggccgagaagaccatcggccgcagccgcagcaccaggacccgggagcaggagaatgaggagaaggagaaggaggagaaggagaagcaggacaaggagaagcaggaggagaagaaggagagcgagaccagcagagaagatgagtacaagcagaagtacagcaggacctatgatgagacctaccagcgctacagacctgtgtccaccagcagcagcaccacccccagcagcagcctgagcaccatgagcagcagcctgtatgccagcagccagctgaaccggcccaacagcctggtgggcatcaccagcgcctacagccggggcatcaccaaggaaaatgaaagagaaggagagaagcgggaggaggagaaggagggggaggacaagagccagcccaagagcatccgggagcggcggcggccccgggagaagaggaggagcactggagtgtccttctggacccaggacagtgatgaaaatgagcaggagcagcagagcgacacagaggagggcagcaacaagaaggagacccagacagacagcatcagccgctatgagaccagcagcaccagcgctggggacagatatgacagcctgctgggccgcagcggcagctacagctacctggaggagaggaagccctacagcagccggctggagaaggatgacagcacagacttcaagaagctgtatgagcagatcctggccgagaatgagaagctgaaggcccagctgcatgacaccaacatggagctgacagacctgaagctgcagctggagaaggccacccagaggcaggagagatttgctgacaggagcctgctggagatggagaagcgggagcggcgggccctggagcggcgcatcagcgagatggaggaggagctgaagatgctgcctgacctgaaggctgacaaccagaggctgaaggatgaaaatggagccctgatccgggtcatcagcaagctgagcaagtag

SEQ ID NO: 166102 - DNA, 2949 bp, Artificial Sequence
  Description of Artificial Sequence: Synthetic coding sequence
atggccgagctggagcacctgggcggcaagagagctgagagcgccaggatgagaagagctgagcagctgcggcgctggaggggcagcctgacagagcaggagcctgctgagaggagaggagctggccggcagcccctgacccggcggggcagcccccgggtgcgctttgaagatggagctgtgttcctggccgcctgcagcagcggggacacagatgaggtgaggaagctgctggcccggggagctgacatcaacacagtgaatgtggatggcctgacagccctgcaccaggcctgcattgatgagaacctggacatggtgaagttcctggtggagaacagagccaacgtgaaccagcaggacaatgaaggctggacccccctgcacgccgccgccagctgtggctacctgaacattgctgagtacttcatcaaccacggggcctctgtgggcatcgtgaacagcgagggggaggtgcccagcgacctggccgaggagcccgccatgaaggacctgctgctggagcaggtgaagaagcagggcgtggacctggagcagagcaggaaggaggaggagcagcagatgctgcaggatgcccggcagtggctgaacagcggcaagattgaagatgtgcggcaggcccggagcggggccacagccctgcacgtggccgccgccaagggctacagcgaggtgctgcggctgctgatccaggccggctatgagctgaatgtgcaggactatgatggctggacccccctgcacgccgccgcccactggggcgtgaaggaggcctgcagcatcctggccgaggccctgtgtgacatggacatccggaacaagctgggccagaccccatttgatgtggctgatgagggcctggtggagcacctggagctgctgcagaagaagcagaatgtgctgcggtctgagaaggagaccaggaacaagctgattgaaagtgacctgaacagcaagatccagagcggcttcttcaagaacaaggagaagatgctgtatgaggaggagacccccaagagccaggagatggaggaggagaacaaggagagcagcagcagcagcagcgaggaggaggagggggaggatgaggccagcgagagcgagacagagaaggaggccgacaagaagccagaggcctttgtgaaccacagcaacagcgagagcaagagcagcatcacagagcagatcccagccccagcccagaacaccttcagcgccagcagcgcccggcgcttcagcagcggcctcttcaacaagccagaggagcccaaggatgagagccccagctcctggaggctgggcctgaggaagacaggcagccacaacatgctgtctgaggtggccaacagccgggagcccatccgggaccggggcagcagcatctaccgcagcagcagcagcccccgcatcagcgccctgctggacaacaaggacaaggagcgggagaacaagagctacatcagcagcctggcccccaggaagctgaacagcaccagtgacatcgaggagaaggagaaccgggagagcgctgtgaacctggtgcgcagcggcagctacacccggcagctgtggagagatgaggccaagggaaatgagatcccccagaccatcgcccccagcacctacgtgtccacctacctgaagaggaccccccacaagagccaggccgacaccacagctgagaagacagctgacaacgtgagcagcagcacccccctgtgtgtgatcaccaaccggcccctgcccagcacagccaatggagtgacagccacccctgtgctgagcatcaccggcacagacagctctgtggaggcccgggagaagaggaggagctacctgacccctgtgagagatgaggaggccgagagcctgaggaaggcccggagccggcaggcccggcagaccaggaggagcacccagggcgtgaccctgacagacctgcaggaggccgagaggaccttcagccgcagcagagctgagcggcaggcccaggagcagccccgggagaagcccacagacacagagggcctggagggcagccctgagaagcatgagcccagcgctgtgcctgccacagaagctggggagggccagcagccctggggccgcagcctggatgaggagcccatctgccaccggctgcgctgcccagcccagcctgacaagcccaccaccccagccagccccagcaccagccggcccagcctgtacaccagcagccacctgctgtggaccaaccgcttctctgtgcctgacagcgagagcagcgagaccaccaccaacaccaccacagccaaggagatggacaagaatgaaaatgaggaggccgacctggatgagcagagcagcaagaggctgagcatccgggagaggagaagacccaaggagaggagaagaggcaccggcatcaacttctggaccaaggatgaagatgaaacagatggcagcgaggaggtgaaggagacctgggccgagcggctgaagaggctggagagcggcggcagcaaccccaccaccagtgacagctatggagaccgggccagcgcccgggcccggcgggaggcccgggaggcccggctggccaccctgaccagccgggtggaggaggacagcaacagagactacaagaagctgtatgagagcgccctgacagagaaccagaagctgaagaccaagctgcaggaggcccagctggagctggccgacatcaagagcaagctggagaaggtggcccagcagaagcaggagaagaccagtgacaggagctctgtgctggagatggagaagcgggagcggcgggccctggagaggaagatgtctgagatggaggaggagatgaaggtgctgacagagctgaagagtgacaaccagaggctgaaggatgaaaatggagccctgatccgggtcatcagcaagctgagcaagtag

SEQ ID NO: 166103 - DNA, 1161 bp, Artificial Sequence
  Description of Artificial Sequence: Synthetic coding sequence
atggccgagctggagcacctgggcggcaagagagctgagagcgccaggatgagaagagctgagcagctgcggcgctggaggggcagcctgacagagcaggagcctgctgagaggagaggagctggccggcagcccctgacccggcggggcagcccccgggtgcgctttgaagatggagctgtgttcctggccgcctgcagcagcggggacacagatgaggtgaggaagctgctggcccggggagctgacatcaacacagtgaatgtggatggcctgacagccctgcaccaggcctgcattgatgagaacctggacatggtgaagttcctggtggagaacagagccaacgtgaaccagcaggacaatgaaggctggacccccctgcacgccgccgccagctgtggctacctgaacattgctgagtacttcatcaaccacggggcctctgtgggcatcgtgaacagcgagggggaggtgcccagcgacctggccgaggagcccgccatgaaggacctgctgctggagcaggtgaagaagcagggcgtggacctggagcagagcaggaaggaggaggagcagcagatgctgcaggatgcccggcagtggctgaacagcggcaagattgaagatgtgcggcaggcccggagcggggccacagccctgcacgtggccgccgccaagggctacagcgaggtgctgcggctgctgatccaggccggctatgagctgaatgtgcaggactatgatggctggacccccctgcacgccgccgcccactggggcgtgaaggaggcctgcagcatcctggccgaggccctgtgtgacatggacatccggaacaagctgggccagaccccatttgatgtggctgatgagggcctggtggagcacctggagctgctgcagaagaagcagaatgtgctgcggtctgagaaggagaccaggaacaagctgattgaaagtgacctgaacagcaagatccagagcggcttcttcaagaacaaggagaagatgctgtatgaggaggagacccccaagagccaggagatggaggaggagaacaaggagagcagcagcagcagcagcgaggaggaggagggggaggatgaggccagcgagagcgagacagagaaggaggccgtgctcttctggcccttctag

SEQ ID NO: 166104 - DNA, 675 bp, Artificial Sequence
  Description of Artificial Sequence: Synthetic coding sequence
atggacaagaatgaaaatgaggaggccgacctggatgagcagagcagcaagaggctgagcatccgggagaggagaagacccaaggagaggagaagaggcaccggcatcaacttctggaccaaggatgaagatgaaacagatggcagcgaggaggtgaaggagacctggcatgagcggctgagccggctggagagcggcggcagcaaccccaccaccagtgacagctatggagaccgggccagcgcccgggcccggcgggaggcccgggaggcccggctggccaccctgaccagccgggtggaggaggacagcaacagagactacaagaagctgtatgagagcgccctgacagagaaccagaagctgaagaccaagctgcaggaggcccagctggagctggccgacatcaagagcaagctggagaaggtggcccagcagaagcaggagaagaccagtgacaggagctctgtgctggagatggagaagcgggagcggcgggccctggagaggaagatgtctgagatggaggaggagatgaagaacctgcaccagctgaagcagatccagaccctgaagcagatgaatgagcagctgcaggctgaaaatagagccctgaccagggtggtggcccggctgtctgagagcattgagagcagtgacacccaggagctgtag

SEQ ID NO: 166105 - DNA, 627 bp, Artificial Sequence
  Description of Artificial Sequence: Synthetic coding sequence
atggacaagaatgaaaatgaggaggccgacctggatgagcagagcagcaagaggctgagcatccgggagaggagaagacccaaggagaggagaagaggcaccggcatcaacttctggaccaaggatgaagatgaaacagatggcagcgaggaggtgaaggagacctggcatgagcggctgagccggctggagagcggcggcagcaaccccaccaccagtgacagctatggagaccgggccagcgcccgggcccggcgggaggcccgggaggcccggctggccaccctgaccagccgggtggaggaggacagcaacagagactacaagaagctgtatgagagcgccctgacagagaaccagaagctgaagaccaagctgcaggaggcccagctggagctggccgacatcaagagcaagctggagaaggtggcccagcagaagcaggagaagaccagtgacaggagctctgtgctggagatggagaagcgggagcggcgggccctggagaggaagatgtctgagatggaggaggagatgaaggtgctgacagagctgaagagtgacaaccagaggctgaaggatgaaaatggagccctgatccgggtcatcagcaagctgagcaagtag

SEQ ID NO: 166106 - DNA, 2949 bp, Artificial Sequence
  Description of Artificial Sequence: Synthetic coding sequence
atggccgagctggagcacctgggcggcaagagagctgagagcgccaggatgagaagagctgagcagctgcggcgctggaggggcagcctgacagagcaggagcctgctgagaggagaggagctggccggcagcccctgacccggcggggcagcccccgggtgcgctttgaagatggagctgtgttcctggccgcctgcagcagcggggacacagatgaggtgaggaagctgctggcccggggagctgacatcaacacagtgaatgtggatggcctgacagccctgcaccaggcctgcattgatgagaacctggacatggtgaagttcctggtggagaacagagccaacgtgaaccagcaggacaatgaaggctggacccccctgcacgccgccgccagctgtggctacctgaacattgctgagtacttcatcaaccacggggcctctgtgggcatcgtgaacagcgagggggaggtgcccagcgacctggccgaggagcccgccatgaaggacctgctgctggagcaggtgaagaagcagggcgtggacctggagcagagcaggaaggaggaggagcagcagatgctgcaggatgcccggcagtggctgaacagcggcaagattgaagatgtgcggcaggcccggagcggggccacagccctgcacgtggccgccgccaagggctacagcgaggtgctgcggctgctgatccaggccggctatgagctgaatgtgcaggactatgatggctggacccccctgcacgccgccgcccactggggcgtgaaggaggcctgcagcatcctggccgaggccctgtgtgacatggacatccggaacaagctgggccagaccccatttgatgtggctgatgagggcctggtggagcacctggagctgctgcagaagaagcagaatgtgctgcggtctgagaaggagaccaggaacaagctgattgaaagtgacctgaacagcaagatccagagcggcttcttcaagaacaaggagaagatgctgtatgaggaggagacccccaagagccaggagatggaggaggagaacaaggagagcagcagcagcagcagcgaggaggaggagggggaggatgaggccagcgagagcgagacagagaaggaggccgacaagaagccagaggcctttgtgaaccacagcaacagcgagagcaagagcagcatcacagagcagatcccagccccagcccagaacaccttcagcgccagcagcgcccggcgcttcagcagcggcctcttcaacaagccagaggagcccaaggatgagagccccagctcctggaggctgggcctgaggaagacaggcagccacaacatgctgtctgaggtggccaacagccgggagcccatccgggaccggggcagcagcatctaccgcagcagcagcagcccccgcatcagcgccctgctggacaacaaggacaaggagcgggagaacaagagctacatcagcagcctggcccccaggaagctgaacagcaccagtgacatcgaggagaaggagaaccgggagagcgctgtgaacctggtgcgcagcggcagctacacccggcagctgtggagagatgaggccaagggaaatgagatcccccagaccatcgcccccagcacctacgtgtccacctacctgaagaggaccccccacaagagccaggccgacaccacagctgagaagacagctgacaacgtgagcagcagcacccccctgtgtgtgatcaccaaccggcccctgcccagcacagccaatggagtgacagccacccctgtgctgagcatcaccggcacagacagctctgtggaggcccgggagaagaggaggagctacctgacccctgtgagagatgaggaggccgagagcctgaggaaggcccggagccggcaggcccggcagaccaggaggagcacccagggcgtgaccctgacagacctgcaggaggccgagaggaccttcagccgcagcagagctgagcggcaggcccaggagcagccccgggagaagcccacagacacagagggcctggagggcagccctgagaagcatgagcccagcgctgtgcctgccacagaagctggggagggccagcagccctggggccgcagcctggatgaggagcccatctgccaccggctgcgctgcccagcccagcctgacaagcccaccaccccagccagccccagcaccagccggcccagcctgtacaccagcagccacctgctgtggaccaaccgcttctctgtgcctgacagcgagagcagcgagaccaccaccaacaccaccacagccaaggagatggacaagaatgaaaatgaggaggccgacctggatgagcagagcagcaagaggctgagcatccgggagaggagaagacccaaggagaggagaagaggcaccggcatcaacttctggaccaaggatgaagatgaaacagatggcagcgaggaggtgaaggagacctggcatgagcggctgagccggctggagagcggcggcagcaaccccaccaccagtgacagctatggagaccgggccagcgcccgggcccggcgggaggcccgggaggcccggctggccaccctgaccagccgggtggaggaggacagcaacagagactacaagaagctgtatgagagcgccctgacagagaaccagaagctgaagaccaagctgcaggaggcccagctggagctggccgacatcaagagcaagctggagaaggtggcccagcagaagcaggagaagaccagtgacaggagctctgtgctggagatggagaagcgggagcggcgggccctggagaggaagatgtctgagatggaggaggagatgaaggtgctgacagagctgaagagtgacaaccagaggctgaaggatgaaaatggagccctgatccgggtcatcagcaagctgagcaagtag

SEQ ID NO: 166107 - DNA, 2349 bp, Artificial Sequence
  Description of Artificial Sequence: Synthetic coding sequence
atgtctggagaagatggccctgctgctggccctggagctgctgctgctgctgcccgggagcggcggcgggagcagctgcggcagtggggcgcccgggccggggctgagcccggccctggagagcggcgggccaggacagtgcgctttgaaagagctgctgagttcctggccgcctgtgccggcggggacctggatgaggcccggctgatgctgcgggctgctgaccccggccctggagctgagctggaccctgctgcccctcctccagcccgggctgtgctggacagcaccaatgctgatggcatcagcgccctgcaccaggcctgcattgatgagaacctggaggtggtgcgcttcctggtggagcagggcgccaccgtgaaccaggccgacaatgaaggctggacccccctgcacgtggccgccagctgtggctacctggacatcgcccgctacctgctgagccacggggccaacattgctgctgtgaacagtgatggagacctgcccctggacctggccgagagtgatgccatggagggcctgctgaaggccgagatcgccaggagaggagtggatgtggaggccgccaagagagctgaggaggagctgctgctgcatgacacccgctgctggctgaatggaggagccatgcctgaggcccggcaccccaggactggagccagcgccctgcacgtggccgccgccaagggctacatcgaggtgatgaggctgctgctgcaggccggctatgaccctgagctgagagatggagatggctggacccccctgcacgccgccgcccactggggcgtggaggatgcctgccgcctgctggccgagcacggcggcggcatggacagcctgacccacgccggccagaggccctgtgacctggctgatgaggaggtgctgagcctgctggaggagctggccaggaagcaggaggacctgaggaaccagaaggaggccagccagagccggggccaggagccccaggcccccagcagcagcaagcacagaagaagctctgtgtgccgcctgagcagccgggagaagatcagcctgcaggacctgagcaaggagaggaggcctggaggagctgggggcccccccatccaggatgaagatgaaggagaggagggccccacagagcccccacctgctgagcccaggaccctgaatggagtgagcagccccccccaccccagccccaagagccctgtgcagctggaggaggcccccttcagccgccgcttcggcctgctgaagacaggcagcagcggggccctgggccccccagagaggagaacagctgagggcgcccctggagctggcctgcagaggtctgccagcagctcctggctggagggcaccagcacccaggccaaggagctgcggctggcccgcatcacccccacccccagccccaagctgcctgagcccagcgtgctgtctgaggtgaccaagcccccaccctgcctggagaacagcagcccccccagccgcatccctgagcctgagagccctgccaagcccaacgtgcccacagccagcacagcccccccagctgacagccgggacagaagaagaagctaccagatgcctgtgagagatgaggagagcgagagccagaggaaggcccggagccggctgatgaggcagagcagaagaagcacccagggcgtgaccctgacagacctgaaggaggccgagaaggctgctgggaaggcccctgagagcgagaagccagcccagagcctggaccccagccggcggccccgggtgcctggggtggagaacagcgacagccctgcccagagagctgaggccccagatggccagggccctggcccccaggccgcccgggagcacaggaaggtgggcaaggagtggaggggccctgctgagggggaggaggccgagcctgctgacaggagccaggagagcagcaccctggagggcggccccagcgcccggcggcagcgctggcagagggacctgaaccctgagcctgagcctgagagcgaggagccagatggcggcttccgcaccctgtatgcagagctgcggagagaaaatgaaaggctgcgggaggccctgacagagaccaccctgcggctggcccagctgaaggtggagctggagcgggccacccagaggcaggagagatttgctgagaggcctgccctgctggagctggagagatttgaaagaagagccctggagaggaaggctgctgagctggaggaggagctgaaggccctgagtgacctgcgggctgacaaccagaggctgaaggatgaaaatgctgccctgatccgggtcatcagcaagctgagcaagtag

SEQ ID NO: 166108 - DNA, 2160 bp, Artificial Sequence
  Description of Artificial Sequence: Synthetic coding sequence
atgtctggagaagatggccctgctgctggccctggagctgctgctgctgctgcccgggagcggcggcgggagcagctgcggcagtggggcgcccgggccggggctgagcccggccctggagagcggcgggccaggacagtgcgctttgaaagagctgctgagttcctggccgcctgtgccggcggggacctggatgaggcccggctgatgctgcgggctgctgaccccggccctggagctgagctggaccctgctgcccctcctccagcccgggctgtgctggacagcaccaatgctgatggcatcagcgccctgcaccaggcctgcattgatgagaacctggaggtggtgcgcttcctggtggagcagggcgccaccgtgaaccaggccgacaatgaaggctggacccccctgcacgtggccgccagctgtggctacctggacatcgcccgctacctgctgagccacggggccaacattgctgctgtgaacagtgatggagacctgcccctggacctggccgagagtgatgccatggagggcctgctgaaggccgagatcgccaggagaggagtggatgtggaggccgccaagagagctgaggaggagctgctgctgcatgacacccgctgctggctgaatggaggagccatgcctgaggcccggcaccccaggactggagccagcgccctgcacgtggccgccgccaagggctacatcgaggtgatgaggctgctgctgcaggccggctatgaccctgagctgagagatggagatggctggacccccctgcacgccgccgcccactggggcgtggaggatgcctgccgcctgctggccgagcacggcggcggcatggacagcctgacccacgccggccagaggccctgtgacctggctgatgaggaggtgctgagcctgctggaggagctggccaggaagcaggaggacctgaggaaccagaaggaggccagccagagccggggccaggagccccaggcccccagcagcagcaagcacagaagaagctctgtgtgccgcctgagcagccgggagaagatcagcctgcaggacctgagcaaggagaggaggcctggaggagctgggggcccccccatccaggatgaagatgaaggagaggagggccccacagagcccccacctgctgagcccaggaccctgaatggagtgagcagccccccccaccccagccccaagagccctgtgcagctggaggaggcccccttcagccgccgcttcggcctgctgaagacaggcagcagcggggccctgggccccccagagaggagaacagctgagggcgcccctggagctggcctgcagaggtctgccagcagctcctggctggagggcaccagcacccaggccaaggagctgcggctggcccgcatcacccccacccccagccccaagctgcctgagcccagcgtgctgtctgaggtgaccaagcccccaccctgcctggagaacagcagcccccccagccgcatccctgagcctgagagccctgccaagcccaacgtgcccacagccagcacagcccccccagctgacagccgggacagaagaagaagctaccagatgcctgtgagagatgaggagagcgagagccagaggaaggcccggagccggctgatgaggcagagcagaagaagcacccagggcgtgaccctgacagacctgaaggaggccgagaaggccggggaggaggccgagcctgctgacaggagccaggagagcagcaccctggagggcggccccagcgcccggcggcagcgctggcagagggacctgaaccctgagcctgagcctgagagcgaggagccagatggcggcttccgcaccctgtatgcagagctgcggcgggagaatgaaaggctgcgggaggccctgacagagaccaccctgcggctggcccagctgaaggtggagctggagcgggccacccagaggcaggagagatttgctgagaggcctgccctgctggagctggagagatttgagcggcgggccctggagaggaaggctgctgagctggaggaggagctgaaggccctgagtgacctgcgggctgacaaccagaggctgaaggatgaaaatgctgccctgatccgggtcatcagcaagctgagcaagtag

SEQ ID NO: 166109 - DNA, 2124 bp, Artificial Sequence
  Description of Artificial Sequence: Synthetic coding sequence
atgagaaatggaggcccctgccagcccctggccgccggccccagggctgagggcgcctctgtgaactggagcgtgacagcctggggccctggcacccaggcctgcattgatgagaacctggaggtggtgcgcttcctggtggagcagggcgccaccgtgaaccaggccgacaatgaaggctggacccccctgcacgtggccgccagctgtggctacctggacatcgcccgctacctgctgagccacggggccaacattgctgctgtgaacagtgatggagacctgcccctggacctggccgagagtgatgccatggagggcctgctgaaggccgagatcgccaggagaggagtggatgtggaggccgccaagagagctgaggaggagctgctgctgcatgacacccgctgctggctgaatggaggagccatgcctgaggcccggcaccccaggactggagccagcgccctgcacgtggccgccgccaagggctacatcgaggtgatgaggctgctgctgcaggccggctatgaccctgagctgagagatggagatggctggacccccctgcacgccgccgcccactggggcgtggaggatgcctgccgcctgctggccgagcacggcggcggcatggacagcctgacccacgccggccagaggccctgtgacctggctgatgaggaggtgctgagcctgctggaggagctggccaggaagcaggaggacctgaggaaccagaaggaggccagccagagccggggccaggagccccaggcccccagcagcagcaagcacagaagaagctctgtgtgccgcctgagcagccgggagaagatcagcctgcaggacctgagcaaggagaggaggcctggaggagctgggggcccccccatccaggatgaagatgaaggagaggagggccccacagagcccccacctgctgagcccaggaccctgaatggagtgagcagccccccccaccccagccccaagagccctgtgcagctggaggaggcccccttcagccgccgcttcggcctgctgaagacaggcagcagcggggccctgggccccccagagaggagaacagctgagggcgcccctggagctggcctgcagaggtctgccagcagctcctggctggagggcaccagcacccaggccaaggagctgcggctggcccgcatcacccccacccccagccccaagctgcctgagcccagcgtgctgtctgaggtgaccaagcccccaccctgcctggagaacagcagcccccccagccgcatccctgagcctgagagccctgccaagcccaacgtgcccacagccagcacagcccccccagctgacagccgggacagaagaagaagctaccagatgcctgtgagagatgaggagagcgagagccagaggaaggcccggagccggctgatgaggcagagcagaagaagcacccagggcgtgaccctgacagacctgaaggaggccgagaaggctgctgggaaggcccctgagagcgagaagccagcccagagcctggaccccagccggcggccccgggtgcctggggtggagaacagcgacagccctgcccagcgggaggccccagatggccagggccctggcccccaggccgcccgggagcacaggaaggtgggcaaggagtggaggggccctgctgagggggaggaggccgagcctgctgacaggagccaggagagcagcaccctggagggcggccccagcgcccggcggcagcgctggcagagggacctgaaccctgagcctgagcctgagagcgaggagccagatggcggcttccgcaccctgtatgcagagctgcggcgggagaatgaaaggctgcgggaggccctgacagagaccaccctgcggctggcccagctgaaggtggagctggagcgggccacccagaggcaggagagatttgctgagaggcctgccctgctggagctggagagatttgagcggcgggccctggagaggaaggctgctgagctggaggaggagctgaaggccctgagtgacctgcgggctgacaaccagaggctgaaggatgaaaatgctgccctgatccgggtcatcagcaagctgagcaagtag

SEQ ID NO: 166110 - DNA, 2142 bp, Artificial Sequence
  Description of Artificial Sequence: Synthetic coding sequence
atggagcccggcactggaggcagcaggaagaggctgggcccccgggccggcttccgcttctggccacccttcttccccaggaggagccaggccggcagcagcaagttccccacccccctgggcccagaaaattctggcaaccccaccctgctgagcagcgcccagcctgagaccagggtgtcctactggaccaagctgctgagccagctgctggcccccctgcccggcctgctgcagaaggtgctgatctggagccagctgtttggaggcatgttccccacccgctggctggactttgctggggtgtacagcgccctgcgggccctgaagggccgggagaagccagctgcccccacagcccagaagagcctgagcagcctgcagctggacagcagtgaccccagcgtgaccagccccctggactggctggaggagggcatccactggcagtacagccccccagacctgaagctggagctgaaggccaagggcagcgccctggaccctgctgcccaggccttcctgctggagcagcagctgtggggcgtggagctgctgcccagcagcctgcagagccggctgtacagcaaccgggagctgggcagcagccccagcggccccctgaacatccagagaattgacaacttctctgtggtgtcctacctgctgaaccccagctacctggactgcttcccccggctggaggtgtcctaccagaacagtgatggcaacagcgaggtggtgggcttccagaccctgaccccagagagcagctgcctgcgggaggaccactgccacccccagcccctgtctgctgagctgatcccagcctcctggcagggctgcccccccctgagcacagagggcctgcctgagatccaccacctgaggatgaagaggctggagttcctgcagcaggccaacaagggccaggacctgcccaccccagaccaggacaatggctaccacagcctggaggaggagcacagcctgctgaggatggaccccaagcactgccgggacaaccccacccagtttgtgcctgctgctggggacatccctggcaacacccaggagagcacagaggagaagattgagctgctgaccacagaggtgcccctggccctggaggaggagagccccagcgagggctgccccagcagcgagatccccatggagaaggagcccggggagggccgcatctctgtggtggactacagctacctggagggggacctgcccatcagcgcccggcctgcctgcagcaacaagctgattgactacatcctgggcggggccagcagtgacctggagaccagcagtgaccctgagggggaggactgggatgaggaggctgaagatgatggctttgacagcgacagcagcctgagtgacagcgacctggagcaggaccctgagggcctgcacctgtggaacagcttctgcagcgtggacccctacaacccccagaacttcaccgccaccatccagacagctgcccgcatcgtgcctgaggagcccagcgacagcgagaaggacctgagcggcaagagtgacctggagaacagcagccagagcggcagcctgcctgagaccccagagcacagcagtggagaggaggatgactgggagagcagcgcagatgaggccgagagcctgaagctgtggaacagcttctgcaacagtgatgacccctacaaccccctgaacttcaaggcccccttccagaccagcggggagaatgagaagggctgccgggacagcaagacccccagcgagagcatcgtggccatcagcgagtgccacaccctgctgagctgcaaggtgcagctgctgggcagccaggagagcgagtgcccagacagcgtgcagagagatgtgctgagcggcggccgccacacccacgtgaagaggaagaaggtgaccttcctggaggaggtgacagagtactacatctctggagatgaggacaggaagggcccctgggaggagtttgccagagatggctgccgcttccagaagaggatccaggagacagaagatgccatcggctactgcctgacctttgagcaccgggagaggatgttcaaccggctgcagggcacctgcttcaagggcctgaatgtgctgaagcagtgctag

SEQ ID NO: 166111 - DNA, 1872 bp, Artificial Sequence
  Description of Artificial Sequence: Synthetic coding sequence
atgttccccacccgctggctggactttgctggggtgtacagcgccctgcgggccctgaagggccgggagaagccagctgcccccacagcccagaagagcctgagcagcctgcagctggacagcagtgaccccagcgtgaccagccccctggactggctggaggagggcatccactggcagtacagccccccagacctgaagctggagctgaaggccaagggcagcgccctggaccctgctgcccaggccttcctgctggagcagcagctgtggggcgtggagctgctgcccagcagcctgcagagccggctgtacagcaaccgggagctgggcagcagccccagcggccccctgaacatccagagaattgacaacttctctgtggtgtcctacctgctgaaccccagctacctggactgcttcccccggctggaggtgtcctaccagaacagtgatggcaacagcgaggtggtgggcttccagaccctgaccccagagagcagctgcctgcgggaggaccactgccacccccagcccctgtctgctgagctgatcccagcctcctggcagggctgcccccccctgagcacagagggcctgcctgagatccaccacctgaggatgaagaggctggagttcctgcagcaggccaacaagggccaggacctgcccaccccagaccaggacaatggctaccacagcctggaggaggagcacagcctgctgaggatggaccccaagcactgccgggacaaccccacccagtttgtgcctgctgctggggacatccctggcaacacccaggagagcacagaggagaagattgagctgctgaccacagaggtgcccctggccctggaggaggagagccccagcgagggctgccccagcagcgagatccccatggagaaggagcccggggagggccgcatctctgtggtggactacagctacctggagggggacctgcccatcagcgcccggcctgcctgcagcaacaagctgattgactacatcctgggcggggccagcagtgacctggagaccagcagtgaccctgagggggaggactgggatgaggaggctgaagatgatggctttgacagcgacagcagcctgagtgacagcgacctggagcaggaccctgagggcctgcacctgtggaacagcttctgcagcgtggacccctacaacccccagaacttcaccgccaccatccagacagctgcccgcatcgtgcctgaggagcccagcgacagcgagaaggacctgagcggcaagagtgacctggagaacagcagccagagcggcagcctgcctgagaccccagagcacagcagtggagaggaggatgactgggagagcagcgcagatgaggccgagagcctgaagctgtggaacagcttctgcaacagtgatgacccctacaaccccctgaacttcaaggcccccttccagaccagcggggagaatgagaagggctgccgggacagcaagacccccagcgagagcatcgtggccatcagcgagtgccacaccctgctgagctgcaaggtgcagctgctgggcagccaggagagcgagtgcccagacagcgtgcagagagatgtgctgagcggcggccgccacacccacgtgaagaggaagaaggtgaccttcctggaggaggtgacagagtactacatctctggagatgaggacaggaagggcccctgggaggagtttgccagagatggctgccgcttccagaagaggatccaggagacagaagatgccatcggctactgcctgacctttgagcaccgggagaggatgttcaaccggctgcagggcacctgcttcaagggcctgaatgtgctgaagcagtgctag

SEQ ID NO: 166112 - DNA, 1704 bp, Artificial Sequence
  Description of Artificial Sequence: Synthetic coding sequence
atggccagccacgtggacctgctgacagagctgcagctgctggagaaggtgcccaccctggagcggctgcgggccgcccagaagagaagagcccagcagctgaagaagtgggcccagtatgagcaggacctgcagcacaggaagaggaagcatgagaggaagaggagcactggaggccgcaggaagaaggtgtcctttgaggcctctgtggccctgctggaggccagcctgagaaatgatgctgaggaggtgcgctacttcctgaagaacaaggtgtccccagacctgtgcaatgaagatggcctgacagccctgcaccagtgctgcatcgacaactttgaggagatcgtgaagctgctgctgagccatggagccaacgtgaatgccaaggacaatgagctgtggacccccctgcacgccgccgccacctgtggccacatcaacctggtgaagatcctggtgcagtacggggctgacctgctggccgtgaacagtgatggcaacatgccctatgacctgtgtgaagatgagcccaccctggatgtgattgagacctgcatggcctaccagggcatcacccaggagaagatcaatgagatgagggtggcccctgagcagcagatgattgctgacatccactgcatgattgctgctggccaggacctggactggattgatgcccagggcgccaccctgctgcacatcgccggggccaacggctacctgcgggctgctgagctgctgctggaccatggagtgcgggtggatgtgaaggactgggatggctgggagcccctgcacgccgccgccttctggggccagatgcagatggccgagctgctggtgagccacggggccagcctgagcgcccggacctccatggatgagatgcccatcgacctgtgtgaggaggaggagttcaaggtgctgctgctggagctgaagcacaagcatgatgtgatcatgaagagccagctgcggcacaagagcagcctgagcaggaggaccagcagcgctggcagccggggcaaggtggtgagaagagccagcctgagtgacaggaccaacctgtacaggaaggagtatgaaggagaggccatcctgtggcagaggtctgctgctgaggaccagaggaccagcacctacaatggagacatccgggagaccaggacagaccaggagaacaaggaccccaacccccggctggagaagcctgtgctgctgtctgagttccccaccaagatccccagaggagagctggacatgcctgtggagaatggcctgcgggcccctgtgtctgcctaccagtatgccctggccaatggagatgtgtggaaggtgcatgaggtgcctgactacagcatggcctacggcaaccctggggtggctgatgccaccccaccctggagcagctacaaggagcagagcccccagaccctgctggagctgaagaggcagagagctgctgccaagctgctgagccaccccttcctgagcacccacctgggcagctccatggccaggactggagagagcagcagcgagggcaaggcccccctgattggaggccgcaccagcccctacagcagcaatggcacctctgtgtactacacagtgaccagcggggacccccccctgctgaagttcaaggcccccatcgaggagatggaggagaaggtgcacggctgctgccgcatctcctag

SEQ ID NO: 166113 - DNA, 1578 bp, Artificial Sequence
  Description of Artificial Sequence: Synthetic coding sequence
atggccagccacgtggacctgctgacagagctgcagctgctggagaaggtgcccaccctggagcggctgcgggccgcccagaagagaagagcccagcagctgaagaagtgggcccagtatgagcaggacctgcagcacaggaagaggaagcatgagaggaagaggagcactggaggccgcaggaagaaggtgtcctttgaggcctctgtggccctgctggaggccagcctgagaaatgatgctgaggaggtgcgctacttcctgaagaacaaggtgtccccagacctgtgcaatgaagatggcctgacagccctgcaccagtgctgcatcgacaactttgaggagatcgtgaagctgctgctgagccatggagccaacgtgaatgccaaggacaatgagctgtggacccccctgcacgccgccgccacctgtggccacatcaacctggtgaagatcctggtgcagtacggggctgacctgctggccgtgaacagtgatggcaacatgccctatgacctgtgtgaagatgagcccaccctggatgtgattgagacctgcatggcctaccagggcatcacccaggagaagatcaatgagatgagggtggcccctgagcagcagatgattgctgacatccactgcatgattgctgctggccaggacctggactggattgatgcccagggcgccaccctgatgcagatggccgagctgctggtgagccacggggccagcctgagcgcccggacctccatggatgagatgcccatcgacctgtgtgaggaggaggagttcaaggtgctgctgctggagctgaagcacaagcatgatgtgatcatgaagagccagctgcggcacaagagcagcctgagcaggaggaccagcagcgctggcagccggggcaaggtggtgagaagagccagcctgagtgacaggaccaacctgtacaggaaggagtatgaaggagaggccatcctgtggcagaggtctgctgctgaggaccagaggaccagcacctacaatggagacatccgggagaccaggacagaccaggagaacaaggaccccaacccccggctggagaagcctgtgctgctgtctgagttccccaccaagatccccagaggagagctggacatgcctgtggagaatggcctgcgggcccctgtgtctgcctaccagtatgccctggccaatggagatgtgtggaaggtgcatgaggtgcctgactacagcatggcctacggcaaccctggggtggctgatgccaccccaccctggagcagctacaaggagcagagcccccagaccctgctggagctgaagaggcagagagctgctgccaagctgctgagccaccccttcctgagcacccacctgggcagctccatggccaggactggagagagcagcagcgagggcaaggcccccctgattggaggccgcaccagcccctacagcagcaatggcacctctgtgtactacacagtgaccagcggggacccccccctgctgaagttcaaggcccccatcgaggagatggaggagaaggtgcacggctgctgccgcatctcctag

SEQ ID NO: 166114 - DNA, 3369 bp, Artificial Sequence
  Description of Artificial Sequence: Synthetic coding sequence
atggagcccagcgaggtgcccagccagatcagcaaggacaacttcctggaggtgcccaacctgagtgacagcctgtgtgaagatgaggaggtgaccttccagcccggcttcagcccccagcccagcagaagaggaagtgacagcagcgaggacatctacctggacacccccagcagcggcacccggcgggtgtcctttgctgacagctttggcttcaacctggtgtctgtgaaggagtttgactgctgggagctgcccagcgccagcaccacctttgacctgggcacagacatcttccacacagaggagtatgtgctggcccccctgtttgacctgcccagcagcaaagaagacctgatgcagcagctgcagatccagaaggccatcctggagagcacagagagcctgctgggcagcaccagcatcaagggcatcatccgggtgctgaatgtgtcctttgagaagctggtgtatgtgaggatgagcctggatgactggcagacccactatgacatcctggccgagtatgtgcccaacagctgtgatggagaaacagaccagttctccttcaagatcgtgctggtgcccccctaccagaaggatggcagcaaggtggagttctgcatccgctatgagacctctgtgggcaccttctggagcaacaacaacggcaccaactacaccttcatctgccagaagaaggagcaggagcctgagcctgtgaagccctggaaggaggtgcccaaccggcagatcaagggctgcctgaaggtgaagagcagcaaggaggagagctctgtgaccagcgaggagaacaactttgagaaccccaagaacacagacacctacatccccaccatcatctgcagccatgaggacaaggaggacctggaggccagcaacagaaatgtgaaggatgtgaaccgggagcatgatgagcacaatgagaaggagctggagctgatgatcaaccagcacctgatccgcaccaggagcacagccagcagagatgaaagaaacaccttcagcacagatcctgtgaacttccccaacaaggccgagggcctggagaagaagcagatccacggggagatctgcacagacctcttccagaggagcctgagccccagcagcagcgctgagagctctgtgaagggggacttctactgcaatgagaagtacagcagtggagatgactgcacccaccagcccagcgaggagaccaccagcaacatgggagagatcaagcccagcctgggggacaccagcagtgatgagctggtgcagctgcacacaggcagcaaggaggtgctggatgacaatgccaacccagcccacggcaatggcaccgtgcagatcccctgccccagcagtgaccagctgatggccggcaacctgaacaagaagcatgagggcggggccaagaacatcgaggtgaaggacctgggctgcctgcggcgggacttccacagcgacaccagcgcctgcctgaaggagagcacagaggagggcagcagcaaggaggactactatggaaatggcaaggatgatgaggagcagaggatctacctgggcgtgaatgagaagcagaggaagaacttccagaccatcctgcatgaccaggagaggaagatgggcaaccccaagatctctgtggccggcattggagccagcaacagagacctggccaccctgctgtctgagcacacagccatccccacccgggccatcacagcagatgtgagccacagccccaggaccaacctgtcctgggaggaggccgtgctgaccccagagcaccaccacctgaccagcgagggcagcgccctgggcggcatcaccggccaggtgtgcagcagcaggactggaaatgtgctgagaaatgactacctgttccaggtggaggagaagagcggcggcatcaacagcgaggaccaggacaacagcccccagcacaagcagagctggaatgtgctggagagccagggcaagagccgggagaacaagaccaacatcacagagcacatcaagggccagacagactgtgaagatgtgtggggcaagagggacaacaccaggagcctgaaggccaccacagaggagctgttcacctgccaggagaccgtgtgctgtgagctgagcagcctggccgaccacggcatcacagagaaggccgaggccggcacagcctacatcatcaagaccaccagcgagagcaccccagagagcatgtctgcccgggagaaggccatcatcgccaagctgccccaggagacagcccggagtgaccggcccatcgaggtgaaggagacagcctttgacccccatgagggcagaaatgatgacagccactacaccctgtgccagagggacacagtgggcgtcatctatgacaatgactttgagaaggagagccggctgggcatctgcaatgtgcgggtggatgagatggagaaggaggagaccatgtccatgtacaaccccaggaagacccatgaccgggagaagtgtggcactggaaacatcacctctgtggaggagagctcctgggtgatcacagagtaccagaaggccaccagcaagctggacctgcagctgggcatgctgcccacagacaagacagtgttttctgagaacagagacctgcggcaggtgcaggagctgagcaagaagacagacagtgatgccatcgtgcacagcgccttcaacagcgacaccaacagagccccccagaacagcagccccttcagcaagcaccacacagagatctctgtgtccaccaatgagcaggccatcgctgtggagaatgctgtgaccaccatggccagccagcccatcagcaccaagtctgagaacatctgcaacagcacccgggagatccagggcatcgagaagcacccctacccagagagcaagccagaggaggtgagccgcagcagcggcatcgtgaccagcggcagcaggaaggagcgctgcatcggccagatcttccagacagaggagtacagcgtggagaagagcctgggccccatgatcctgatcaacaagcccctggagaacatggaggaggcccggcatgaaaatgaaggcctggtgagcagcggccagagcctgtacaccagcggggagaaggagagtgacagcagcgccagcaccagcctgcctgtggaggagagccaggcccagggcaatgaaagcctcttcagcaagtacaccaacagcaagatcccctacttcctgctcttcctgatcttcctgatcaccgtgtaccactatgacctgatgattggcctgaccttctacgtgctgagcctgtcctggctgtcctgggaggagggccggcagaaggagagcgtgaagaagaagtag

SEQ ID NO: 166115 - DNA, 954 bp, Artificial Sequence
  Description of Artificial Sequence: Synthetic coding sequence
atgagctgcaccaggatgatccaggtgctggacccccggcccctgaccagctctgtgatgcctgtggatgtggccatgaggctgtgcctggcccacagcccccctgtgaagagcttcctgggcccctatgatgagttccagaggaggcactttgtgaacaagctgaagcccctgaagagctgcctgaacatcaagcacaaggccaagagccagaatgactggaagtgcagccacaaccaggccaagaagagggtggtgtttgctgacagcaagggcctgagcctgacagccatccacgtgttcagtgacctgcctgaggagcccgcctgggacctgcagtttgacctgctggacctgaatgacatcagcagcgccctgaagcaccacgaggagaagaacctgatcctggacttcccccagcccagcacagactacctgtccttccgcagccacttccagaagaactttgtgtgcctggagaactgcagcctgcaggagaggacagtgacaggcaccgtgaaggtgaagaatgtgtcctttgagaagaaggtgcagatccgcatcacctttgacagctggaagaactacacagatgtggactgtgtgtacatgaagaatgtgtatggaggaacagacagcgacaccttctcctttgccatcgacctgccccctgtgatccccacagagcagaagattgagttctgcatctcctaccacgccaacggccaggtgttctgggacaacaatgatggccagaactaccgcatcgtgcacgtgcagtggaagccagatggagtgcagacccagatggccccccaggactgtgccttccaccagaccagccccaagacagagctggagagcaccatcttcggcagcccccggctggccagcggcctcttccctgagtggcagagctggggccgcatggagaacctggccagctacagatag

SEQ ID NO: 166116 - DNA, 894 bp, Artificial Sequence
  Description of Artificial Sequence: Synthetic coding sequence
atgagctgcaccaggatgatccaggtgctggacccccggcccctgaccagctctgtgatgcctgtggatgtggccatgaggctgtgcctggcccacagcccccctgtgaagagcttcctgggcccctatgatgagttccagaggaggcactttgtgaacaagctgaagcccctgaagagctgcctgaacatcaagcacaaggccaagagccagaatgactggaagtgcagccacaaccaggccaagaagagggtggtgtttgctgacagcaagggcctgagcctgacagccatccacgtgttcagtgacctgcctgaggagcccgcctgggacctgcagtttgacctgctggacctgaatgacatcagcagcgccctgtccttccgcagccacttccagaagaactttgtgtgcctggagaactgcagcctgcaggagaggacagtgacaggcaccgtgaaggtgaagaatgtgtcctttgagaagaaggtgcagatccgcatcacctttgacagctggaagaactacacagatgtggactgtgtgtacatgaagaatgtgtatggaggaacagacagcgacaccttctcctttgccatcgacctgccccctgtgatccccacagagcagaagattgagttctgcatctcctaccacgccaacggccaggtgttctgggacaacaatgatggccagaactaccgcatcgtgcacgtgcagtggaagccagatggagtgcagacccagatggccccccaggactgtgccttccaccagaccagccccaagacagagctggagagcaccatcttcggcagcccccggctggccagcggcctcttccctgagtggcagagctggggccgcatggagaacctggccagctacagatag

SEQ ID NO: 166117 - DNA, 600 bp, Artificial Sequence
  Description of Artificial Sequence: Synthetic coding sequence
atgagcagccccaccagccccctgaagcaccacgaggagaagaacctgatcctggacttcccccagcccagcacagactacctgtccttccgcagccacttccagaagaactttgtgtgcctggagaactgcagcctgcaggagaggacagtgacaggcaccgtgaaggtgaagaatgtgtcctttgagaagaaggtgcagatccgcatcacctttgacagctggaagaactacacagatgtggactgtgtgtacatgaagaatgtgtatggaggaacagacagcgacaccttctcctttgccatcgacctgccccctgtgatccccacagagcagaagattgagttctgcatctcctaccacgccaacggccaggtgttctgggacaacaatgatggccagaactaccgcatcgtgcacgtgcagtggaagccagatggagtgcagacccagatggccccccaggactgtgccttccaccagaccagccccaagacagagctggagagcaccatcttcggcagcccccggctggccagcggcctcttccctgagtggcagagctggggccgcatggagaacctggccagctacagatag

SEQ ID NO: 166118 - DNA, 900 bp, Artificial Sequence
  Description of Artificial Sequence: Synthetic coding sequence
atgagccggggccccagcagcgctgtgctgcccagcgccctgggcagcaggaagctgggccccaggagcctgagctgcctgagtgacctggatggaggagtggccctggagccccgggcctgcaggcctcctggcagccctggccgggcccccccacccaccccagcccccagcggctgtgacccccggctgcggcccatcatcctgcggcgggcccggagcctgcccagcagccctgagcggcggcagaaggccgccggggcccctggagctgcctgcaggcctggctgcagccagaagctgcgggtgcgctttgctgatgccctgggcctggagctggcccaggtgaaggtgttcaatgctggagatgaccccagcgtgcccctgcacgtgctgagccggctggccatcaacagcgacctgtgctgcagcagccaggacctggagttcaccctgcactgcctggtgcctgacttccccccacctgtggaggccgctgactttggagagcggctgcagaggcagctggtgtgcctggagcgggtgacctgcagcgacctgggcatcagcggcaccgtgcgggtgtgcaatgtggcctttgagaagcaggtggccgtgcgctacaccttcagcggctggaggagcacccatgaagctgtggcccgctggaggggccctgctggccctgagggcacagaagatgtgttcaccttcggcttccctgtgccccccttcctgctggagctgggcagccgggtgcactttgctgtgcgctaccaggtggccggggctgagtactgggacaacaatgaccaccgggactacagcctgacctgcaggaaccacgccctgcacatgcccagaggagaatgtgaggagagctggatccacttcatctag

SEQ ID NO: 166119 - DNA, 756 bp, Artificial Sequence
  Description of Artificial Sequence: Synthetic coding sequence
atgacccggctgactgtgctggccctgctggccggcctgctggccagcagcagagctggcagcagccccctgctggacatcgtgggcggcaggaaggcccggccccggcagttccccttcctggccagcatccagaaccagggccgccacttctgtggcggggccctgatccacgccaggtttgtgatgacagctgccagctgcttccagagccagaaccctggggtgtccacagtggtgctgggcgcctatgacctgcggcggcgggagcggcagagccggcagaccttcagcatcagctccatgtctgaaaatggctatgacccccagcagaacctgaatgacctgatgctgctgcagctggaccgggaggccaacctgaccagctctgtgaccatcctgcccctgcccctgcagaatgccaccgtggaggccggcacccgctgccaggtggccggctggggcagccagaggtctgggggccgcctgagccgcttccccaggtttgtgaatgtgacagtgaccccagaggaccagtgccggcccaacaacgtgtgcacaggagtgctgacccggcggggcggcatctgcaatggagatggcggcacccccctggtgtgtgagggcctggcccacggcgtggccagcttcagcctgggcccctgtggccggggccctgacttcttcaccagggtggccctcttccgggactggattgatggagtgctgaacaaccctggccctggccctgcctag

SEQ ID NO: 166120 - DNA, 954 bp, Artificial Sequence
  Description of Artificial Sequence: Synthetic coding sequence
atggctgctgagagaggagctggccagcagcagagccaggagatgatggaggaggagcacgagctgcctgtggacatggagaccatcaacctggacagagatgctgaagatgtggacctgaaccactacagaattggcaagattgagggctttgaggtgctgaagaaggtgaagaccctgtgcctgcggcagaacctgatcaagtgcatcgagaacctggaggagctgcagagcctgcgggagctggacctgtatgacaaccagatcaagaagattgagaacctggaggccctgacagagctggagatcctggacatctccttcaacctgctgaggaacatcgagggcgtggacaagctgacccggctgaagaagctgttcctggtgaacaacaagatcagcaagattgagaacctgagcaacctgcaccagctgcagatgctggagctgggcagcaaccgcatccgggccattgaaaatattgacaccctgaccaacctggagagcctcttcctgggcaagaacaagatcaccaagctgcagaacctggatgccctgaccaacctgactgtgctgtccatgcagagcaaccggctgaccaagattgagggcctgcagaacctggtgaacctgcgggagctgtacctgagccacaatggaattgaagtcatcgagggcctggagaacaacaacaagctgaccatgctggacatcgccagcaaccgcatcaagaagattgagaacatcagccacctgacagagctgcaggagttctggatgaatgacaacctgctggagagctggagcgacctggatgagctgaagggggcccggagcctggagaccgtgtacctggagaggaaccccctgcagaaggacccccagtacagaaggaaggtgatgctggccctgcccagcgtgcggcagattgatgccacctttgtgcgcttctag

SEQ ID NO: 166121 - DNA, 714 bp, Artificial Sequence
  Description of Artificial Sequence: Synthetic coding sequence
atggctgctgagagaggagctggccagcagcagagccaggagatgatggaggaggagcacgagctgcctgtggacatggagaccatcaacctggacagagatgctgaagatgtggacctgaaccactacagaattggcaagattgagggctttgaggtgctgaagaaggtgaagaccctgtgcctgcggcagaacctgatcaagtgcatcgagaacctggaggagctgcagagcctgcgggagctggacctgtatgacaaccagatcaagaagattgagaacctggaggccctgacagagctggagatcctggacatctccttcaacctgctgaggaacatcgagggcgtggacaagctgacccggctgaagaagctgttcctggtgaacaacaagatcagcaagattgagaacctgagcaacctgcaccagctgcagatgctggagctgggcagcaaccgcatccgggccattgaaaatattgacaccctgaccaacctggagagcctcttcctgggcaagaacaagatcaccaagctgcagaacctggatgccctgaccaacctgactgtgctgtccatgcagagcaaccggctgaccaagattgagggcctgcagaacctggtgaacctgcgggagctgtacctgagccacaatggaattgaagtcatcgagggcctggagaacaacgtgcaggacagcctgacctactag

SEQ ID NO: 166122 - DNA, 843 bp, Artificial Sequence
  Description of Artificial Sequence: Synthetic coding sequence
atggctgctgagagaggagctggccagcagcagagccaggagatgatggaggtggaccggcgggtggagagcgaggagagcggagatgaggagggcaagaagcacagcagcggcatcgtggccgacctgtctgagcagagcctgaaggatggagaggagcggggggaggaggaccctgaggaggagcacgagctgcctgtggacatggagaccatcaacctggacagagatgctgaagatgtggacctgaaccactaccgcatcggcaagattgagggctttgaggtgctgaagaaggtgaagaccctgtgcctgcggcagaacctgatcaagtgcatcgagaacctggaggagctgcagagcctgcgggagctggacctgtatgacaaccagatcaagaagattgagaacctggaggccctgacagagctggagatcctggacatctccttcaacctgctgagaaatattgaaggagtggacaagctgacccggctgaagaagctgttcctggtgaacaacaagatcagcaagattgagaacctgagcaacctgcaccagctgcagatgctggagctgggcagcaaccgcatccgggccatcgagaacatcgacaccctgaccaacctggagagcctcttcctgggcaagaacaagatcaccaagctgcagaacctggatgccctgaccaacctgactgtgctgtccatgcagagcaaccggctgaccaagattgagggcctgcagaacctggtgaacctgcgggagctgtacctgagccacaacggcatcgaggtgattgagggcctggagaacaacgtgcaggacagcctgacctactag

SEQ ID NO: 166123 - DNA, 1083 bp, Artificial Sequence; identical to SEQ ID NO: 163329
  Description of Artificial Sequence: Synthetic coding sequence

SEQ ID NO: 166124 - DNA, 384 bp, Artificial Sequence
  Description of Artificial Sequence: Synthetic coding sequence
atggtgcagacagctgtggtgcctgtgaagaagaagagggtggagggccctggcagcctgggcctggaggagagcggcagcaggaggatgcagaactttgccttcagcggcggcctgtatggaggcctgccccccacccacagcgaggccggcagccagccccacggcatccacggcacagccctgattggaggcctgcccatgccctaccccaacctggccccagatgtggacctgacccctgtggtgcccagcgctgtgaacatgaacccagcccccaacccagctgtgtacaaccctgaggccgtgaatgagcccaagaagaagaagtatgccaaggaggcctggccaggcaagaagcccacccccagcctgctgatctag

SEQ ID NO: 166125 - DNA, 1056 bp, Artificial Sequence
  Description of Artificial Sequence: Synthetic coding sequence
atggctgctgctgccaacagcggcagcagcctgcccctgtttgactgccccacctgggccggcaagcccccacctggcctgcacctggatgtggtgaagggggacaagctgattgagaagctgatcattgatgagaagaagtactacctgtttggaagaaatccagacctgtgtgacttcaccatcgaccaccagagctgcagccgggtgcacgccgccctggtgtaccacaagcacctgaagagggtcttcctgattgacctgaacagcacccacggcaccttcctgggccacatccggctggagccccacaagccccagcagatccccatcgacagcacagtgtcctttggagccagcacccgggcctacaccctgcgggagaagccccagaccctgcccagcgctgtgaagggagatgagaagatgggcggggaggatgatgagctgaagggcctgctgggcctgcctgaggaggagacagagctggacaacctgacagagttcaacacagcccacaacaagaggatcagcaccctgaccatcgaggagggcaacctggacatccagaggcccaagaggaagaggaagaacagccgggtgaccttctctgaagatgatgagatcatcaacccagaagatgtggaccccagcgtgggccgcttcaggaacatggtgcagacagctgtggtgcctgtgaagaagaagagggtggagggccctggcagcctgggcctggaggagagcggcagcaggaggatgcagaactttgccttcagcggcggcctgtatggaggcctgccccccacccacagcgaggccggcagccagccccacggcatccacggcacagccctgattggaggcctgcccatgccctaccccaacctggccccagatgtggacctgacccctgtggtgcccagcgctgtgaacatgaacccagcccccaacccagctgtgtacaaccctgaggccgtgaatgagcccaagaagaagaagtatgccaaggaggcctggccaggcaagaagcccacccccagcctgctgatctag

SEQ ID NO: 166126 - DNA, 630 bp, Artificial Sequence
  Description of Artificial Sequence: Synthetic coding sequence
atgggcggggaggatgatgagctgaagggcctgctgggcctgcctgaggaggagacagagctggacaacctgacagagttcaacacagcccacaacaagaggatcagcaccctgaccatcgaggagggcaacctggacatccagaggcccaagaggaagaggaagaacagccgggtgaccttctctgaagatgatgagatcatcaacccagaagatgtggaccccagcgtgggccgcttcaggaacatggtgcagacagctgtggtgcctgtgaagaagaagagggtggagggccctggcagcctgggcctggaggagagcggcagcaggaggatgcagaactttgccttcagcggcggcctgtatggaggcctgccccccacccacagcgaggccggcagccagccccacggcatccacggcacagccctgattggaggcctgcccatgccctaccccaacctggccccagatgtggacctgacccctgtggtgcccagcgctgtgaacatgaacccagcccccaacccagctgtgtacaaccctgaggccgtgaatgagcccaagaagaagaagtatgccaaggaggcctggccaggcaagaagcccacccccagcctgctgatctag

SEQ ID NO: 166127 - DNA, 711 bp, Artificial Sequence
  Description of Artificial Sequence: Synthetic coding sequence
atgggcggggaggatgatgagctgaagggcctgctgggcctgcctgaggaggagacagagctggacaacctgacagagttcaacacagcccacaacaagaggatcagcaccctgaccatcgaggagggcaacctggacatccagaggcccaagaggaagaggaagaacagccgggtgaccttctctgaagatgatgagatcatcaacccagaagatgtggaccccagcgtgggccgcttcaggaacatggtgcagacagctgtggtgcctgtgaagaagaagagggtggagggccctggcagcctgggcctggaggagagcggcagcaggaggatgcagaactttgccttcagcggcggcctgtatggaggcctgccccccacccacagcgaggccggcagccagccccacggcatccacggcacagccctgattggaggcctgcccatgccctaccccaacctggccccagatgtggacctgacccctgtggtgcccagcgctgtgaacatgaacccagcccccaacccagctgtgtacaaccctgaggccgtgaatgagcccaagaagaagaagtatgccaaggaggcctggccaggctgtgaatttgtgtcccagagcctgattgccacagccatctggaagtgcctgctgaaggcccagagcctgggcctgggcggcaatgcccccagccccctgtactacaagtag

SEQ ID NO: 166128 - DNA, 618 bp, Artificial Sequence
  Description of Artificial Sequence: Synthetic coding sequence
atgggcggggaggatgatgagctgaagggcctgctgggcctgcctgaggaggagacagagctggacaacctgacagagttcaacacagcccacaacaagaggatcagcaccctgaccatcgaggagggcaacctggacatccagaggcccaagaggaagaggaagaacagccgggtgaccttctctgaagatgatgagatcatcaacccagaagatgtggaccccagcgtgggccgcttcaggaacatggtgcagacagctgtggtgcctgtgaagaagaagagggtggagggccctggcagcctgggcctggaggagagcggcagcaggaggatgcagaactttgccttcagcggcggcctgtatggaggcctgccccccacccacagcgaggccggcagccagccccacggcatccacggcacagccctgattggaggcctgcccatgccctaccccaacctggccccagatgtggacctgacccctgtggtgcccagcgctgtgaacatgaacccagcccccaacccagctgtgtacaaccctgaggccgtgaatgagcccaagaagaagaagtatgccaaggaggcctggccaggcaagaagcccaccccctag

SEQ ID NO: 166129 - DNA, 600 bp, Artificial Sequence
  Description of Artificial Sequence: Synthetic coding sequence
atggctgctgctgccaacagcggcagcagcctgcccctgtttgactgccccacctgggccggcaagcccccacctggcctgcacctggatgtggtgaagggggacaagctgattgagaagctgatcattgatgagaagaagtactacctgtttggaagaaatccagacctgtgtgacttcaccatcgaccaccagagctgcagccgggtgcacgccgccctggtgtaccacaagcacctgaagagggtcttcctgattgacctgaacagcacccacggcaccttcctgggccacatccggctggagccccacaagccccagcagatccccatcgacagcacagtgtcctttggagccagcacccgggcctacaccctgcgggagaagccccagaccctgcccagcgctgtgaagggagatgagaagatgggcggggaggatgatgagctgaagggcctgctgggcctgcctgaggaggagacagagctggacaacctgacagagttcaacacagcccacaaccacatggcctccatgggccagcacagctctgtggcctgcccctgccacacccagaccctgcccctgatgtggacctag

SEQ ID NO: 166130 - DNA, 3891 bp, Artificial Sequence
  Description of Artificial Sequence: Synthetic coding sequence
atgctgaagacagagagcagtggagagaggaccaccctgcggagcgccagcccccacagaaatgcctacagaacagagttccaggccctgaagagcacctttgacaagcccaagagtgatggagagcagaagaccaaggagggggagggcagccagcagagccggggcaggaaatatggcagcaatgtgaaccgcatcaagaacctcttcatgcagatgggcatggagcccaatgaaaatgctgctgtgattgccaagacccggggcaagggcggccacagcagcccccagaggaggatgaagcccaaggagttcctggagaagacagatggctctgtggtgaagctggagagctctgtgtctgagcgcatcagcagatttgacaccatgtatgatggccccagctacagcaagttcacagagaccaggaagatgtttgagaggtctgtgcatgaaagtggccagaacaaccgctacagccccaagaaggagaaggccggcggcagcgagccccaggatgagtggggcggcagcaagagcaacagaggcagcacagacagcctggacagcctgagcagcaggacagaagctgtgagccccaccgtgtcccagctgtctgctgtgtttgagaacacagacagccccagcgccatcatcagcgagaaggccgagaacaatgagtacagcgtgacaggccactaccccctgaacctgcccagcgtgacagtgaccaacctggacaccttcggccacctgaaggacagcaacagctggccacccagcaacaagaggggcgtggacacagaagatgcccacaagagcaatgccacccctgtgcctgaggtggccagcaagagcaccagcctggccagcatccctggagaggagatccagcagagcaaggagcctgaggacagcaccagcaaccagcagaccccagacagcattgacaaggatggccctgaggagccctgtgccgagagcaaggccatgcccaagtctgagatccccagcccccagagccagctgctggaggatgctgaggccaacctggtgggccgggaggccgccaagcagcagaggaaggagctggccggcggggacttcaccagcccagatgccagcgccagcagctgtgggaaggaggtgcctgaggacagcaacaactttgatggcagccacgtgtacatgcacagcgactacaacgtgtacagagtgcgcagccgctacaacagcgactggggcgagactggaacagagcaggatgaggaggaggacagtgatgaaaattcctactaccagcctgacatggagtacagcgagatcgtgggcctgcctgaggaggaggagatcccagccaacaggaagatcaagttcagcagcgcccccatcaaggtgttcaacacctacagcaatgaagattatgacagaagaaatgatgaggtggaccctgtggccgccagcgcagaatatgagctggagaagagggtggagaagctggagctgtttcctgtggagctggagaaggatgaagatggcctgggcatcagcatcatcggcatgggcgtgggcgcagatgctggcctggagaagctgggcatctttgtgaagacagtgacagagggcggggccgcccagagagatggccgcatccaggtgaatgaccagatcgtggaggtggatggcatcagcctggtgggcgtgacccagaactttgctgccaccgtgctgaggaacaccaagggaaatgtgcgcttcgtcatcggccgggagaagccaggccaggtgtctgaggtggcccagctgatcagccagaccctggagcaggagcggcggcagcgggagctgctggagcagcactacgcccagtatgatgctgatgatgatgaaacaggagaatatgccacagatgaggaggaggatgaggtgggccctgtgctgcccggcagtgacatggccatcgaggtgtttgagctgcctgaaaatgaagacatgttcagccccagcgagctggacaccagcaagctgagccacaagttcaaggagctgcagatcaagcatgctgtgacagaggccgagatccagaagctgaagaccaagctgcaggccgcagaaaatgagaaggtgcgctgggagctggagaagacccagctgcagcagaacatcgaggagaacaaggagaggatgctgaagctggagagctactggattgaggcccagaccctgtgccacacagtgaatgagcacctgaaggagacccagagccagtaccaggccctggagaagaagtacaacaaggccaagaagctgatcaaggacttccagcagaaggagctggacttcatcaagaggcaggaggccgagaggaagaagattgaggacctggagaaggcccacctggtggaggtgcagggcctgcaggtgcgcatccgggacctggaggccgaggtgttccggctgctgaagcagaatggcacccaggtgaacaacaacaacaacatctttgaaagaaggaccagcctgggggaggtgtccaagggggacaccatggagaacctggatggcaagcagaccagctgccaggacggcctgagccaggacctgaatgaagctgtgcctgagacagagcggctggacagcaaggccctgaagacccgggcccagctgtctgtgaagaacagacggcagaggcccagcaggacccggctgtatgacagcgtgagcagcacagatggagaggacagcctggagaggaagggcctgcggaccagcagccctgagagtgacagcggcgtgccccccctgacccctgtggacagcaatgtgcccttcagcagtgaccacatcgccgagttccaggaggagcccctggaccctgagatgggccccctgagctccatgtggggagacaccagcctcttcagcaccagcaagagtgaccatgatgtggaggagagcccctgccaccaccagaccaccaacaagaagatcctgcgggagaaggatgatgccaaggaccccaagagcctgcgggccagcagcagcctggccgtgcagggcggcaagatcaagaggaagtttgtggacctgggcgcccccctgcggaggaacagcagcaagggcaagaagtggaaggagaaggagaaggaggccagccgcttctctgctggcagccgcatcttccggggccgcctggagaactggacccccaagccctgcagcacagcccagaccagcaccaggagcccctgcatgcccttctcctggttcaatgacagcaggaagggcagctacagcttcaggaacctgcctgcccccaccagcagcctgcagcccagccctgagaccctcatcagtgacaagaagggcagcaagaacttcaccttcaatgatgacttcagccccagcagcaccagcagcgctgacctgagcggcctgggcgctgagcccaagaccccaggcctgagccagagcctggccctgagcagtgatgagatcctggatgatggccagagccccaagcacagccagtgccagaacagagctgtgcaggagtggagcgtgcagcaggtgagccactggctgatgagcctgaacctggagcagtatgtgtctgagttcagcgcccagaacatcactggagagcagctgctgcagctggatggcaacaagctgaaggccctgggcatgacagccagccaggacagagctgtggtgaagaagaagctgaaggagatgaagatgagcctggagaaggccaggaaggcccaggagaagatggagaagcagcgggagaagctgcggaggaaggagcaggagcagatgcagaggaagagcaagaagacagagaagatgaccagcaccacagctgagggcgctggggagcagtag

SEQ ID NO: 166131 - DNA, 3297 bp, Artificial Sequence
  Description of Artificial Sequence: Synthetic coding sequence
atgctgaagacagagagcagtggagagaggaccaccctgcggagcgccagcccccacagaaatgcctacagaacagagttccaggccctgaagagcacctttgacaagcccaagagtgatggagagcagaagaccaaggagggggagggcagccagcagagccggggcaggaaatatggcagcaatgtgaaccgcatcaagaacctcttcatgcagatgggcatggagcccaatgaaaatgctgctgtgattgccaagacccggggcaagggcggccacagcagcccccagaggaggatgaagcccaaggagttcctggagaagacagatggctctgtggtgaagctggagagctctgtgtctgagcgcatcagcagatttgacaccatgtatgatggccccagctacagcaagttcacagagaccaggaagatgtttgagaggtctgtgcatgaaagtggccagaacaaccgctacagccccaagaaggagaaggccggcggcagcgagccccaggatgagtggggcggcagcaagagcaacagaggcagcacagacagcctggacagcctgagcagcaggacagaagctgtgagccccaccgtgtcccagctgtctgctgtgtttgagaacacagacagccccagcgccatcatcagcgagaaggccgagaacaatgagtacagcgtgacaggccactaccccctgaacctgcccagcgtgacagtgaccaacctggacaccttcggccacctgaaggacagcaacagctggccacccagcaacaagaggggcgtggacacagaagatgcccacaagagcaatgccacccctgtgcctgaggtggccagcaagagcaccagcctggccagcatccctggagaggagatccagcagagcaaggagcctgaggacagcaccagcaaccagcagaccccagacagcattgacaaggatggccctgaggagccctgtgccgagagcaaggccatgcccaagtctgagatccccagcccccagagccagctgctggaggatgctgaggccaacctggtgggccgggaggccgccaagcagcagaggaaggagctggccggcggggacttcaccagcccagatgccagcgccagcagctgtgggaaggaggtgcctgaggacagcaacaactttgatggcagccacgtgtacatgcacagcgactacaacgtgtacagagtgcgcagccgctacaacagcgactggggcgagactggaacagagcaggatgaggaggaggacagtgatgaaaattcctactaccagcctgacatggagtacagcgagatcgtgggcctgcctgaggaggaggagatcccagccaacaggaagatcaagttcagcagcgcccccatcaaggtgttcaacacctacagcaatgaagattatgacagaagaaatgatgaggtggaccctgtggccgccagcgcagaatatgagctggagaagagggtggagaagctggagctgtttcctgtggagctggagaaggatgaagatggcctgggcatcagcatcatcggcatgggcgtgggcgcagatgctggcctggagaagctgggcatctttgtgaagacagtgacagagggcggggccgcccagagagatggccgcatccaggtgaatgaccagatcgtggaggtggatggcatcagcctggtgggcgtgacccagaactttgctgccaccgtgctgaggaacaccaagggaaatgtgcgcttcgtcatcggccgggagaagccaggccaggtgtctgaggtggcccagctgatcagccagaccctggagcaggagcggcggcagcgggagctgctggagcagcactacgcccagtatgatgctgatgatgatgaaacaggagaatatgccacagatgaggaggaggatgaggtgggccctgtgctgcccggcagtgacatggccatcgaggtgtttgagctgcctgaaaatgaagacatgttcagccccagcgagctggacaccagcaagctgagccacaagttcaaggagctgcagatcaagcatgctgtgacagaggccgagatccagaagctgaagaccaagctgcaggccgcagaaaatgagaaggtgcgctgggagctggagaagacccagctgcagcagaacatcgaggagaacaaggagaggatgctgaagctggagagctactggattgaggcccagaccctgtgccacacagtgaatgagcacctgaaggagacccagagccagtaccaggccctggagaagaagtacaacaaggccaagaagctgatcaaggacttccagcagaaggagctggacttcatcaagaggcaggaggccgagaggaagaagattgaggacctggagaaggcccacctggtggaggtgcagggcctgcaggtgcgcatccgggacctggaggccgaggtgttccggctgctgaagcagaatggcacccaggtgaacaacaacaacaacatctttgaaagaaggaccagcctgggggaggtgtccaagggggacaccatggagaacctggatggcaagcagaccagctgccaggacggcctgagccaggacctgaatgaagctgtgcctgagacagagcggctggacagcaaggccctgaagacccgggcccagctgtctgtgaagaacagacggcagaggcccagcaggacccggctgtatgacagcgtgagcagcacagatggagaggacagcctggagaggaagaacttcaccttcaatgatgacttcagccccagcagcaccagcagcgctgacctgagcggcctgggcgctgagcccaagaccccaggcctgagccagagcctggccctgagcagtgatgagagcctggacatgattgatgatgagatcctggatgatggccagagccccaagcacagccagtgccagaacagagctgtgcaggagtggagcgtgcagcaggtgagccactggctgatgagcctgaacctggagcagtatgtgtctgagttcagcgcccagaacatcactggagagcagctgctgcagctggatggcaacaagctgaaggccctgggcatgacagccagccaggacagagctgtggtgaagaagaagctgaaggagatgaagatgagcctggagaaggccaggaaggcccaggagaagatggagaagcagcgggagaagctgcggaggaaggagcaggagcagatgcagaggaagagcaagaagacagagaagatgaccagcaccacagctgagggcgctggggagcagtag

SEQ ID NO: 166132 - DNA, 222 bp, Artificial Sequence
  Description of Artificial Sequence: Synthetic coding sequence
atgctgaagacagagagcagtggagagaggaccaccctgcggagcgccagcccccacagaaatgcctacagaacagagttccaggccctgaagagcacctttgacaagcccaagagtgatggagagcagaagaccaaggagggggagggcagccagcagagccggggcaggaaatatggcagcaatgtgaaccgcatcaagaacctcttcatgcagatgtag

SEQ ID NO: 166133 - DNA, 126 bp, Artificial Sequence
  Description of Artificial Sequence: Synthetic coding sequence
atgctgaagacagagagcagtggagagaggaccaccctgcggagcgccagcccccacagaaatgcctacagaacagagttccaggccctgaagagcacctttgacaagcccaagagtgatggatag

SEQ ID NO: 166134 - DNA, 3297 bp, Artificial Sequence; identical to SEQ ID NO: 166131
  Description of Artificial Sequence: Synthetic coding sequence

SEQ ID NO: 166135 - DNA, 3762 bp, Artificial Sequence
  Description of Artificial Sequence: Synthetic coding sequence
atgctgaagacagagagcagtggagagaggaccaccctgcggagcgccagcccccacagaaatgcctacagaacagagttccaggccctgaagagcacctttgacaagcccaagagtgatggagagcagaagaccaaggagggggagggcagccagcagagccggggcaggaaatatggcagcaatgtgaaccgcatcaagaacctcttcatgcagatgggcatggagcccaatgaaaatgctgctgtgattgccaagacccggggcaagggcggccacagcagcccccagaggaggatgaagcccaaggagttcctggagaagacagatggctctgtggtgaagctggagagctctgtgtctgagcgcatcagcagatttgacaccatgtatgatggccccagctacagcaagttcacagagaccaggaagatgtttgagaggtctgtgcatgaaagtggccagaacaaccgctacagccccaagaaggagaaggccggcggcagcgagccccaggatgagtggggcggcagcaagagcaacagaggcagcacagacagcctggacagcctgagcagcaggacagaagctgtgagccccaccgtgtcccagctgtctgctgtgtttgagaacacagacagccccagcgccatcatcagcgagaaggccgagaacaatgagtacagcgtgacaggccactaccccctgaacctgcccagcgtgacagtgaccaacctggacaccttcggccacctgaaggacagcaacagctggccacccagcaacaagaggggcgtggacacagaagatgcccacaagagcaatgccacccctgtgcctgaggtggccagcaagagcaccagcctggccagcatccctggagaggagatccagcagagcaaggagcctgaggacagcaccagcaaccagcagaccccagacagcattgacaaggatggccctgaggagccctgtgccgagagcaaggccatgcccaagtctgagatccccagcccccagagccagctgctggaggatgctgaggccaacctggtgggccgggaggccgccaagcagcagaggaaggagctggccggcggggacttcaccagcccagatgccagcgccagcagctgtgggaaggaggtgcctgaggacagcaacaactttgatggcagccacgtgtacatgcacagcgactacaacgtgtacagagtgcgcagccgctacaacagcgactggggcgagactggaacagagcaggatgaggaggaggacagtgatgaaaattcctactaccagcctgacatggagtacagcgagatcgtgggcctgcctgaggaggaggagatcccagccaacaggaagatcaagttcagcagcgcccccatcaaggtgttcaacacctacagcaatgaagattatgacagaagaaatgatgaggtggaccctgtggccgccagcgcagaatatgagctggagaagagggtggagaagctggagctgtttcctgtggagctggagaaggatgaagatggcctgggcatcagcatcatcggcatgggcgtgggcgcagatgctggcctggagaagctgggcatctttgtgaagacagtgacagagggcggggccgcccagagagatggccgcatccaggtgaatgaccagatcgtggaggtggatggcatcagcctggtgggcgtgacccagaactttgctgccaccgtgctgaggaacaccaagggaaatgtgcgcttcgtcatcggccgggagaagccaggccaggtgtctgaggtggcccagctgatcagccagaccctggagcaggagcggcggcagcgggagctgctggagcagcactacgcccagtatgatgctgatgatgatgaaacaggagaatatgccacagatgaggaggaggatgaggtgggccctgtgctgcccggcagtgacatggccatcgaggtgtttgagctgcctgaaaatgaagacatgttcagccccagcgagctggacaccagcaagctgagccacaagttcaaggagctgcagatcaagcatgctgtgacagaggccgagatccagaagctgaagaccaagctgcaggccgcagaaaatgagaaggtgcgctgggagctggagaagacccagctgcagcagaacatcgaggagaacaaggagaggatgctgaagctggagagctactggattgaggcccagaccctgtgccacacagtgaatgagcacctgaaggagacccagagccagtaccaggccctggagaagaagtacaacaaggccaagaagctgatcaaggacttccagcagaaggagctggacttcatcaagaggcaggaggccgagaggaagaagattgaggacctggagaaggcccacctggtggaggtgcagggcctgcaggtgcgcatccgggacctggaggccgaggtgttccggctgctgaagcagaatggcacccaggtgaacaacaacaacaacatctttgaaagaaggaccagcctgggggaggtgtccaagggggacaccatggagaacctggatggcaagcagaccagctgccaggacggcctgagccaggacctgaatgaagctgtgcctgagacagagcggctggacagcaaggccctgaagacccgggcccagctgtctgtgaagaacagacggcagaggcccagcaggacccggctgtatgacagcgtgagcagcacagatggagaggacagcctggagaggaagcccagcaacagcttctacaaccacatgcacatcaccaagctgctgccccccaagggcctgcggaccagcagccctgagagtgacagcggcgtgccccccctgacccctgtggacagcaatgtgcccttcagcagtgaccacatcgccgagttccaggaggagcccctggaccctgagatgggccccctgagctccatgtggggagacaccagcctcttcagcaccagcaagagtgaccatgatgtggaggagagcccctgccaccaccagaccaccaacaagaagatcctgcgggagaaggatgatgccaaggaccccaagagcctgcgggccagcagcagcctggccgtgcagggcggcaagatcaagaggaagtttgtggacctgggcgcccccctgcggaggaacagcagcaagggcaagaagtggaaggagaaggagaaggaggccagccgcttctctgctggcagccgcatcttccggggccgcctggagaactggacccccaagccctgcagcacagcccagaccagcaccaggagcccctgcatgcccttctcctggttcaatgacagcaggaagggcagctacagcttcaggaacctgcctgcccccaccagcagcctgcagcccagccctgagaccctcatcagtgacaagaagggcagcaagaacttcaccttcaatgatgacttcagccccagcagcaccagcagcgctgacctgagcggcctgggcgctgagcccaagaccccaggcctgagccagagcctggccctgagcagtgatgaggccctgggcatgacagccagccaggacagagctgtggtgaagaagaagctgaaggagatgaagatgagcctggagaaggccaggaaggcccaggagaagatggagaagcagcgggagaagctgcggaggaaggagcaggagcagatgcagaggaagagcaagaagacagagaagatgaccagcaccacagctgagggcgctggggagcagtag

SEQ ID NO: 166136 - DNA, 930 bp, Artificial Sequence
  Description of Artificial Sequence: Synthetic coding sequence
atggatgagaaggtgttcaccaaggagctggaccagtggattgagcagctgaatgaatgcaagcagctgtctgagagccaggtgaagagcctgtgtgagaaggccaaggagatcctgaccaaggagagcaatgtgcaggaggtgcgctgccctgtgacagtgtgtggagatgtgcacggccagttccatgacctgatggagctgttcagaattggaggcaagagcccagacaccaactacctgttcatgggagactatgtggaccggggctactacagcgtggagaccgtgaccctgctggtggccctgaaggtgcgctaccgggagcgcatcaccatcctgcggggcaaccacgagagccggcagatcacccaggtgtatggcttctatgatgagtgcctgaggaaatatggaaatgccaacgtgtggaagtacttcacagacctgtttgactacctgcccctgacagccctggtggatggccagatcttctgcctgcatggaggcctgagccccagcattgacaccctggaccacatccgggccctggaccggctgcaggaggtgccccatgagggccccatgtgtgacctgctgtggagcgaccctgatgacagaggaggctggggcatcagccccaggggggccggctacaccttcggccaggacatcagcgagaccttcaaccacgccaacggcctgaccctggtgtcccgggcccaccagctggtgatggagggctacaactggtgccacgacagaaatgtggtgaccatcttcagcgcccccaactactgctaccgctgtggcaaccaggccgccatcatggagctggatgacaccctgaagtacagcttcctgcagtttgatcctgccccccggcggggggagccccacgtgaccaggaggaccccagactacttcctgtag

SEQ ID NO: 166137 - DNA, 1407 bp, Artificial Sequence
  Description of Artificial Sequence: Synthetic coding sequence
atggcccctcctccagcccgggtgcacctgggcgccttcctggccgtgacccccaaccctggcagcgctgccagcggcacagaagctgctgctgccacccccagcaaggtgtggggcagcagcgctggaagaattgagccccggggcggcggccgcggggccctgcccacctccatgggccagcacggccccagcgcccgggcccgggccggccgggcccctggccccaggcctgcccgggaggccagcccccggctgcgggtgcacaagaccttcaagtttgtggtggtgggcgtgctgctgcaggtggtgcccagcagcgctgccaccatcaagctgcatgaccagagcatcggcacccagcagtgggagcacagccccctgggggagctgtgccccccaggcagccacaggtctgagcaccctggggcctgcaaccgctgcacagaaggagtgggctacaccaatgccagcaacaacctgtttgcctgcctgccctgcacagcctgcaagagtgatgaggaggagaggagcccctgcaccaccaccaggaacacagcctgccagtgcaagccaggcaccttcagaaatgacaacagcgctgagatgtgcaggaagtgcagccggggctgcccccggggcatggtgaaggtgaaggactgcaccccctggagcgacattgaatgtgtgcacaaggagagcggaaatggccacaacatctgggtgatcctggtggtgaccctggtggtgcccctgctgctggtggccgtgctgattgtgtgctgctgcatcggcagcggctgcggcggggaccccaagtgcatggacagagtgtgcttctggaggctgggcctgctgcggggccctggagctgaggacaatgcccacaatgagatcctgagcaatgctgacagcctgagcacctttgtgtctgagcagcagatggagagccaggagcctgctgacctgactggagtgacagtgcagagccctggagaggcccagtgcctgctgggccctgctgaggccgagggcagccagaggcggcggctgctggtgcctgccaacggggctgaccccacagagaccctgatgctgttctttgacaagtttgccaacatcgtgccctttgacagctgggaccagctgatgaggcagctggacctgaccaagaatgaaattgatgtggtgcgggccggcacagctggccctggagatgccctgtatgccatgctgatgaagtgggtgaacaagacaggaagaaatgccagcatccacaccctgctggatgccctggagaggatggaggagagacatgcccgggagaagatccaggacctgctggtggacagcggcaagttcatctacctggaggatggcactggatctgctgtgtccctggagtag

SEQ ID NO: 166138 - DNA, 930 bp, Artificial Sequence; identical to SEQ ID NO: 161626
  Description of Artificial Sequence: Synthetic coding sequence

SEQ ID NO: 166139 - DNA, 1461 bp, Artificial Sequence
  Description of Artificial Sequence: Synthetic coding sequence
atgagcagcagcagccccccagctggggccgccagcgctgccatcagcgccagcgagaaggtggatggcttcaccaggaagtctgtgaggaaggcccagaggcagaagaggagccagggcagcagccagttccgcagccagggcagccaggccgagctgcaccccctgccccagctgaaggatgccaccagcaatgagcagcaggagctgttctgccagaagctgcagcagtgctgcatcctgtttgacttcatggattctgtgtctgacctgaagagcaaggagatcaagagggccaccctgaatgagctggtggagtatgtgtccaccaacagaggagtgattgtggagagcgcctacagcgacatcgtgaagatgatcagcgccaacatcttccgcaccctgccccccagcgacaacccagactttgatcctgaagaagatgagcccaccctggaggcctcctggccccacatccagctggtgtatgagttcttcctgcgcttcctggagagcccagacttccagcccagcatcgccaagcgctacatcgaccagaagtttgtgcagcagctgctggagctgtttgacagcgaggacccccgggagcgggacttcctgaagacagtgctgcaccgcatctacggcaagttcctgggcctgcgggccttcatcaggaagcagatcaacaacatcttcctgcgcttcatctatgaaacagagcacttcaacggggtggccgagctgctggagatcctgggcagcatcatcaatggatttgccctgcccctgaaggccgagcacaagcagttcctgatgaaggtgctgatccccatgcacacagccaagggcctggccctcttccacgcccagctggcctactgtgtggtgcagttcctggagaaggacaccaccctgacagagcctgtgatccggggcctgctgaagttctggcccaagacctgcagccagaaggaggtgatgttcctgggggagattgaggagatcctggatgtgattgagcccacccagttcaagaagattgaggagcccctcttcaagcagatcagcaaatgtgtgagcagcagccacttccaggtggccgagcgggccctgtacttctggaacaatgagtacatcctgagcctcatcgaggagaacatcgacaagatcctgcccatcatgtttgccagcctgtacaagatcagcaaggagcactggaaccccaccatcgtggccctggtgtacaacgtgctgaagaccctgatggagatgaatggcaagctgtttgatgacctgaccagcagctacaaggccgagcggcagcgggagaagaagaaggagctggagcgggaggagctgtggaagaagctggaggagctgaagctgaagaaggccctggagaagcagaacagcgcctacaacatgcacagcatcctgagcaacaccagcgctgagtag

SEQ ID NO: 166140 - DNA, 1290 bp, Artificial Sequence
  Description of Artificial Sequence: Synthetic coding sequence
atgatcatgaatgccaccagcaatgagcagcaggagctgttctgccagaagctgcagcagtgctgcatcctgtttgacttcatggacagcgtgtctgacctgaagagcaaggagatcaagagggccaccctgaatgagctggtggagtatgtgtccaccaacagaggagtcatcgtggagagcgcctacagcgacatcgtgaagatgatcagcgccaacatcttccgcaccctgcccccaagtgacaacccagactttgatcctgaggaggatgagcccaccctggaggcctcctggccccacatccagctggtgtatgagttcttcctgcgcttcctggagagcccagacttccagcccagcatcgccaagcgctacatcgaccagaagtttgtgcagcagctgctggagctgtttgattctgaggacccccgggagcgggacttcctgaagacagtgctgcaccgcatctacggcaagttcctgggcctgcgggccttcatcaggaagcagatcaacaacatcttcctgcgcttcatctatgaaacagagcacttcaatggagtggccgagctgctggagatcctgggcagcatcatcaatggatttgccctgcccctgaaggccgagcacaagcagttcctgatgaaggtgctgatccccatgcacacagccaagggcctggccctcttccacgcccagctggcctactgtgtggtgcagttcctggagaaggacaccaccctgacagagcccgtcatccggggcctgctgaagttctggcccaagacctgcagccagaaggaggtgatgttcctgggggagattgaggagatcctggatgtgattgagcccacccagttcaagaagattgaggagcccctcttcaagcagatcagcaaatgtgtgagcagcagccacttccaggtggccgagcgggccctgtacttctggaacaatgagtacatcctgagcctgattgaagaaaatattgacaagatcctgcccatcatgtttgccagcctgtacaagatcagcaaggagcactggaaccccaccatcgtggccctggtgtacaacgtgctgaagaccctgatggagatgaatggcaagctgtttgatgacctgaccagcagctacaaggccgagcggcagcgggagaagaagaaggagctggagcgggaggagctgtggaagaagctggaggagctgaagctgaagaaggccctggagaagcagaacagcgcctacaacatgcacagcatcctgagcaacaccagcgctgagtag

SEQ ID NO: 166141 - DNA, 1461 bp, Artificial Sequence; identical to SEQ ID NO: 166139
  Description of Artificial Sequence: Synthetic coding sequence

SEQ ID NO: 166142 - DNA, 1341 bp, Artificial Sequence
  Description of Artificial Sequence: Synthetic coding sequence
atgaagtgcttcagccgctacctgccctacatcttccggccccccaacaccatcctgagcagcagctgccacacagaagctgacatcatcagcacagtggagttcaaccacactggagagctgctggccaccggggacaagggcggccgggtggtgatcttccagcgggagcaggagagcaagaaccaggtgcaccggcggggggagtacaacgtgtacagcaccttccagagccatgagcctgagtttgactacctgaagagcctggagattgaggagaagatcaacaagatccgctggctgccccagcagaatgctgcctacttcctgctgagcaccaatgacaagacagtgaagctgtggaaggtgtctgagcgggacaagaggcctgagggctacaacctgaaggatgaggagggccgcctgcgggaccctgccaccatcaccaccctgcgggtgcctgtgctgcggcccatggacctgatggtggaggccaccccccggcgggtgtttgccaatgcccacacctaccacatcaacagcatctctgtgaacagcgactatgagacctacatgtctgcagatgacctgcgcatcaacctgtggaactttgagatcaccaaccagagcttcaacatcgtggacatcaagccagccaacatggaggagctgacagaggtgatcacagctgctgagttccacccccaccactgcaacacctttgtgtacagcagcagcaagggcaccatccggctgtgtgacatgagggccagcgccctgtgtgacagacacaccaagttctttgaggagcctgaggaccccagcaacagaagcttcttcagcgagatcatcagcagcatcagtgatgtgaagttcagccacagcggccgctacatcatgacccgggactacctgactgtgaaggtgtgggacctgaacatggagaaccggcccatcgagacctaccaggtgcatgactacctgcggagcaagctgtgcagcctgtatgaaaatgactgcatctttgacaagtttgaatgtgtgtggaatggaagtgacagcgtcatcatgacaggcagctacaacaacttcttcaggatgtttgacaggaacaccaagagagatgtgaccctggaggccagccgggagaacagcaagccccgggccatcctgaagcccaggaaggtgtgtgtgggcggcaagaggaggaaggatgagatctctgtggacagcctggacttcagcaagaagatcctgcacacagcctggcaccccagcgagaacatcatcgctgtggccgccaccaacaacctgtacatcttccaggacaaggtgaactag

SEQ ID NO: 166143 - DNA, 1332 bp, Artificial Sequence
  Description of Artificial Sequence: Synthetic coding sequence
atggaggaggacatcgacaccaggaagatcaacaacagcttcctgcgggaccacagctatgccacagaggccgacatcatcagcacagtggagttcaaccacactggagagctgctggccactggagacaagggcggccgggtggtgatcttccagcgggagcaggagagcaagaaccaggtgcacagaagaggagagtacaacgtgtacagcaccttccagagccatgagcctgagtttgactacctgaagagcctggagattgaggagaagatcaacaagatccgctggctgccccagcagaatgctgcctacttcctgctgagcaccaatgacaagacagtgaagctgtggaaggtgtctgagcgggacaagaggcctgagggctacaacctgaaggatgaggagggccgcctgcgggaccctgccaccatcaccaccctgcgggtgcctgtgctgcggcccatggacctgatggtggaggccaccccaagaagagtgtttgccaatgcccacacctaccacatcaacagcatctctgtgaacagcgactatgagacctacatgtctgcagatgacctgcgcatcaacctgtggaactttgagatcaccaaccagagcttcaacatcgtggacatcaagccagccaacatggaggagctgacagaggtgatcacagctgctgagttccacccccaccactgcaacacctttgtgtacagcagcagcaagggcaccatccggctgtgtgacatgagggccagcgccctgtgtgacagacacaccaagttctttgaggagcctgaggaccccagcaacagaagcttcttcagcgagatcatcagcagcatcagtgatgtgaagttcagccacagcggccgctacatcatgacccgggactacctgactgtgaaggtgtgggacctgaacatggagaaccggcccatcgagacctaccaggtgcatgactacctgcggagcaagctgtgcagcctgtatgaaaatgactgcatctttgacaagtttgaatgtgtgtggaatggaagtgacagcgtcatcatgacaggcagctacaacaacttcttcaggatgtttgacaggaacaccaagagagatgtgaccctggaggccagccgggagaacagcaagccccgggccatcctgaagcccaggaaggtgtgtgtgggcggcaagaggaggaaggatgagatctctgtggacagcctggacttcagcaagaagatcctgcacacagcctggcaccccagcgagaacatcatcgctgtggccgccaccaacaacctgtacatcttccaggacaaggtgaactag

SEQ ID NO: 166144 - DNA, 1506 bp, Artificial Sequence
  Description of Artificial Sequence: Synthetic coding sequence
atggtgctgcagcccagcgagcggcactacagagactggaaccaccggcggctgggcccctggtgcagccccaccggcagccctgcccccctgagctgtgaaacaggctgtggggagggctcctggatcctggtgtgccgcctgctggtgcccacccaggtgtccctgctgtccatggaggaggacatcgacaccaggaagatcaacaacagcttcctgcgggaccacagctatgccacagaggccgacatcatcagcacagtggagttcaaccacactggagagctgctggccactggagacaagggcggccgggtggtgatcttccagcgggagcaggagagcaagaaccaggtgcacagaagaggagagtacaacgtgtacagcaccttccagagccatgagcctgagtttgactacctgaagagcctggagattgaggagaagatcaacaagatccgctggctgccccagcagaatgctgcctacttcctgctgagcaccaatgacaagacagtgaagctgtggaaggtgtctgagcgggacaagaggcctgagggctacaacctgaaggatgaggagggccgcctgcgggaccctgccaccatcaccaccctgcgggtgcctgtgctgcggcccatggacctgatggtggaggccaccccaagaagagtgtttgccaatgcccacacctaccacatcaacagcatctctgtgaacagcgactatgagacctacatgtctgcagatgacctgcgcatcaacctgtggaactttgagatcaccaaccagagcttcaacatcgtggacatcaagccagccaacatggaggagctgacagaggtgatcacagctgctgagttccacccccaccactgcaacacctttgtgtacagcagcagcaagggcaccatccggctgtgtgacatgagggccagcgccctgtgtgacagacacaccaagttctttgaggagcctgaggaccccagcaacagaagcttcttcagcgagatcatcagcagcatcagtgatgtgaagttcagccacagcggccgctacatcatgacccgggactacctgactgtgaaggtgtgggacctgaacatggagaaccggcccatcgagacctaccaggtgcatgactacctgcggagcaagctgtgcagcctgtatgaaaatgactgcatctttgacaagtttgaatgtgtgtggaatggaagtgacagcgtcatcatgacaggcagctacaacaacttcttcaggatgtttgacaggaacaccaagagagatgtgaccctggaggccagccgggagaacagcaagccccgggccatcctgaagcccaggaaggtgtgtgtgggcggcaagaggaggaaggatgagatctctgtggacagcctggacttcagcaagaagatcctgcacacagcctggcaccccagcgagaacatcatcgctgtggccgccaccaacaacctgtacatcttccaggacaaggtgaactag

SEQ ID NO: 166145 - DNA, 1299 bp, Artificial Sequence
  Description of Artificial Sequence: Synthetic coding sequence
atgaactacccagatgagaacacctacggcaacaaggctgacatcatcagcacagtggagttcaaccacactggagagctgctggccaccggggacaagggcggccgggtggtgatcttccagcgggagcaggagagcaagaaccaggtgcaccggcggggggagtacaacgtgtacagcaccttccagagccatgagcctgagtttgactacctgaagagcctggagattgaggagaagatcaacaagatccgctggctgccccagcagaatgctgcctacttcctgctgagcaccaatgacaagacagtgaagctgtggaaggtgtctgagcgggacaagaggcctgagggctacaacctgaaggatgaggagggccgcctgcgggaccctgccaccatcaccaccctgcgggtgcctgtgctgcggcccatggacctgatggtggaggccaccccccggcgggtgtttgccaatgcccacacctaccacatcaacagcatctctgtgaacagcgactatgagacctacatgtctgcagatgacctgcgcatcaacctgtggaactttgagatcaccaaccagagcttcaacatcgtggacatcaagccagccaacatggaggagctgacagaggtgatcacagctgctgagttccacccccaccactgcaacacctttgtgtacagcagcagcaagggcaccatccggctgtgtgacatgagggccagcgccctgtgtgacagacacaccaagttctttgaggagcctgaggaccccagcaacagaagcttcttcagcgagatcatcagcagcatcagtgatgtgaagttcagccacagcggccgctacatcatgacccgggactacctgactgtgaaggtgtgggacctgaacatggagaaccggcccatcgagacctaccaggtgcatgactacctgcggagcaagctgtgcagcctgtatgaaaatgactgcatctttgacaagtttgaatgtgtgtggaatggaagtgacagcgtcatcatgacaggcagctacaacaacttcttcaggatgtttgacaggaacaccaagagagatgtgaccctggaggccagccgggagaacagcaagccccgggccatcctgaagcccaggaaggtgtgtgtgggcggcaagaggaggaaggatgagatctctgtggacagcctggacttcagcaagaagatcctgcacacagcctggcaccccagcgagaacatcatcgctgtggccgccaccaacaacctgtacatcttccaggacaaggtgaactag

SEQ ID NO: 166146 - DNA, 1332 bp, Artificial Sequence; identical to SEQ ID NO: 166143
  Description of Artificial Sequence: Synthetic coding sequence

SEQ ID NO: 166147 - DNA, 1332 bp, Artificial Sequence; identical to SEQ ID NO: 166143
  Description of Artificial Sequence: Synthetic coding sequence

SEQ ID NO: 166148 - DNA, 1530 bp, Artificial Sequence
  Description of Artificial Sequence: Synthetic coding sequence
atgctgctgagcctgcctgccctgcacctgcagaccagcgagcaccaccccttcttccagctgccccaccggcggctgggcccctggtgcagccccaccggcagccctgcccccctgagctgtgaaacaggctgtggggagggctcctggatcctggtgtgccgcctgctggtgcccacccaggtgtccctgctgtccatggaggaggacatcgacaccaggaagatcaacaacagcttcctgcgggaccacagctatgccacagaggccgacatcatcagcacagtggagttcaaccacactggagagctgctggccactggagacaagggcggccgggtggtgatcttccagcgggagcaggagagcaagaaccaggtgcacagaagaggagagtacaacgtgtacagcaccttccagagccatgagcctgagtttgactacctgaagagcctggagattgaggagaagatcaacaagatccgctggctgccccagcagaatgctgcctacttcctgctgagcaccaatgacaagacagtgaagctgtggaaggtgtctgagcgggacaagaggcctgagggctacaacctgaaggatgaggagggccgcctgcgggaccctgccaccatcaccaccctgcgggtgcctgtgctgcggcccatggacctgatggtggaggccaccccaagaagagtgtttgccaatgcccacacctaccacatcaacagcatctctgtgaacagcgactatgagacctacatgtctgcagatgacctgcgcatcaacctgtggaactttgagatcaccaaccagagcttcaacatcgtggacatcaagccagccaacatggaggagctgacagaggtgatcacagctgctgagttccacccccaccactgcaacacctttgtgtacagcagcagcaagggcaccatccggctgtgtgacatgagggccagcgccctgtgtgacagacacaccaagttctttgaggagcctgaggaccccagcaacagaagcttcttcagcgagatcatcagcagcatcagtgatgtgaagttcagccacagcggccgctacatcatgacccgggactacctgactgtgaaggtgtgggacctgaacatggagaaccggcccatcgagacctaccaggtgcatgactacctgcggagcaagctgtgcagcctgtatgaaaatgactgcatctttgacaagtttgaatgtgtgtggaatggaagtgacagcgtcatcatgacaggcagctacaacaacttcttcaggatgtttgacaggaacaccaagagagatgtgaccctggaggccagccgggagaacagcaagccccgggccatcctgaagcccaggaaggtgtgtgtgggcggcaagaggaggaaggatgagatctctgtggacagcctggacttcagcaagaagatcctgcacacagcctggcaccccagcgagaacatcatcgctgtggccgccaccaacaacctgtacatcttccaggacaaggtgaactag

SEQ ID NO: 166149 - DNA, 1332 bp, Artificial Sequence; identical to SEQ ID NO: 166143
  Description of Artificial Sequence: Synthetic coding sequence

SEQ ID NO: 166150 - DNA, 1350 bp, Artificial Sequence
  Description of Artificial Sequence: Synthetic coding sequence
atgatccctggcatcggcaccctgacccaggacaccctgtggtgcttcagccaggtgaagggcaccattgaaattggcaccacagaggccgacatcatcagcacagtggagttcaaccacactggagagctgctggccactggagacaagggcggccgggtggtgatcttccagcgggagcaggagagcaagaaccaggtgcacagaagaggagagtacaacgtgtacagcaccttccagagccatgagcctgagtttgactacctgaagagcctggagattgaggagaagatcaacaagatccgctggctgccccagcagaatgctgcctacttcctgctgagcaccaatgacaagacagtgaagctgtggaaggtgtctgagcgggacaagaggcctgagggctacaacctgaaggatgaggagggccgcctgcgggaccctgccaccatcaccaccctgcgggtgcctgtgctgcggcccatggacctgatggtggaggccaccccaagaagagtgtttgccaatgcccacacctaccacatcaacagcatctctgtgaacagcgactatgagacctacatgtctgcagatgacctgcgcatcaacctgtggaactttgagatcaccaaccagagcttcaacatcgtggacatcaagccagccaacatggaggagctgacagaggtgatcacagctgctgagttccacccccaccactgcaacacctttgtgtacagcagcagcaagggcaccatccggctgtgtgacatgagggccagcgccctgtgtgacagacacaccaagttctttgaggagcctgaggaccccagcaacagaagcttcttcagcgagatcatcagcagcatcagtgatgtgaagttcagccacagcggccgctacatcatgacccgggactacctgactgtgaaggtgtgggacctgaacatggagaaccggcccatcgagacctaccaggtgcatgactacctgcggagcaagctgtgcagcctgtatgaaaatgactgcatctttgacaagtttgaatgtgtgtggaatggaagtgacagcgtcatcatgacaggcagctacaacaacttcttcaggatgtttgacaggaacaccaagagagatgtgaccctggaggccagccgggagaacagcaagccccgggccatcctgaagcccaggaaggtgtgtgtgggcggcaagaggaggaaggatgagatctctgtggacagcctggacttcagcaagaagatcctgcacacagcctggcaccccagcgagaacatcatcgctgtggccgccaccaacaacctgtacatcttccaggacaaggtgaactag

SEQ ID NO: 166151 - DNA, 1299 bp, Artificial Sequence; identical to SEQ ID NO: 166145
  Description of Artificial Sequence: Synthetic coding sequence

SEQ ID NO: 166152 - DNA, 1494 bp, Artificial Sequence
  Description of Artificial Sequence: Synthetic coding sequence
atggagaccaagctgcccccagccagcacccccaccagccccagcagccctggcctgagccctgtgcccccaccagacaaggtggatggcttcagcagaagaagcctgcggcgggcccggccccggcgcagccacagcagcagccagttccgctaccagagcaaccagcaggagctgacccccctgcccctgctgaaggatgtgcctgccagcgagctgcacgagctgctgagcaggaagctggcccagtgtggggtgatgtttgacttcctggactgtgtggccgacctgaagggcaaggaggtgaagagagctgccctgaatgagctggtggagtgtgtgggcagcacccggggcgtgctgattgagcctgtgtacccagacatcatccgcatgatctctgtgaacatcttccgcaccctgcccccatctgaaaatcctgagtttgatcctgaagaagatgagcccaacctggagcccagctggccccacctgcagctggtgtatgagttcttcctgcgcttcctggagagcccagacttccagcccagcgtggccaagagatatgtggaccagaagtttgtgctgatgctgctggagctgtttgacagcgaggacccccgggagcgggagtacctgaagaccatcctgcaccgggtgtatggcaagttcctgggcctgcgggcctacatcaggaagcagtgcaaccacatcttcctgcgcttcatctatgaatttgagcacttcaacggggtggccgagctgctggagatcctgggcagcatcatcaatggatttgccctgcccctgaagacagagcacaagcagttcctggtgcgggtgctgatccccctgcacagcgtgaagagcctgagcgtcttccacgcccagctggcctactgtgtggtgcagttcctggagaaggatgccaccctgacagaacatgtgatccggggcctgctgaagtactggcccaagacctgcacccagaaggaggtgatgttcctgggggagatggaggagatcctggatgtgattgagcccagccagtttgtgaagatccaggagcccctcttcaagcaggtggcccgctgtgtgagcagcccccacttccaggtggccgagcgggccctgtacttctggaacaatgagtacatcctgagcctgattgaggacaactgccacacagtgctgcctgctgtgtttggcaccctgtaccaggtgtccaaggagcactggaaccagaccatcgtgtccctcatctacaacgtgctgaagaccttcatggagatgaatggcaagctgtttgatgagctgacagccagctacaagctggagaagcagcaggagcagcagaaggcccaggagcggcaggagctgtggcagggcctggaggagctgcggctgcggcggctgcagggcacccagggcgccaaggaggcccccctgcagaggctgaccccccaggtggccgccagcggcggccagagctag

SEQ ID NO: 166153 - DNA, 1107 bp, Artificial Sequence
  Description of Artificial Sequence: Synthetic coding sequence
tctgtgcagagccacccagccccaccccggccccgggagaacccccggggcagcgagagcctgccctgccgcctgacagccatggagaccaagctgcccccagccagcacccccaccagccccagcagccctggcctgagccctgtgcccccaccagacaaggtggatggcttcagccgccgcagcctgcggcgggcccggcccaggaggagccacagcagcagccagttccgctaccagagcaaccagcaggagctgacccccctgcccctgctgaaggatgtgcctgccagcgagctgcacgagctgctgagcaggaagctggcccagtgtggggtgatgtttgacttcctggactgtgtggccgacctgaagggcaaggaggtgaagagagctgccctgaatgagctggtggagtgtgtgggcagcacccggggcgtgctgattgagcctgtgtacccagacatcatccgcatgatctctgtgaacatcttccgcaccctgcccccatctgagaaccctgagtttgatcctgaggaggatgagcccaacctggagcccagctggccccacctgcagctggtgtatgagttcttcctgcgcttcctggagagcccagacttccagcccagcgtggccaagcgctacgtggaccagaagtttgtgctgatgctgctggagctgtttgattctgaggacccccgggagcgggagtacctgaagaccatcctgcaccgggtgtatggcaagttcctgggcctgcgggcctacatcaggaagcagtgcaaccacatcttcctgcgcttcatctatgaatttgagcacttcaatggagtggccgagctgctggagatcctgggcagcatcatcaatggatttgccctgcccctgaagacagagcacaagccaggcagcaggccagaccccccagccctgtgccaggtggccgtgtgcctgccctgcccagctggcatcctgtgtggggctgtgcctggagagggctgccacagcgaccgggcccgggaccctggagctgcccagatcctggccaagaacctgcaccctgagggcggagatgtgtctggaggagatggccgggacagctag

SEQ ID NO: 166154 - DNA, 582 bp, Artificial Sequence
  Description of Artificial Sequence: Synthetic coding sequence
atggagaccaagctgcccccagccagcacccccaccagccccagcagccctggcctgagccctgtgcccccaccagacaaggtggatggcttcagcagaagaagcctgcggcgggcccggccccggcgcagccacagcagcagccagttccgctaccagagcaaccagcaggagctgacccccctgcccctgctgaaggatgtgcctgccagcgagctgcacgagctgctgagcaggaagctggcccagtgtggggtgatgtttgacttcctggactgtgtggccgacctgaagggcaaggaggtgaagagagctgccctgaatgagctggtggagtgtgtgggcagcacccggggcgtgctgattgagcctgtgtacccagacatcatccgcatgatctctgtgaacatcttccgcaccctgcccccatctgaaaatcctgagtttgatcctgaagaagatgagcccaacctggagcccagctggccccacctgcagctggtgtatgagttcttcctgcgcttcctggagagcccagacttccagcccagcgtggccaagagatatgtggaccagaagtag

SEQ ID NO: 166155 - DNA, 1494 bp, Artificial Sequence; identical to SEQ ID NO: 166152
  Description of Artificial Sequence: Synthetic coding sequence

SEQ ID NO: 166156 - DNA, 408 bp, Artificial Sequence
  Description of Artificial Sequence: Synthetic coding sequence
atggaggagctgacagaggtgatcacagctgctgagttccacccccaccagtgcaatgtgtttgtgtacagcagcagcaagggcaccatccggctgtgtgacatgaggagcagcgccctgtgtgacagacacagcaagttctttgaggagcctgaggaccccagcagccgctccttcttcagcgagatcatcagcagcatcagtgatgtgaagttcagccacagcggccgctacatgatgacccgggaccctgtgggggagggcgtgggcccccagcacagagctggccgctggaggcccaccaggagcaccagcacctgtgccgccagcagcgccctgtccatgaggaccacagccagcctgaccagcctgtctgtggccggcaccgtgcgcatcgcccccagctag

SEQ ID NO: 166157 - DNA, 1269 bp, Artificial Sequence
  Description of Artificial Sequence: Synthetic coding sequence
ctgacagctgacatcatcagcacagtggagttcaactacagcggggacctgctggccaccggggacaagggcggccgggtggtgatcttccagcgggagcaggagaacaagagccggccccacagcagaggagagtacaacgtgtacagcaccttccagagccatgagcctgagtttgactacctgaagagcctggagattgaggagaagatcaacaagatccgctggctgccccagcagaatgctgcccacttcctgctgagcaccaatgacaagaccatcaagctgtggaagatcagcgagcgggacaagagagctgagggctacaacctgaaggatgaagatggccgcctgcgggaccccttccgcatcacagccctgcgggtgcccatcctgaagcccatggacctgatggtggaggccagcccccggcgcatctttgccaatgcccacacctaccacatcaacagcatctctgtgaacagcgaccacgagacctacctgtctgcagatgacctgcgcatcaacctgtggcacctggagatcacagacaggagcttcaacatcgtggacatcaagccagccaacatggaggagctgacagaggtgatcacagctgctgagttccacccccaccagtgcaatgtgtttgtgtacagcagcagcaagggcaccatccggctgtgtgacatgaggagcagcgccctgtgtgacagacacagcaagttctttgaggagcctgaggaccccagcagccgctccttcttcagcgagatcatcagcagcatcagtgatgtgaagttcagccacagcggccgctacatgatgacccgggactacctgtctgtgaaggtgtgggacctgaacatggagagcaggcctgtggagacccaccaggtgcatgagtacctgcggagcaagctgtgcagcctgtatgaaaatgactgcatctttgacaagtttgagtgctgctggaatggaagtgacagcgccatcatgacaggcagctacaacaacttcttcaggatgtttgaccgggacaccaggagagatgtgaccctggaggccagccgggagagcagcaagccccgggccagcctgaagcccaggaaggtgtgcaccggcggcaagaggaggaaggatgagatctctgtggacagcctggacttcaacaagaagatcctgcacacagcctggcaccctgtggacaacgtgattgctgtggccgccaccaacaacctgtacatcttccaggacaagatcaactag

SEQ ID NO: 166158 - DNA, 1713 bp, Artificial Sequence
  Description of Artificial Sequence: Synthetic coding sequence
atgccctacaagctgaagaaggagaaggagccccccaaggtggccaagtgcacagccaagcccagcagcagcggcaaggatggcggcggagaaaatacagaggaggcccagccccagccccagccccagccccagccccaggcccagagccagccccccagcagcaacaagaggcccagcaacagcaccccaccacccacccagctgagcaagatcaagtacagcggcggcccccagatcgtgaagaaggagctgttcatccagaagctgcggcagtgctgcgtgctgtttgattttgtgtctgaccccctgagtgacctgaagttcaaggaggtgaagagagctggcctgaatgagatggtggagtacatcacccacagcagagatgtggtgacagaggccatctacccagaggccgtgaccatgttttctgtgaacctcttccgcaccctgccccccagcagcaaccccaccggggctgagtttgatcctgaggaggatgagcccaccctggaggccgcctggccccacctgcagctggtgtatgagttcttcctgcgcttcctggagagcccagacttccagcccaacatcgccaagaagtacatcgaccagaagtttgtgctggccctgctggacctgtttgattctgaggacccccgggagcgggacttcctgaagaccatcctgcaccgcatctacggcaagttcctgggcctgcgggcctacatccggcggcagatcaaccacatcttctaccgcttcatctatgaaacagagcaccacaatggaattgctgagctgctggagatcctgggcagcatcatcaatggatttgccctgcccctgaaggaggagcacaagatgttcctgatccgggtgctgctgcccctgcacaaggtgaagagcctgtctgtgtaccacccccagctggcctactgtgtggtgcagttcctggagaaggagagcagcctgacagagcccgtcatcgtgggcctgctgaagttctggcccaagacccacagccccaaggaggtgatgttcctgaatgagctggaggagatcctggatgtgattgagcccagcgagttcagcaaggtgatggagcccctcttccggcagctggccaagtgtgtgagcagcccccacttccaggtggccgagcgggccctgtactactggaacaatgagtacatcatgagcctcatcagtgacaatgctgcccgggtgctgcccatcatgtttcctgccctgtacagaaacagcaagagccactggaacaagaccatccacggcctcatctacaatgccctgaagctgttcatggagatgaaccagaagctgtttgatgactgcacccagcagtacaaggccgagaagcagaagggccgcttcaggatgaaggagcgggaggagatgtggcagaagattgaggagctggcccggctgaacccccagtaccccatgttccgggcccccccacccctgccccctgtgtacagcatggagacagagacccccacagctgaggacatccagctgctgaagaggacagtggagacagaagctgtgcagatgctgaaggacatcaagaaggagaaggtgctgctgcggaggaagtctgagctgccccaggatgtgtacaccatcaaggccctggaggcccacaagagagctgaggagttcctgacagccagccaggaggccctgtag

SEQ ID NO: 166159 - DNA, 1491 bp, Artificial Sequence
  Description of Artificial Sequence: Synthetic coding sequence
atgccctacaagctgaagaaggagaaggagctgttcatccagaagctgcggcagtgctgcgtgctgtttgattttgtgtctgaccccctgagtgacctgaagttcaaggaggtgaagagagctggcctgaatgagatggtggagtacatcacccacagcagagatgtggtgacagaggccatctacccagaggccgtgaccatgttttctgtgaacctcttccgcaccctgccccccagcagcaaccccaccggggctgagtttgatcctgaggaggatgagcccaccctggaggccgcctggccccacctgcagctggtgtatgagttcttcctgcgcttcctggagagcccagacttccagcccaacatcgccaagaagtacatcgaccagaagtttgtgctggccctgctggacctgtttgattctgaggacccccgggagcgggacttcctgaagaccatcctgcaccgcatctacggcaagttcctgggcctgcgggcctacatccggcggcagatcaaccacatcttctaccgcttcatctatgaaacagagcaccacaatggaattgctgagctgctggagatcctgggcagcatcatcaatggatttgccctgcccctgaaggaggagcacaagatgttcctgatccgggtgctgctgcccctgcacaaggtgaagagcctgtctgtgtaccacccccagctggcctactgtgtggtgcagttcctggagaaggagagcagcctgacagagcccgtcatcgtgggcctgctgaagttctggcccaagacccacagccccaaggaggtgatgttcctgaatgagctggaggagatcctggatgtgattgagcccagcgagttcagcaaggtgatggagcccctcttccggcagctggccaagtgtgtgagcagcccccacttccaggtggccgagcgggccctgtactactggaacaatgagtacatcatgagcctcatcagtgacaatgctgcccgggtgctgcccatcatgtttcctgccctgtacagaaacagcaagagccactggaacaagaccatccacggcctcatctacaatgccctgaagctgttcatggagatgaaccagaagctgtttgatgactgcacccagcagtacaaggccgagaagcagaagggccgcttcaggatgaaggagcgggaggagatgtggcagaagattgaggagctggcccggctgaacccccagtaccccatgttccgggcccccccacccctgccccctgtgtacagcatggagacagagacccccacagctgaggacatccagctgctgaagaggacagtggagacagaagctgtgcagatgctgaaggacatcaagaaggagaaggtgctgctgcggaggaagtctgagctgccccaggatgtgtacaccatcaaggccctggaggcccacaagagagctgaggagttcctgacagccagccaggaggccctgtag

SEQ ID NO: 166160 - DNA, 1515 bp, Artificial Sequence
  Description of Artificial Sequence: Synthetic coding sequence
tgaaagaaggagcggcggcagagcagcagccgcttcaacctgagcaagaaccgggagctgcagaagctgcctgccctgaaggacagccccacccaggagcgggaggagctgttcatccagaagctgcggcagtgctgcgtgctgtttgattttgtgtctgaccccctgagtgacctgaagttcaaggaggtgaagagagctggcctgaatgagatggtggagtacatcacccacagcagagatgtggtgacagaggccatctacccagaggccgtgaccatgttttctgtgaacctcttccgcaccctgccccccagcagcaaccccaccggggctgagtttgatcctgaggaggatgagcccaccctggaggccgcctggccccacctgcagctggtgtatgagttcttcctgcgcttcctggagagcccagacttccagcccaacatcgccaagaagtacatcgaccagaagtttgtgctggccctgctggacctgtttgattctgaggacccccgggagcgggacttcctgaagaccatcctgcaccgcatctacggcaagttcctgggcctgcgggcctacatccggcggcagatcaaccacatcttctaccgcttcatctatgaaacagagcaccacaatggaattgctgagctgctggagatcctgggcagcatcatcaatggatttgccctgcccctgaaggaggagcacaagatgttcctgatccgggtgctgctgcccctgcacaaggtgaagagcctgtctgtgtaccacccccaggtgattgtgggcctgctgaagttctggcccaagacccacagccccaaggaggtgatgttcctgaatgagctggaggagatcctggatgtgattgagcccagcgagttcagcaaggtgatggagcccctcttccggcagctggccaagtgtgtgagcagcccccacttccaggtggccgagcgggccctgtactactggaacaatgagtacatcatgagcctcatcagtgacaatgctgcccgggtgctgcccatcatgtttcctgccctgtacagaaacagcaagagccactggaacaagaccatccacggcctcatctacaatgccctgaagctgttcatggagatgaaccagaagctgtttgatgactgcacccagcagtacaaggccgagaagcagaagggccgcttcaggatgaaggagcgggaggagatgtggcagaagattgaggagctggcccggctgaacccccagtaccccatgttccgggcccccccacccctgccccctgtgtacagcatggagacagagacccccacagctgaggacatccagctgctgaagaggacagtggagacagaagctgtgcagatgctgaaggacatcaagaaggagaaggtgctgctgcggaggaagtctgagctgccccaggatgtgtacaccatcaaggccctggaggcccacaagagagctgaggagttcctgacagccagccaggaggccctgtag

SEQ ID NO: 166161 - DNA, 1809 bp, Artificial Sequence
  Description of Artificial Sequence: Synthetic coding sequence
atgccctacaagctgaagaaggagaaggagccccccaaggtggccaagtgcacagccaagcccagcagcagcggcaaggatggcggcggagaaaatacagaggaggcccagccccagccccagccccagccccagccccaggcccagagccagccccccagcagcaacaagaggcccagcaacagcaccccaccacccacccagctgagcaagatcaagtacagcggcggcccccagatcgtgaagaaggagcggcggcagagcagcagccgcttcaacctgagcaagaaccgggagctgcagaagctgcctgccctgaaggacagccccacccaggagcgggaggagctgttcatccagaagctgcggcagtgctgcgtgctgtttgattttgtgtctgaccccctgagtgacctgaagttcaaggaggtgaagagagctggcctgaatgagatggtggagtacatcacccacagcagagatgtggtgacagaggccatctacccagaggccgtgaccatgttttctgtgaacctcttccgcaccctgccccccagcagcaaccccaccggggctgagtttgatcctgaggaggatgagcccaccctggaggccgcctggccccacctgcagctggtgtatgagttcttcctgcgcttcctggagagcccagacttccagcccaacatcgccaagaagtacatcgaccagaagtttgtgctggccctgctggacctgtttgattctgaggacccccgggagcgggacttcctgaagaccatcctgcaccgcatctacggcaagttcctgggcctgcgggcctacatccggcggcagatcaaccacatcttctaccgcttcatctatgaaacagagcaccacaatggaattgctgagctgctggagatcctgggcagcatcatcaatggatttgccctgcccctgaaggaggagcacaagatgttcctgatccgggtgctgctgcccctgcacaaggtgaagagcctgtctgtgtaccacccccagctggcctactgtgtggtgcagttcctggagaaggagagcagcctgacagagcccgtcatcgtgggcctgctgaagttctggcccaagacccacagccccaaggaggtgatgttcctgaatgagctggaggagatcctggatgtgattgagcccagcgagttcagcaaggtgatggagcccctcttccggcagctggccaagtgtgtgagcagcccccacttccaggtggccgagcgggccctgtactactggaacaatgagtacatcatgagcctcatcagtgacaatgctgcccgggtgctgcccatcatgtttcctgccctgtacagaaacagcaagagccactggaacaagaccatccacggcctcatctacaatgccctgaagctgttcatggagatgaaccagaagctgtttgatgactgcacccagcagtacaaggccgagaagcagaagggccgcttcaggatgaaggagcgggaggagatgtggcagaagattgaggagctggcccggctgaacccccagtaccccatgttccgggcccccccacccctgccccctgtgtacagcatggagacagagacccccacagctgaggacatccagctgctgaagaggacagtggagacagaagctgtgcagatgctgaaggacatcaagaaggagaaggtgctgctgcggaggaagtctgagctgccccaggatgtgtacaccatcaaggccctggaggcccacaagagagctgaggagttcctgacagccagccaggaggccctgtag

SEQ ID NO: 166162 - DNA, 1755 bp, Artificial Sequence
  Description of Artificial Sequence: Synthetic coding sequence
atgccctacaagctgaagaaggagaaggagccccccaaggtggccaagtgcacagccaagcccagcagcagcggcaaggatggcggcggagaaaatacagaggaggcccagccccagccccagccccagccccagccccaggcccagagccagccccccagcagcaacaagaggcccagcaacagcaccccaccacccacccagctgagcaagatcaagtacagcggcggcccccagatcgtgaagaaggagcggcggcagagcagcagccgcttcaacctgagcaagaaccgggagctgcagaagctgcctgccctgaaggacagccccacccaggagcgggaggagctgttcatccagaagctgcggcagtgctgcgtgctgtttgattttgtgtctgaccccctgagtgacctgaagttcaaggaggtgaagagagctggcctgaatgagatggtggagtacatcacccacagcagagatgtggtgacagaggccatctacccagaggccgtgaccatgttttctgtgaacctcttccgcaccctgccccccagcagcaaccccaccggggctgagtttgatcctgaggaggatgagcccaccctggaggccgcctggccccacctgcagctggtgtatgagttcttcctgcgcttcctggagagcccagacttccagcccaacatcgccaagaagtacatcgaccagaagtttgtgctggccctgctggacctgtttgattctgaggacccccgggagcgggacttcctgaagaccatcctgcaccgcatctacggcaagttcctgggcctgcgggcctacatccggcggcagatcaaccacatcttctaccgcttcatctatgaaacagagcaccacaatggaattgctgagctgctggagatcctgggcagcatcatcaatggatttgccctgcccctgaaggaggagcacaagatgttcctgatccgggtgctgctgcccctgcacaaggtgaagagcctgtctgtgtaccacccccaggtgattgtgggcctgctgaagttctggcccaagacccacagccccaaggaggtgatgttcctgaatgagctggaggagatcctggatgtgattgagcccagcgagttcagcaaggtgatggagcccctcttccggcagctggccaagtgtgtgagcagcccccacttccaggtggccgagcgggccctgtactactggaacaatgagtacatcatgagcctcatcagtgacaatgctgcccgggtgctgcccatcatgtttcctgccctgtacagaaacagcaagagccactggaacaagaccatccacggcctcatctacaatgccctgaagctgttcatggagatgaaccagaagctgtttgatgactgcacccagcagtacaaggccgagaagcagaagggccgcttcaggatgaaggagcgggaggagatgtggcagaagattgaggagctggcccggctgaacccccagtaccccatgttccgggcccccccacccctgccccctgtgtacagcatggagacagagacccccacagctgaggacatccagctgctgaagaggacagtggagacagaagctgtgcagatgctgaaggacatcaagaaggagaaggtgctgctgcggaggaagtctgagctgccccaggatgtgtacaccatcaaggccctggaggcccacaagagagctgaggagttcctgacagccagccaggaggccctgtag

SEQ ID NO: 166163 - DNA, 1404 bp, Artificial Sequence
  Description of Artificial Sequence: Synthetic coding sequence
atgagcagcgcccccaccaccccacccagcgtggacaaggtggatggcttcagcaggaagtctgtgaggaaggcccggcagaagaggagccagagcagcagccagttccgcagccagggcaagcccatcgagctgacccccctgcccctgctgaaggatgtgcccagcagcgagcagcctgagctgttcctgaagaagctgcagcagtgctgcgtcatctttgacttcatggacaccctgagtgacctgaagatgaaggagtacaagaggagcaccctgaatgagctggtggactacatcaccatcagccggggctgcctgacagagcagacctacccagaggtggtgaggatggtgtcctgcaacatcttccgcaccctgccccccagcgacagcaatgaatttgatcctgaagaagatgagcccaccctggaggcctcctggccccacctgcagctggtgtatgagttcttcatccgcttcctggagagccaggagttccagcccagcatcgccaagaagtacatcgaccagaagtttgtgctgcagctgctggagctgtttgacagcgaggacccccgggagcgggactacctgaagacagtgctgcaccgcatctacggcaagttcctgggcctgcgggccttcatcaggaagcagatcaacaacatcttcctgcgctttgtgtatgaaacagagcacttcaacggggtggccgagctgctggagatcctgggcagcatcatcaatggatttgccctgcccctgaaggccgagcacaagcagttcctggtgaaggtgctgatccccctgcacacagtgcgcagcctgagcctcttccacgcccagctggcctactgcatcgtgcagttcctggagaaggaccccagcctgacagagcctgtgatccggggcctgatgaagttctggcccaagacctgcagccagaaggaggtgatgttcctgggggagctggaggagatcctggatgtgattgagcccagccagtttgtgaagatccaggagcccctcttcaagcagatcgccaagtgtgtgagcagcccccacttccaggtggccgagcgggccctgtactactggaacaatgagtacatcatgagcctcatcgaggagaacagcaatgtcatcctgcccatcatgttcagcagcctgtaccgcatcagcaaggagcactggaacccagccatcgtggccctggtgtacaacgtgctgaaggccttcatggagatgaacagcaccatgtttgatgagctgacagccacctacaagagtgaccggcagcgggagaagaagaaggagaaggagcgggaggagctgtggaagaagctggaggacctggagctgaagaggggcctgcggagagatggcatcatccccacctag

SEQ ID NO: 166164 - DNA, 1176 bp, Artificial Sequence
  Description of Artificial Sequence: Synthetic coding sequence
atggacaccctgagtgacctgaagatgaaggagtacaagaggagcaccctgaatgagctggtggactacatcaccatcagccggggctgcctgacagagcagacctacccagaggtggtgaggatggtgtcctgcaacatcttccgcaccctgccccccagcgacagcaatgaatttgatcctgaagaagatgagcccaccctggaggcctcctggccccacctgcagctggtgtatgagttcttcatccgcttcctggagagccaggagttccagcccagcatcgccaagaagtacatcgaccagaagtttgtgctgcagctgctggagctgtttgacagcgaggacccccgggagcgggactacctgaagacagtgctgcaccgcatctacggcaagttcctgggcctgcgggccttcatcaggaagcagatcaacaacatcttcctgcgctttgtgtatgaaacagagcacttcaacggggtggccgagctgctggagatcctgggcagcatcatcaatggatttgccctgcccctgaaggccgagcacaagcagttcctggtgaaggtgctgatccccctgcacacagtgcgcagcctgagcctcttccacgcccagctggcctactgcatcgtgcagttcctggagaaggaccccagcctgacagagcctgtgatccggggcctgatgaagttctggcccaagacctgcagccagaaggaggtgatgttcctgggggagctggaggagatcctggatgtgattgagcccagccagtttgtgaagatccaggagcccctcttcaagcagatcgccaagtgtgtgagcagcccccacttccaggtggccgagcgggccctgtactactggaacaatgagtacatcatgagcctcatcgaggagaacagcaatgtcatcctgcccatcatgttcagcagcctgtaccgcatcagcaaggagcactggaacccagccatcgtggccctggtgtacaacgtgctgaaggccttcatggagatgaacagcaccatgtttgatgagctgacagccacctacaagagtgaccggcagcgggagaagaagaaggagaaggagcgggaggagctgtggaagaagctggaggacctggagctgaagaggggcctgcggagagatggcatcatccccacctag

SEQ ID NO: 166165 - DNA, 1389 bp, Artificial Sequence
  Description of Artificial Sequence: Synthetic coding sequence
atgagcagcgcccccaccaccccacccagcgtggacaaggtggatggcttcagcaggaagtctgtgaggaaggcccggcagaagaggagccagagcagcagccagttccgcagccagggcaagcccatcgagctgacccccctgcccctgctgaaggatgtgcccagcagcgagcagcctgagctgttcctgaagaagctgcagcagtgctgcgtcatctttgacttcatggacaccctgagtgacctgaagatgaaggagtacaagaggagcaccctgaatgagctggtggactacatcaccatcagccggggctgcctgacagagcagacctacccagaggtggtgaggatggtgtcctgcaacatcttccgcaccctgccccccagcgacagcaatgaatttgatcctgaagaagatgagcccaccctggaggcctcctggccccacctgcagctggtgtatgagttcttcatccgcttcctggagagccaggagttccagcccagcatcgccaagaagtacatcgaccagaagtttgtgctgcagctgctggagctgtttgacagcgaggacccccgggagcgggactacctgaagacagtgctgcaccgcatctacggcaagttcctgggcctgcgggccttcatcaggaagcagatcaacaacatcttcctgcgctttgtgtatgaaacagagcacttcaacggggtggccgagctgctggagatcctgggcagcatcatcaatggatttgccctgcccctgaaggccgagcacaagcagttcctggtgaaggtgctgatccccctgcacacagtgcgcagcctgagcctcttccacgcccagctggcctactgcatcgtgcagttcctggagaaggaccccagcctgacagagcctgtgatccggggcctgatgaagttctggcccaagacctgcagccagaaggaggtgatgttcctgggggagctggaggagatcctggatgtgattgagcccagccagtttgtgaagatccaggagcccctcttcaagcagatcgccaagtgtgtgagcagcccccacttccaggtggccgagcgggccctgtactactggaacaatgagtacatcatgagcctcatcgaggagaacagcaatgtcatcctgcccatcatgttcagcagcctgtaccgcatcagcaaggagcactggaacccagccatcgtggccctggtgtacaacgtgctgaaggccttcatggagatgaacagcaccatgtttgatgagctgacagccacctacaatgagaagaagaaggagaaggagcgggaggagctgtggaagaagctggaggacctggagctgaagaggggcctgcggagagatggcatcatccccacctag

SEQ ID NO: 166166 - DNA, 1344 bp, Artificial Sequence
  Description of Artificial Sequence: Synthetic coding sequence
atgggcctgtccttcttcagcaagcacctgcccatccaggagggccagccctgggccctgaagaccccagctgacatcatcagcacagtggagttcaaccacactggagagctgctggccactggagacaagggcggccgggtggtgatcttccagcgggagcctgagagcaagaatgccccccacagccagggcgagtatgatgtgtacagcaccttccagagccatgagcctgagtttgactacctgaagagcctggagattgaggagaagatcaacaagatcaagtggctgccccagcagaatgctgcccacagcctgctgagcaccaatgacaagaccatcaagctgtggaagatcacagagcgggacaagaggcctgagggctacaacctgaaggatgaggagggcaagctgaaggacctgagcacagtgaccagcctgcaggtgcctgtgctgaagcccatggacctgatggtggaggtgagcccccggcgcatctttgccaacggccacacctaccacatcaacagcatctctgtgaacagcgactgtgagacctacatgtctgcagatgacctgcgcatcaacctgtggcacctggccatcacagaccgctccttcaacatcgtggacatcaagccagccaacatggaggacctgacagaggtgatcacagccagcgagttccacccccaccactgcaacctgtttgtgtacagcagcagcaagggcagcctgcggctgtgtgacatgagagctgctgccctgtgtgacaagcacagcaagctgtttgaggagcctgaggaccccagcaacagaagcttcttcagcgagatcatcagctctgtgtctgatgtgaagttcagccacagcggccgctacatgctgacccgggactacctgactgtgaaggtgtgggacctgaacatggaggcccggcccatcgagacctaccaggtgcatgactacctgcggagcaagctgtgcagcctgtatgaaaatgactgcatctttgacaagtttgaatgtgcctggaatggaagtgacagcgtcatcatgactggagcctacaacaacttcttcaggatgtttgacaggaacaccaagagagatgtgaccctggaggccagccgggagagcagcaagcccagggctgtgctgaagcccaggagagtgtgtgtgggcggcaagagaagaagagatgacatctctgtggacagcctggacttcaccaagaagatcctgcacacagcctggcaccctgctgagaacatcatcgccatcgccgccaccaacaacctgtacatcttccaggacaaggtgaacagcgacatgcactag

SEQ ID NO: 166167 - DNA, 1344 bp, Artificial Sequence
  Description of Artificial Sequence: Synthetic coding sequence
atgggagaggacacagacaccaggaagatcaaccacagcttcctgcgggaccacagctatgtgacagaggccgacatcatcagcacagtggagttcaaccacactggagagctgctggccactggagacaagggcggccgggtggtgatcttccagcgggagcctgagagcaagaatgccccccacagccagggcgagtatgatgtgtacagcaccttccagagccatgagcctgagtttgactacctgaagagcctggagattgaggagaagatcaacaagatcaagtggctgccccagcagaatgctgcccacagcctgctgagcaccaatgacaagaccatcaagctgtggaagatcacagagcgggacaagaggcctgagggctacaacctgaaggatgaggagggcaagctgaaggacctgagcacagtgaccagcctgcaggtgcctgtgctgaagcccatggacctgatggtggaggtgagcccccggcgcatctttgccaacggccacacctaccacatcaacagcatctctgtgaacagcgactgtgagacctacatgtctgcagatgacctgcgcatcaacctgtggcacctggccatcacagaccgctccttcaacatcgtggacatcaagccagccaacatggaggacctgacagaggtgatcacagccagcgagttccacccccaccactgcaacctgtttgtgtacagcagcagcaagggcagcctgcggctgtgtgacatgagagctgctgccctgtgtgacaagcacagcaagctgtttgaggagcctgaggaccccagcaacagaagcttcttcagcgagatcatcagctctgtgtctgatgtgaagttcagccacagcggccgctacatgctgacccgggactacctgactgtgaaggtgtgggacctgaacatggaggcccggcccatcgagacctaccaggtgcatgactacctgcggagcaagctgtgcagcctgtatgaaaatgactgcatctttgacaagtttgaatgtgcctggaatggaagtgacagcgtcatcatgactggagcctacaacaacttcttcaggatgtttgacaggaacaccaagagagatgtgaccctggaggccagccgggagagcagcaagcccagggctgtgctgaagcccaggagagtgtgtgtgggcggcaagagaagaagagatgacatctctgtggacagcctggacttcaccaagaagatcctgcacacagcctggcaccctgctgagaacatcatcgccatcgccgccaccaacaacctgtacatcttccaggacaaggtgaacagcgacatgcactag

SEQ ID NO: 166168 - DNA, 1323 bp, Artificial Sequence
  Description of Artificial Sequence: Synthetic coding sequence
atgagggaggccgacaccctgcggcccccccagctgatggaggtgtctgctgacatcatcagcacagtggagttcaaccacactggagagctgctggccaccggggacaagggcggccgggtggtgatcttccagcgggagcctgagagcaagaatgccccccacagccagggcgagtatgatgtgtacagcaccttccagagccatgagcctgagtttgactacctgaagagcctggagattgaggagaagatcaacaagatcaagtggctgccccagcagaatgctgcccacagcctgctgagcaccaatgacaagaccatcaagctgtggaagatcacagagcgggacaagaggcctgagggctacaacctgaaggatgaggagggcaagctgaaggacctgagcacagtgaccagcctgcaggtgcctgtgctgaagcccatggacctgatggtggaggtgagcccccggcgcatctttgccaacggccacacctaccacatcaacagcatctctgtgaacagcgactgtgagacctacatgtctgcagatgacctgcgcatcaacctgtggcacctggccatcacagacaggagcttcaacatcgtggacatcaagccagccaacatggaggacctgacagaggtgatcacagccagcgagttccacccccaccactgcaacctgtttgtgtacagcagcagcaagggcagcctgcggctgtgtgacatgagagctgctgccctgtgtgacaagcacagcaagctgtttgaggagcctgaggaccccagcaacagaagcttcttcagcgagatcatcagctctgtgtctgatgtgaagttcagccacagcggccgctacatgctgacccgggactacctgactgtgaaggtgtgggacctgaacatggaggcccggcccatcgagacctaccaggtgcatgactacctgcggagcaagctgtgcagcctgtatgaaaatgactgcatctttgacaagtttgaatgtgcctggaatggaagtgacagcgtcatcatgaccggggcctacaacaacttcttcaggatgtttgacaggaacaccaagagagatgtgaccctggaggccagccgggagagcagcaagcccagggctgtgctgaagccccggcgggtgtgtgtgggcggcaagagaagaagagatgacatctctgtggacagcctggacttcaccaagaagatcctgcacacagcctggcaccctgctgagaacatcatcgccatcgccgccaccaacaacctgtacatcttccaggacaaggtgaacagcgacatgcactag

SEQ ID NO: 166169 - DNA, 1323 bp, Artificial Sequence; identical to SEQ ID NO: 166168
  Description of Artificial Sequence: Synthetic coding sequence

SEQ ID NO: 166170 - DNA, 1293 bp, Artificial Sequence
  Description of Artificial Sequence: Synthetic coding sequence
atgggcaagagggacacagctgacatcatcagcacagtggagttcaaccacactggagagctgctggccaccggggacaagggcggccgggtggtgatcttccagcgggagcctgagagcaagaatgccccccacagccagggcgagtatgatgtgtacagcaccttccagagccatgagcctgagtttgactacctgaagagcctggagattgaggagaagatcaacaagatcaagtggctgccccagcagaatgctgcccacagcctgctgagcaccaatgacaagaccatcaagctgtggaagatcacagagcgggacaagaggcctgagggctacaacctgaaggatgaggagggcaagctgaaggacctgagcacagtgaccagcctgcaggtgcctgtgctgaagcccatggacctgatggtggaggtgagcccccggcgcatctttgccaacggccacacctaccacatcaacagcatctctgtgaacagcgactgtgagacctacatgtctgcagatgacctgcgcatcaacctgtggcacctggccatcacagacaggagcttcaacatcgtggacatcaagccagccaacatggaggacctgacagaggtgatcacagccagcgagttccacccccaccactgcaacctgtttgtgtacagcagcagcaagggcagcctgcggctgtgtgacatgagagctgctgccctgtgtgacaagcacagcaagctgtttgaggagcctgaggaccccagcaacagaagcttcttcagcgagatcatcagctctgtgtctgatgtgaagttcagccacagcggccgctacatgctgacccgggactacctgactgtgaaggtgtgggacctgaacatggaggcccggcccatcgagacctaccaggtgcatgactacctgcggagcaagctgtgcagcctgtatgaaaatgactgcatctttgacaagtttgaatgtgcctggaatggaagtgacagcgtcatcatgaccggggcctacaacaacttcttcaggatgtttgacaggaacaccaagagagatgtgaccctggaggccagccgggagagcagcaagcccagggctgtgctgaagccccggcgggtgtgtgtgggcggcaagagaagaagagatgacatctctgtggacagcctggacttcaccaagaagatcctgcacacagcctggcaccctgctgagaacatcatcgccatcgccgccaccaacaacctgtacatcttccaggacaaggtgaacagcgacatgcactag

SEQ ID NO: 166171 - DNA, 1623 bp, Artificial Sequence
  Description of Artificial Sequence: Synthetic coding sequence
atgcccaacaagaacaagaaggagaaggagagccccaaggccggcaagagcggcaagagcagcaaggagggccaggacacagtggagagcgagcagatctctgtgaggaagaacagcctggtggccgtgcccagcacagtgtctgccaagatcaaggtgcctgtgtcccagcccatcgtgaagaaggacaagaggcagaacagcagccgcttcagcgccagcaacaaccgggagctgcagaagctgcccagcctgaaggatgtgcccccagctgaccaggagaagctgttcatccagaagctgcggcagtgctgcgtgctgtttgattttgtgtctgaccccctgagtgacctgaagtggaaggaggtgaagagagctgccctgtctgagatggtggagtacatcacccacaacagaaatgtcatcacagagcccatctacccagaggtggtgcacatgtttgctgtgaacatgttccgcaccctgccccccagcagcaaccccactggagctgagtttgatcctgaagaagatgagcccaccctggaggccgcctggccccacctgcagctggtgtatgagttcttcctgcgcttcctggagagcccagacttccagcccaacatcgccaagaagtacatcgaccagaagtttgtgctgcagctgctggagctgtttgacagcgaggacccccgggagcgggacttcctgaagaccaccctgcaccgcatctacggcaagttcctgggcctgcgggcctacatcaggaagcagatcaacaacatcttctaccgcttcatctatgaaacagagcaccacaacggcattgctgagctgctggagatcctgggcagcatcatcaatggatttgccctgcccctgaaggaggagcacaagatcttcctgctgaaggtgctgctgcccctgcacaaggtgaagagcctgtctgtgtaccacccccagctggcctactgtgtggtgcagttcctggagaaggacagcaccctgacagagcctgtggtgatggccctgctgaagtactggcccaagacccacagccccaaggaggtgatgttcctgaatgagctggaggagatcctggatgtgattgagcccagcgagtttgtgaagatcatggagcccctcttccggcagctggccaagtgtgtgagcagcccccacttccaggtggccgagcgggccctgtactactggaacaatgagtacatcatgagcctcatcagtgacaatgctgccaagatcctgcccatcatgttccccagcctgtacagaaacagcaagacccactggaacaagaccatccacggcctcatctacaatgccctgaagctgttcatggagatgaaccagaagctgtttgatgactgcacccagcagttcaaggccgagaagctgaaggagaagctgaagatgaaggagcgggaggaggcctgggtgaagattgagaacctggccaaggccaacccccaggcccagaaggaccccaagaaggaccggcccctggcccggaggaagtctgagctgccccaggacccccacaccaagaaggccctggaggcccactgcagagcagatgagctggccagccaggacggccgctag

SEQ ID NO: 166172 - DNA, 1575 bp, Artificial Sequence
  Description of Artificial Sequence: Synthetic coding sequence
atgctgacctgcaacaaggccggcagcaggatggtggtggatgctgccaacagcaatggccccttccagcctgtggtgctgctgcacatcagagatgtgcccccagctgaccaggagaagctgttcatccagaagctgcggcagtgctgcgtgctgtttgattttgtgtctgaccccctgagtgacctgaagtggaaggaggtgaagagagctgccctgtctgagatggtggagtacatcacccacaacagaaatgtcatcacagagcccatctacccagaggtggtgcacatgtttgctgtgaacatgttccgcaccctgccccccagcagcaaccccaccggggctgagtttgatcctgaggaggatgagcccaccctggaggccgcctggccccacctgcagctggtgtatgagttcttcctgcgcttcctggagagcccagacttccagcccaacatcgccaagaagtacatcgaccagaagtttgtgctgcagctgctggagctgtttgattctgaggacccccgggagcgggacttcctgaagaccaccctgcaccgcatctacggcaagttcctgggcctgcgggcctacatcaggaagcagatcaacaacatcttctaccgcttcatctatgaaacagagcaccacaatggaattgctgagctgctggagatcctgggcagcatcatcaatggatttgccctgcccctgaaggaggagcacaagatcttcctgctgaaggtgctgctgcccctgcacaaggtgaagagcctgtctgtgtaccacccccagctggcctactgtgtggtgcagttcctggagaaggacagcaccctgacagagcctgtggtgatggccctgctgaagtactggcccaagacccacagccccaaggaggtgatgttcctgaatgagctggaggagatcctggatgtgattgagcccagcgagtttgtgaagatcatggagcccctcttccggcagctggccaagtgtgtgagcagcccccacttccaggtggccgagcgggccctgtactactggaacaatgagtacatcatgagcctcatcagtgacaatgctgccaagatcctgcccatcatgttccccagcctgtacagaaacagcaagacccactggaacaagaccatccacggcctcatctacaatgccctgaagctgttcatggagatgaaccagaagctgtttgatgactgcacccagcagttcaaggccgagaagctgaaggagaagctgaagatgaaggagcgggaggaggcctgggtgaagattgagaacctggccaaggccaacccccagtacacagtgtacagccaggccagcaccatgagcatccctgtggccatggagacagatggccccctgtttgaagatgtgcagatgctgaggaagacagtgaaggatgaggcccaccaggcccagaaggaccccaagaaggaccggcccctggcccggaggaagtctgagctgccccaggacccccacaccaagaaggccctggaggcccactgcagagcagatgagctggccagccaggacggccgctag

SEQ ID NO: 166173 - DNA, 783 bp, Artificial Sequence
  Description of Artificial Sequence: Synthetic coding sequence
atgttccgcaccctgccccccagcagcaaccccaccggggctgagtttgatcctgaggaggatgagcccaccctggaggccgcctggccccacctgcagctggtgtatgagttcttcctgcgcttcctggagagcccagacttccagcccaacatcgccaagaagtacatcgaccagaagtttgtgctgcagctgctggagctgtttgattctgaggacccccgggagcgggacttcctgaagaccaccctgcaccgcatctacggcaagttcctgggcctgcgggcctacatcaggaagcagatcaacaacatcttctaccgcttcatctatgaaacagagcaccacaatggaattgctgagctgctggagatcctgggcagcatcatcaatggatttgccctgcccctgaaggaggagcacaagatcttcctgctgaaggtgctgctgcccctgcacaaggtgaagagcctgtctgtgtaccacccccagctggcctactgtgtggtgcagttcctggagaaggacagcaccctgacagagcctgtggtgatggccctgctgaagtactggcccaagacccacagccccaaggaggtgatgttcctgaatgagctggaggagatcctggatgtgattgagcccagcgagtttgtgaagatcatggagcccctcttccggcagctggccaagtgtgtgagcagcccccacttccaggacaacacctggctggacatccagaggcctgaggccctgcatggagatgagcccaaggccatctag

SEQ ID NO: 166174 - DNA, 1458 bp, Artificial Sequence
  Description of Artificial Sequence: Synthetic coding sequence
atgctgacctgcaacaaggccggcagcaggatggtggtggatgctgccaacagcaatggccccttccagcctgtggtgctgctgcacatcagagatgtgcccccagctgaccaggagaagctgttcatccagaagctgcggcagtgctgcgtgctgtttgattttgtgtctgaccccctgagtgacctgaagtggaaggaggtgaagagagctgccctgtctgagatggtggagtacatcacccacaacagaaatgtcatcacagagcccatctacccagaggtggtgcacatgtttgctgtgaacatgttccgcaccctgccccccagcagcaaccccaccggggctgagtttgatcctgaggaggatgagcccaccctggaggccgcctggccccacctgcagctggtgtatgagttcttcctgcgcttcctggagagcccagacttccagcccaacatcgccaagaagtacatcgaccagaagtttgtgctgcagctgctggagctgtttgattctgaggacccccgggagcgggacttcctgaagaccaccctgcaccgcatctacggcaagttcctgggcctgcgggcctacatcaggaagcagatcaacaacatcttctaccgcttcatctatgaaacagagcaccacaatggaattgctgagctgctggagatcctgggcagcatcatcaatggatttgccctgcccctgaaggaggagcacaagatcttcctgctgaaggtgctgctgcccctgcacaaggtgaagagcctgtctgtgtaccacccccagctggcctactgtgtggtgcagttcctggagaaggacagcaccctgacagagcctgtggtgatggccctgctgaagtactggcccaagacccacagccccaaggaggtgatgttcctgaatgagctggaggagatcctggatgtgattgagcccagcgagtttgtgaagatcatggagcccctcttccggcagctggccaagtgtgtgagcagcccccacttccaggtggccgagcgggccctgtactactggaacaatgagtacatcatgagcctcatcagtgacaatgctgccaagatcctgcccatcatgttccccagcctgtacagaaacagcaagacccactggaacaagaccatccacggcctcatctacaatgccctgaagctgttcatggagatgaaccagaagctgtttgatgactgcacccagcagttcaaggccgagaagctgaaggagaagctgaagatgaaggagcgggaggaggcctgggtgaagattgagaacctggccaaggccaacccccaggcccagaaggaccccaagaaggaccggcccctggcccggaggaagtctgagctgccccaggacccccacaccaagaaggccctggaggcccactgcagagcagatgagctggccagccaggatggaagatag

SEQ ID NO: 166175 - DNA, 1668 bp, Artificial Sequence
  Description of Artificial Sequence: Synthetic coding sequence
atgcccaacaagaacaagaaggagaaggagagccccaaggccggcaagagcggcaagagcagcaaggagggccaggacacagtggagagcgagggcaccagccctgaggagcccagcagccccaaggtgcccccacccctgctgcctgagctgctggtgctgatctttggaggcctgcagggcagagatgtgcccccagctgaccaggagaagctgttcatccagaagctgcggcagtgctgcgtgctgtttgattttgtgtctgaccccctgagtgacctgaagtggaaggaggtgaagagagctgccctgtctgagatggtggagtacatcacccacaacagaaatgtcatcacagagcccatctacccagaggtggtgcacatgtttgctgtgaacatgttccgcaccctgccccccagcagcaaccccactggagctgagtttgatcctgaagaagatgagcccaccctggaggccgcctggccccacctgcagctggtgtatgagttcttcctgcgcttcctggagagcccagacttccagcccaacatcgccaagaagtacatcgaccagaagtttgtgctgcagctgctggagctgtttgacagcgaggacccccgggagcgggacttcctgaagaccaccctgcaccgcatctacggcaagttcctgggcctgcgggcctacatcaggaagcagatcaacaacatcttctaccgcttcatctatgaaacagagcaccacaacggcattgctgagctgctggagatcctgggcagcatcatcaatggatttgccctgcccctgaaggaggagcacaagatcttcctgctgaaggtgctgctgcccctgcacaaggtgaagagcctgtctgtgtaccacccccagctggcctactgtgtggtgcagttcctggagaaggacagcaccctgacagagcctgtggtgatggccctgctgaagtactggcccaagacccacagccccaaggaggtgatgttcctgaatgagctggaggagatcctggatgtgattgagcccagcgagtttgtgaagatcatggagcccctcttccggcagctggccaagtgtgtgagcagcccccacttccaggtggccgagcgggccctgtactactggaacaatgagtacatcatgagcctcatcagtgacaatgctgccaagatcctgcccatcatgttccccagcctgtacagaaacagcaagacccactggaacaagaccatccacggcctcatctacaatgccctgaagctgttcatggagatgaaccagaagctgtttgatgactgcacccagcagttcaaggccgagaagctgaaggagaagctgaagatgaaggagcgggaggaggcctgggtgaagattgagaacctggccaaggccaacccccagtacacagtgtacagccaggccagcaccatgagcatccctgtggccatggagacagatggccccctgtttgaagatgtgcagatgctgaggaagacagtgaaggatgaggcccaccaggcccagaaggaccccaagaaggaccggcccctggcccggaggaagtctgagctgccccaggacccccacaccaagaaggccctggaggcccactgcagagcagatgagctggccagccaggatggaagatag

SEQ ID NO: 166176 - DNA, 1350 bp, Artificial Sequence
  Description of Artificial Sequence: Synthetic coding sequence
atgctgacctgcaacaaggccggcagcaggatggtggtggatgctgccaacagcaatggccccttccagcctgtggtgctgctgcacatcagagatgtgcccccagctgaccaggagaagctgttcatccagaagctgcggcagtgctgcgtgctgtttgattttgtgtctgaccccctgagtgacctgaagtggaaggaggtgaagagagctgccctgtctgagatggtggagtacatcacccacaacagaaatgtcatcacagagcccatctacccagaggtggtgcacatgtttgctgtgaacatgttccgcaccctgccccccagcagcaaccccaccggggctgagtttgatcctgaggaggatgagcccaccctggaggccgcctggccccacctgcagctggtgtatgagttcttcctgcgcttcctggagagcccagacttccagcccaacatcgccaagaagtacatcgaccagaagtttgtgctgcagctgctggagctgtttgattctgaggacccccgggagcgggacttcctgaagaccaccctgcaccgcatctacggcaagttcctgggcctgcgggcctacatcaggaagcagatcaacaacatcttctaccgcttcatctatgaaacagagcaccacaatggaattgctgagctgctggagatcctgggcagcatcatcaatggatttgccctgcccctgaaggaggagcacaagatcttcctgctgaaggtgctgctgcccctgcacaaggtgaagagcctgtctgtgtaccacccccagctggcctactgtgtggtgcagttcctggagaaggacagcaccctgacagagcctgtggtgatggccctgctgaagtactggcccaagacccacagccccaaggaggtgatgttcctgaatgagctggaggagatcctggatgtgattgagcccagcgagtttgtgaagatcatggagcccctcttccggcagctggccaagtgtgtgagcagcccccacttccaggtggccgagcgggccctgtactactggaacaatgagtacatcatgagcctcatcagtgacaatgctgccaagatcctgcccatcatgttccccagcctgtacagaaacagcaagacccactggaacaagaccatccacggcctcatctacaatgccctgaagctgttcatggagatgaaccagaagctgtttgatgactgcacccagcagttcaaggccgagaagctgaaggagaagctgaagatgaaggagcgggaggaggcctgggtgaagattgagaacctggccaaggccaacccccaggtgctgaagaagaggatcacctag

SEQ ID NO: 166177 - DNA, 1155 bp, Artificial Sequence
  Description of Artificial Sequence: Synthetic coding sequence
atgctgacctgcaacaaggccggcagcaggatggtggtggatgctgccaacagcaatggccccttccagcctgtggtgctgctgcacatcagagatgtgcccccagctgaccaggagaagctgttcatccagaagctgcggcagtgctgcgtgctgtttgattttgtgtctgaccccctgagtgacctgaagtggaaggaggtgaagagagctgccctgtctgagatggtggagtacatcacccacaacagaaatgtcatcacagagcccatctacccagaggtggtgcacatgtttgctgtgaacatgttccgcaccctgccccccagcagcaaccccaccggggctgagtttgatcctgaggaggatgagcccaccctggaggccgcctggccccacctgcagctggtgtatgagttcttcctgcgcttcctggagagcccagacttccagcccaacatcgccaagaagtacatcgaccagaagtttgtgctgcagctgctggagctgtttgattctgaggacccccgggagcgggacttcctgaagaccaccctgcaccgcatctacggcaagttcctgggcctgcgggcctacatcaggaagcagatcaacaacatcttctaccgcttcatctatgaaacagagcaccacaatggaattgctgagctgctggagatcctgggcagcatcatcaatggatttgccctgcccctgaaggaggagcacaagatcttcctgctgaaggtgctgctgcccctgcacaaggtgaagagcctgtctgtgtaccacccccagctggcctactgtgtggtgcagttcctggagaaggacagcaccctgacagagcctgtggtgatggccctgctgaagtactggcccaagacccacagccccaaggaggtgatgttcctgaatgagctggaggagatcctggatgtgattgagcccagcgagtttgtgaagatcatggagcccctcttccggcagctggccaagtgtgtgagcagcccccacttccaggtggccgagcgggccctgtactactggaacaatgagtacatcatgagcctcatcagtgacaatgctgccaagatcctgcccatcatgttccccagcctgtacagaaacagcaagacccactggaacaagtag

SEQ ID NO: 166178 - DNA, 1662 bp, Artificial Sequence
  Description of Artificial Sequence: Synthetic coding sequence
aacaagaacaagaaggagaaggagagccccaaggccggcaagagcggcaagagcagcaaggagggccaggacacagtggagagcgagggcaccagccctgaggagcccagcagccccaaggtgcccccacccctgctgcctgagctgctggtgctgatctttggaggcctgcagggcagagatgtgcccccagctgaccaggagaagctgttcatccagaagctgcggcagtgctgcgtgctgtttgattttgtgtctgaccccctgagtgacctgaagtggaaggaggtgaagagagctgccctgtctgagatggtggagtacatcacccacaacagaaatgtcatcacagagcccatctacccagaggtggtgcacatgtttgctgtgaacatgttccgcaccctgccccccagcagcaaccccactggagctgagtttgatcctgaagaagatgagcccaccctggaggccgcctggccccacctgcagctggtgtatgagttcttcctgcgcttcctggagagcccagacttccagcccaacatcgccaagaagtacatcgaccagaagtttgtgctgcagctgctggagctgtttgacagcgaggacccccgggagcgggacttcctgaagaccaccctgcaccgcatctacggcaagttcctgggcctgcgggcctacatcaggaagcagatcaacaacatcttctaccgcttcatctatgaaacagagcaccacaacggcattgctgagctgctggagatcctgggcagcatcatcaatggatttgccctgcccctgaaggaggagcacaagatcttcctgctgaaggtgctgctgcccctgcacaaggtgaagagcctgtctgtgtaccacccccagctggcctactgtgtggtgcagttcctggagaaggacagcaccctgacagagcctgtggtgatggccctgctgaagtactggcccaagacccacagccccaaggaggtgatgttcctgaatgagctggaggagatcctggatgtgattgagcccagcgagtttgtgaagatcatggagcccctcttccggcagctggccaagtgtgtgagcagcccccacttccaggtggccgagcgggccctgtactactggaacaatgagtacatcatgagcctcatcagtgacaatgctgccaagatcctgcccatcatgttccccagcctgtacagaaacagcaagacccactggaacaagaccatccacggcctcatctacaatgccctgaagctgttcatggagatgaaccagaagctgtttgatgactgcacccagcagttcaaggccgagaagctgaaggagaagctgaagatgaaggagcgggaggaggcctgggtgaagattgagaacctggccaaggccaacccccagtacacagtgtacagccaggccagcaccatgagcatccctgtggccatggagacagatggccccctgtttgaagatgtgcagatgctgaggaagacagtgaaggatgaggcccaccaggcccagaaggaccccaagaaggaccggcccctggcccggaggaagtctgagctgccccaggacccccacaccaagaaggccctggaggcccactgcagagcagatgagctggccagccaggatggaagatag

SEQ ID NO: 166179 - DNA, 1077 bp, Artificial Sequence
  Description of Artificial Sequence: Synthetic coding sequence
atggccgagggggagcggcagcccccaccagacagcagcgaggaggcccccccagccacccagaacttcatcatccccaagaaggagatccacacagtgcctgacatgggcaagtggaagaggagccaggcctatgctgactacatcggcttcatcctgaccctgaatgaaggagtgaagggcaagaagctgacctttgagtacagagtgtctgagatgtggaatgaggtgcatgaggagaaggagcaggccgccaagcagagcgtgtcctgtgatgagtgcatccccctgccccgggccggccactgtgcccccagcgaggccatcgagaagctggtggccctgctgaacaccctggaccgctggattgatgagaccccacctgtggaccagcccagcagatttggaaacaaggcctaccgcacctggtacgccaagctggatgaggaggccgagaacctggtggccaccgtggtgcccacccacctggccgctgctgtgcctgaggtggccgtgtacctgaaggagagcgtgggcaacagcaccagaattgattatggcaccggccacgaggccgcctttgctgccttcctgtgctgcctgtgcaagattggagtgctgcgggtggatgaccagatcgccatcgtgttcaaggtgttcaaccgctacctggaggtgatgaggaagctgcagaagacctacaggatggagcctgctggcagccagggcgtgtggggcctggatgacttccagttcctgcccttcatctggggcagcagccagctgattgaccacccctacctggagcccaggcactttgtggatgagaaggctgtgaatgaaaaccacaaggactacatgttcctggagtgcatcctcttcatcacagagatgaagacaggcccctttgctgagcacagcaaccagctgtggaacatctctgctgtgcccagctggagcaaggtgaaccagggcctcatccgcatgtacaaggcagaatgtctggagaagtttcctgtgatccagcacttcaagtttggcagcctgctgcccatccaccctgtgaccagcggctag

SEQ ID NO: 166180 - DNA, 990 bp, Artificial Sequence
  Description of Artificial Sequence: Synthetic coding sequence
atggccgagggggagcggcagcccccaccagacagcagcgaggaggcccccccagccacccagaacttcatcatccccaagaaggagatccacacagtgcctgacatgggcaagtggaagaggagccaggtgcccttcggcaccgtggcctatgctgactacatcggcttcatcctgaccctgaatgaaggagtgaagggcaagaagctgacctttgagtacagagtgtctgaggccatcgagaagctggtggccctgctgaacaccctggaccgctggattgatgagaccccacctgtggaccagcccagccgcttcggcaacaaggcctaccgcacctggtacgccaagctggatgaggaggccgagaacctggtggccaccgtggtgcccacccacctggccgctgctgtgcctgaggtggccgtgtacctgaaggagagcgtgggcaacagcaccagaattgattatggaactggacatgaagctgcctttgctgccttcctgtgctgcctgtgcaagattggagtgctgcgggtggatgaccagatcgccatcgtgttcaaggtgttcaaccgctacctggaggtgatgaggaagctgcagaagacctacaggatggagcccgccggcagccagggcgtgtggggcctggatgacttccagttcctgcccttcatctggggcagcagccagctgattgaccacccctacctggagcccaggcactttgtggatgagaaggctgtgaatgaaaaccacaaggactacatgttcctggagtgcatcctcttcatcacagagatgaagacaggcccctttgctgagcacagcaaccagctgtggaacatctctgctgtgcccagctggagcaaggtgaaccagggcctcatccgcatgtacaaggccgagtgcctggagaagtttcctgtgatccagcacttcaagtttggcagcctgctgcccatccaccctgtgaccagcggctag

SEQ ID NO: 166181 - DNA, 846 bp, Artificial Sequence
  Description of Artificial Sequence: Synthetic coding sequence
atggccgagggggagcggcagcccccaccagacagcagcgaggaggcccccccagccacccagaacttcatcatccccaagaaggagatccacacagtgcctgacatgggcaagtggaagaggagccaggcctatgctgactacatcggcttcatcctgaccctgaatgaaggagtgaagggcaagaagctgacctttgagtacagagtgtctgaggaggccgagaacctggtggccaccgtggtgcccacccacctggccgctgctgtgcctgaggtggccgtgtacctgaaggagagcgtgggcaacagcaccagaattgattatggaactggacatgaagctgcctttgctgccttcctgtgctgcctgtgcaagattggagtgctgcgggtggatgaccagatcgccatcgtgttcaaggtgttcaaccgctacctggaggtgatgaggaagctgcagaagacctacaggatggagcccgccggcagccagggcgtgtggggcctggatgacttccagttcctgcccttcatctggggcagcagccagctgattgaccacccctacctggagcccaggcactttgtggatgagaaggctgtgaatgaaaaccacaaggactacatgttcctggagtgcatcctcttcatcacagagatgaagacaggcccctttgctgagcacagcaaccagctgtggaacatctctgctgtgcccagctggagcaaggtgaaccagggcctcatccgcatgtacaaggccgagtgcctggagaagtttcctgtgatccagcacttcaagtttggcagcctgctgcccatccaccctgtgaccagcggctag

SEQ ID NO: 166182 - DNA, 885 bp, Artificial Sequence
  Description of Artificial Sequence: Synthetic coding sequence
atggccgagggggagcggcagcccccaccagacagcagcgaggaggcccccccagccacccagaacttcatcatccccaagaaggagatccacacagtgcctgacatgggcaagtggaagaggagccaggccatcgagaagctggtggccctgctgaacaccctggaccgctggattgatgagaccccacctgtggaccagcccagcagatttggaaacaaggcctaccgcacctggtacgccaagctggatgaggaggccgagaacctggtggccaccgtggtgcccacccacctggccgctgctgtgcctgaggtggccgtgtacctgaaggagagcgtgggcaacagcaccagaattgattatggcaccggccacgaggccgcctttgctgccttcctgtgctgcctgtgcaagattggagtgctgcgggtggatgaccagatcgccatcgtgttcaaggtgttcaaccgctacctggaggtgatgaggaagctgcagaagacctacaggatggagcctgctggcagccagggcgtgtggggcctggatgacttccagttcctgcccttcatctggggcagcagccagctgattgaccacccctacctggagcccaggcactttgtggatgagaaggctgtgaatgaaaaccacaaggactacatgttcctggagtgcatcctcttcatcacagagatgaagacaggcccctttgctgagcacagcaaccagctgtggaacatctctgctgtgcccagctggagcaaggtgaaccagggcctcatccgcatgtacaaggcagaatgtctggagaagtttcctgtgatccagcacttcaagtttggcagcctgctgcccatccaccctgtgaccagcggctag

SEQ ID NO: 166183 - DNA, 972 bp, Artificial Sequence
  Description of Artificial Sequence: Synthetic coding sequence
atggccgagggggagcggcagcccccaccagacagcagcgaggaggcccccccagccacccagaacttcatcatccccaagaaggagatccacacagtgcctgacatgggcaagtggaagaggagccaggcctatgctgactacatcggcttcatcctgaccctgaatgaaggagtgaagggcaagaagctgacctttgagtacagagtgtctgaggccatcgagaagctggtggccctgctgaacaccctggaccgctggattgatgagaccccacctgtggaccagcccagccgcttcggcaacaaggcctaccgcacctggtacgccaagctggatgaggaggccgagaacctggtggccaccgtggtgcccacccacctggccgctgctgtgcctgaggtggccgtgtacctgaaggagagcgtgggcaacagcaccagaattgattatggaactggacatgaagctgcctttgctgccttcctgtgctgcctgtgcaagattggagtgctgcgggtggatgaccagatcgccatcgtgttcaaggtgttcaaccgctacctggaggtgatgaggaagctgcagaagacctacaggatggagcccgccggcagccagggcgtgtggggcctggatgacttccagttcctgcccttcatctggggcagcagccagctgattgaccacccctacctggagcccaggcactttgtggatgagaaggctgtgaatgaaaaccacaaggactacatgttcctggagtgcatcctcttcatcacagagatgaagacaggcccctttgctgagcacagcaaccagctgtggaacatctctgctgtgcccagctggagcaaggtgaaccagggcctcatccgcatgtacaaggccgagtgcctggagaagtttcctgtgatccagcacttcaagtttggcagcctgctgcccatccaccctgtgaccagcggctag

SEQ ID NO: 166184 - DNA, 972 bp, Artificial Sequence; identical to SEQ ID NO: 166183
  Description of Artificial Sequence: Synthetic coding sequence

SEQ ID NO: 166185 - DNA, 792 bp, Artificial Sequence
  Description of Artificial Sequence: Synthetic coding sequence
atgggcaagtggaagaggagccaggcctatgctgactacatcggcttcatcctgaccctgaatgaaggagtgaagggcaagaagctgacctttgagtacagagtgtctgaggccatcgagaagctggtggccctgctgaacaccctggaccgctggattgatgagaccccacctgtggaccagcccagcagatttggaaacaaggcctaccgcacctggtacgccaagctggatgaggaggccgagaacctggtggccaccgtggtgcccacccacctggccgctgctgtgcctgaggtggccgtgtacctgaaggagagcgtgggcaacagcaccagaattgattatggcaccggccacgaggccgcctttgctgccttcctgtgctgcctgtgcaagattggagtgctgcgggtggatgaccagatcgccatcgtgttcaaggtgttcaaccgctacctggaggtgatgaggaagctgcagaagacctacaggatggagcctgctggcagccagggcgtgtggggcctggatgacttccagttcctgcccttcatctggggcagcagccagctgattgaccacccctacctggagcccaggcactttgtggatgagaaggctgtgaatgaaaaccacaaggactacatgttcctggagtgcatcctcttcatcacagagatgaagacaggcccctttgctgagcacagcaaccagctgtggaacatctctgctgtgcccagctggagcaaggtgaaccagggcctcatccgcatgtacaaggccgagtag

SEQ ID NO: 166186 - DNA, 1125 bp, Artificial Sequence
  Description of Artificial Sequence: Synthetic coding sequence
atggccgagggggagcggcagcccccaccagacagcagcgaggaggcccccccagccacccagaacttcatcatccccaagaaggagatccacacagtgcctgacatgggcaagtggaagaggagccaggcctatgctgactacatcggcttcatcctgaccctgaatgaaggagtgaagggcaagaagctgacctttgagtacagagtgtctgagatgtggaatgaggtgcatgaggagaaggagcaggccgccaagcagagcgtgtcctgtgatgagtgcatccccctgccccgggccggccactgtgcccccagcgaggccatcgagaagctggtggccctgctgaacaccctggaccgctggattgatgagaccccacctgtggaccagcccagcagatttggaaacaaggcctaccgcacctggtacgccaagctggatgaggaggccgagaacctggtggccaccgtggtgcccacccacctggccgctgctgtgcctgaggtggccgtgtacctgaaggagagcgtgggcaacagcaccagaattgattatggcaccggccacgaggccgcctttgctgccttcctgtgctgcctgtgcaagattggagtgctgcgggtggatgaccagatcgccatcgtgttcaaggtgttcaaccgctacctggaggtgatgaggaagctgcagaagacctacaggatggagcctgctggcagccagggcgtgtggggcctggatgacttccagttcctgcccttcatctggggcagcagccagctgattgaccacccctacctggagcccaggcactttgtggatgagaaggctgtgaatgaaaaccacaaggactacatgttcctggagtgcatcctcttcatcacagagatgaagacaggcccctttgctgagcacagcaaccagctgtggaacatctctgctgtgcccagctggagcaaggtgaaccagggcctcatccgcatgtacaaggccgaggccagccccagcgacacctggggcctgggcatcagccacctgggccacggccagagcgagaagcaccagcccccccagcccaggaaggctgctgtgcagctgtgcccagatgagctgggcggctag

SEQ ID NO: 166187 - DNA, 456 bp, Artificial Sequence
  Description of Artificial Sequence: Synthetic coding sequence
atgaagacaggcccctttgctgagcacagcaaccagctgtggaacatctctgctgtgcccagctggagcaaggtgaaccagggcctcatccgcatgtacaaggccgaggtgtctgggggctggcctgtgtgccccagcctgctgccccacctggtgctgggctggggccagagcaagagatgtggcacctggggcagctgcttcctgctgccccactgctttgccctgaacctgcggcctgcccccctgaccctgggcgccagcgagagccccatctggggcatgggcagccagaggagcaccagccaccccagccctgagaagctgcagagcagctctgtgctgatgagcctggaggccgaggcccggacctgctgcatgggcagcggaggagatggcggcctgcccagccccctgagcagcggccagaggctgctgaaggcccgggctgtgtag

SEQ ID NO: 166188 - DNA, 2802 bp, Artificial Sequence
  Description of Artificial Sequence: Synthetic coding sequence
atggctgacctgagcctgctgcaggaggacctgcaggaggatgctgatggcagcctggactttgtgtcccaggatgagatgctgacccccctgggccgcctggacaagtatgctgccagcgagaacatcttcaaccggcagatggtggcccggagcctgctggacaccctgcgggaggtgtgtgatgatgagcgggactgcatcgctgtgctggagcgcatcagccggctggctgatgattctgagcccaccgtgcgggcagagctgatggagcaggtgccccacatcgccctcttctgccaggagaaccggcccagcatcccctatgccttcagcaagttcctgctgcccatcgtggtgcgctacctggccgaccagaacaaccaggtgaggaagaccagccaggccgccctgctggccctgctggagcaggagctgattgaaagatttgatgtggagaccaaggtgtgccctgtgctgattgagctgacagccccagacagcaatgatgatgtgaagacagaggccgtggccatcatgtgcaagatggcccccatggtgggcaaggacatcacagagcggctcatcctgccccgcttctgtgagatgtgctgtgactgcaggatgtttcatgtgaggaaggtgtgtgccgccaactttggagacatctgcagcgtggtgggccagcaggccacagaggagatgctgctgccccgcttcttccagctgtgcagcgacaacgtgtggggcgtgaggaaggcctgtgccgagtgcttcatggctgtgtcctgtgccacctgccaggagatccggaggaccaagctgagcgccctcttcatcaacctgatcagtgaccccagccgctgggtgcggcaggccgccttccagagcctgggccccttcatcagcacctttgccaaccccagcagcagcggccagtacttcaaggaggagagcaagagcagcgaggagatgtctgtggagaacaagaacagaacccgggaccaggaggccccagaagatgtgcaggtgcggcctgaggacacccccagcgacctgtctgtgagcaacagcagcgtcatcctggagaacaccatggaggaccacgccgctgaggccagcggcaagcccctgggggagatctctgtgcccctggacagcagcctgctgtgcaccctgagcagcgagagccaccaggaggccgccagcaatgaaaatgacaagaagccaggcaactacaagtccatgctgcggcctgaggtgggcaccaccagccaggacagcgccctgctggaccaggagctgtacaacagcttccacttctggaggacccccctgcctgagattgacctggacatcgagctggagcagaacagcggcggcaagcccagccctgagggccctgaggaggagagcgagggccctgtgcccagcagccccaacatcaccatggccaccaggaaggagctggaggagatgattgagaacctggagccccacattgatgatcctgatgtgaaggcccaggtggaggtgctgtctgctgccctgcgggccagcagcctggatgcccacgaggagaccatcagcattgagaagagaagtgacctgcaggatgagctggacatcaatgagctgcccaactgcaagatcaaccaggaggacagcgtgcccctcatcagtgatgctgtggagaacatggacagcaccctgcactacatccacagcgacagcgacctgagcaacaacagcagcttctccccagatgaggagaggaggaccaaggtgcaggatgtggtgccccaggccctgctggaccagtacctgtccatgacagaccccagccgggcccagacagtggacacagagatcgccaagcactgtgcctacagcctgcccggggtggccctgaccctgggccggcagaactggcactgcctgcgggagacctatgagaccctggccagtgacatgcagtggaaggtgcggaggaccctggccttcagcatccacgagctggccgtcatcctgggggaccagctgacagctgctgacctggtgcccatcttcaacggcttcctgaaggacctggatgaggtgcgcatcggcgtgctgaagcacctgcatgacttcctgaagctgctgcacatcgacaagaggcgggagtacctgtaccagctgcaggagttcctggtgacagacaacagcaggaactggaggttccgggcagagctggccgagcagctgatcctgctgctggagctgtacagccccagagatgtgtatgactacctgcggcccatcgccctgaacctgtgtgccgacaaggtgtcctctgtgcgctggatctcctacaagctggtgtctgagatggtgaagaagctgcatgctgccaccccacccacctttggagtggacctgatcaatgagctggtggagaactttggccgctgccccaagtggagcggccggcaggcctttgtgtttgtgtgccagacagtgattgaagatgactgcctgcccatggaccagtttgctgtgcacctgatgccccacctgctgaccctggccaatgacagagtgcccaacgtgcgggtgctgctggccaagaccctgcggcagaccctgctggagaaggactacttcctggccagcgccagctgccaccaggaggccgtggagcagaccatcatggccctgcagatggaccgggacagtgatgtgaagtactttgccagcatccacccagccagcaccaagatcagtgaagatgccatgagcacagccagcagcacctactag

SEQ ID NO: 166189 - DNA, 924 bp, Artificial Sequence
  Description of Artificial Sequence: Synthetic coding sequence
atggccgagatcagtgacctggaccggcagatcgagcagctgcggcgctgtgagctgatcaaggagagcgaggtgaaggccctgtgtgccaaggcccgggagatcctggtggaggagagcaatgtgcagagggtggacagccctgtgacagtgtgtggggacatccacggccagttctatgacctgaaggagctgttccgggtgggcggagatgtgcctgagaccaactacctgttcatgggagactttgtggaccggggcttctacagcgtggagaccttcctgctgctgctggccctgaaggtgcgctacccagaccgcatcaccctcatccggggcaaccacgagagccggcagatcacccaggtgtatggcttctatgatgaatgtctgaggaaatatggctctgtgacagtgtggagatactgcacagagatctttgactacctgagcctgagcgccatcattgatggcaagatcttctgtgtgcacggcggcctgagccccagcatccagaccctggaccagatccgcaccatcgacaggaagcaggaggtgccccatgatggccccatgtgtgacctgctgtggagcgaccctgaggacaccaccggctggggcgtgagccccagaggagctggctacctgtttggaagtgatgtggtggcccagttcaatgctgccaatgacatcgacatgatctgccgggcccaccagctggtgatggagggctacaagtggcacttcaatgagaccgtgctgactgtgtggagcgcccccaactactgctaccgctgtggaaatgtggccgccatcctggagctggatgagcacctgcagaaggacttcatcatctttgaggccgccccccaggagacccggggcatccccagcaagaagcctgtggccgactacttcctgtag

SEQ ID NO: 166190 - DNA, 1413 bp, Artificial Sequence
  Description of Artificial Sequence: Synthetic coding sequence
atgctgcaggtgaggacctacctgacagagcccaccgtgcgggcagagctgatggagcaggtgccccacatcgccctcttctgccaggagaaccggcccagcatcccctatgccttcagcaagttcctgctgcccatcgtggtgcgctacctggccgaccagaacaaccaggtgaggaagaccagccaggccgccctgctggccctgctggagcaggagctgattgaaagatttgatgtggagaccaaggtgtgccctgtgctgattgagctgacagccccagacagcaatgatgatgtgaagacagaggccgtggccatcatgtgcaagatggcccccatggtgggcaaggacatcacagagcggctcatcctgccccgcttctgtgagatgtgctgtgactgcaggatgtttcatgtgaggaaggtgtgtgccgccaactttggagacatctgcagcgtggtgggccagcaggccacagaggagatgctgctgccccgcttcttccagctgtgcagcgacaacgtgtggggcgtgaggaaggcctgtgccgagtgcttcatggctgtgtcctgtgccacctgccaggagatccggaggaccaagctgagcgccctcttcatcaacctgatcagtgaccccagccgctgggtgcggcaggccgccttccagagcctgggccccttcatcagcacctttgccaaccccagcagcagcggccagtacttcaaggaggagagcaagagcagcgaggagatgtctgtggagaacaagaacagaacccgggaccaggaggccccagaagatgtgcaggtgcggcctgaggacacccccagcgacctgtctgtgagcaacagcagcgtcatcctggagaacaccatggaggaccacgccgctgaggccagcggcaagcccctgggggagatctctgtgcccctggacagcagcctgctgtgcaccctgagcagcgagagccaccaggaggccgccagcaatgaaaatgacaagaagccaggcaactacaagtccatgctgcggcctgaggtgggcaccaccagccaggacagcgccctgctggaccaggagctgtacaacagcttccacttctggaggacccccctgcctgagattgacctggacatcgagctggagcagaacagcggcggcaagcccagccctgagggccctgaggaggagagcgagggccctgtgcccagcagccccaacatcaccatggccaccaggaaggagctggaggagatgattgagaacctggagccccacattgatgatcctgatgtgaaggcccaggtggaggtgctgtctgctgccctgcgggccagcagcctggatgcccacgaggagaccatcagcatcaagcgggaggtgatctgcaagatgaactggatctag

SEQ ID NO: 166191 - DNA, 2853 bp, Artificial Sequence
  Description of Artificial Sequence: Synthetic coding sequence
atggctgacctgagcctgctgcaggaggacctgcaggaggatgctgatggcttcggcgtggatgactacagcagcgagagtgatgtgatcatcatccccagcgccctggactttgtgtcccaggatgagatgctgacccccctgggccgcctggacaagtatgctgccagcgagaacatcttcaaccggcagatggtggcccggagcctgctggacaccctgcgggaggtgtgtgatgatgagcgggactgcatcgctgtgctggagcgcatcagccggctggctgatgacagcgagcccaccgtgcgggcagagctgatggagcaggtgccccacatcgccctcttctgccaggagaaccggcccagcatcccctatgccttcagcaagttcctgctgcccatcgtggtgcgctacctggccgaccagaacaaccaggtgaggaagaccagccaggccgccctgctggccctgctggagcaggagctgattgaaagatttgatgtggagaccaaggtgtgccctgtgctgattgagctgacagccccagacagcaatgatgatgtgaagacagaagctgtggccatcatgtgcaagatggcccccatggtgggcaaggacatcacagagcggctcatcctgccccgcttctgtgagatgtgctgtgactgcaggatgttccacgtgaggaaggtgtgtgccgccaactttggagacatctgcagcgtggtgggccagcaggccacagaggagatgctgctgccccgcttcttccagctgtgcagcgacaacgtgtggggcgtgaggaaggcctgtgccgagtgcttcatggctgtgtcctgtgccacctgccaggagatccggaggaccaagctgagcgccctcttcatcaacctgatcagtgaccccagccgctgggtgcggcaggccgccttccagagcctgggccccttcatcagcacctttgccaaccccagcagcagcggccagtacttcaaggaggagagcaagagcagcgaggagatgtctgtggagaacaagaacagaacccgggaccaggaggccccagaagatgtgcaggtgcggcctgaggacacccccagcgacctgtctgtgagcaacagcagcgtcatcctggagaacaccatggaggaccatgctgctgaggccagcggcaagcccctgggggagatctctgtgcccctggacagcagcctgctgtgcaccctgagcagcgagagccaccaggaggccgccagcaatgaaaatgacaagaagccaggcaactacaagtccatgctgcggcctgaggtgggcaccaccagccaggacagcgccctgctggaccaggagctgtacaacagcttccacttctggaggacccccctgcctgagattgacctggacatcgagctggagcagaacagcggcggcaagcccagccctgagggccctgaggaggagagcgagggccctgtgcccagcagccccaacatcaccatggccaccaggaaggagctggaggagatgattgagaacctggagccccacattgatgatcctgatgtgaaggcccaggtggaggtgctgtctgctgccctgcgggccagcagcctggatgcccacgaggagaccatcagcattgagaagagaagtgacctgcaggatgagctggacatcaatgagctgcccaactgcaagatcaaccaggaggacagcgtgcccctcatcagtgatgctgtggagaacatggacagcaccctgcactacatccacagcgacagcgacctgagcaacaacagcagcttctccccagatgaggagaggaggaccaaggtgcaggatgtggtgccccaggccctgctggaccagtacctgtccatgacagaccccagccgggcccagacagtggacacagaaattgccaagcactgtgcctacagcctgcccggggtggccctgaccctgggccggcagaactggcactgcctgcgggagacctatgagaccctggccagtgacatgcagtggaaggtgcggaggaccctggccttcagcatccacgagctggccgtcatcctgggggaccagctgacagctgctgacctggtgcccatcttcaacggcttcctgaaggacctggatgaggtgagaattggagtgctgaagcacctgcatgacttcctgaagctgctgcacatcgacaagagaagagagtacctgtaccagctgcaggagttcctggtgacagacaacagcaggaactggaggttccgggcagagctggccgagcagctgatcctgctgctggagctgtacagccccagagatgtgtatgactacctgcggcccatcgccctgaacctgtgtgccgacaaggtgtcctctgtgcgctggatctcctacaagctggtgtctgagatggtgaagaagctgcacgccgccaccccacccaccttcggcgtggacctgatcaatgagctggtggagaactttggccgctgccccaagtggagcggccggcaggcctttgtgtttgtgtgccagacagtgattgaagatgactgcctgcccatggaccagtttgctgtgcacctgatgccccacctgctgaccctggccaatgacagagtgcccaacgtgcgggtgctgctggccaagaccctgcggcagaccctgctggagaaggactacttcctggccagcgccagctgccaccaggaggccgtggagcagaccatcatggccctgcagatggaccgggacagtgatgtgaagtactttgccagcatccacccagccagcaccaagatcagtgaagatgccatgagcacagccagcagcacctactag

SEQ ID NO: 166192 - DNA, 1086 bp, Artificial Sequence
  Description of Artificial Sequence: Synthetic coding sequence
atggatgacttccgcaccagcgcccctgagccccggggcccccccaaccccaacgtggagtacatcccctttgatgagatgaaggagcgcatcctgaagatcgtgacaggcttcaacggcatccccttcaccatccagaggctgtgtgagctgctgacagaccccaggaggaactacacaggaacagacaagttcctgcggggcgtggagaagaatgtgatggtggtgtcctgtgtgtaccccagcagcgagaagaacaacagcaacagcctgaacaggatgaatggagtgatgtttcctggcaacagccccagctacacagagaggagcaacatcaatggacctggcaccccccggcccctgaaccggcccaaggtgtccctgagcgcccccatgaccaccaacggcctgcctgagagcacagacagcaaggaggccaacctgcagcagaatgaggagaagaaccacagcgacagcagcaccagcgagagcgaggtgtcctctgtgagccccctgaagaacaagcacccagatgaagatgctgtggaggccgagggccacgaggtgaagaggctgcgctttgacaaggagggggaggtgcgggagacagccagccagaccaccagcagcgagatcagctctgtgatggtgggggagacagaggccagcagcagcagccaggacaaggacaaggacagccgctgcacccggcagcactgcacagaagaagatgaggaggaggatgaggaggaggaggaggagagcttcatgaccagccgggagatgatccctgagaggaagaaccaggagaaggagagtgatgatgccctgactgtgaatgaggagaccagcgaggagaacaaccagatggaggagagtgatgtgtcccaggccgagaaggacctgctgcacagcgagggctctgaaaatgaaggacctgtgagcagcagcagcagtgactgccgggagacagaggagctggtgggcagcaacagcagcaagacaggagagatcctgtctgagagctccatggagaatgatgatgaggccacagaggtgacagatgagcccatggagcaggactag

SEQ ID NO: 166193 - DNA, 1254 bp, Artificial Sequence
  Description of Artificial Sequence: Synthetic coding sequence
atggatgtggagcggctgcaggaggccctgaaggactttgagaagaggggcaagaaggaggtgtgccctgtgctggaccagttcctgtgccacgtggccaagacaggagagaccatgatccagtggagccagttcaagggctacttcatcttcaagctggagaaggtgatggatgacttccgcaccagcgcccctgagccccggggcccccccaaccccaacgtggagtacatcccctttgatgagatgaaggagcgcatcctgaagatcgtgacaggcttcaacggcatccccttcaccatccagaggctgtgtgagctgctgacagaccccaggaggaactacacaggaacagacaagttcctgcggggcgtggagaagaatgtgatggtggtgtcctgtgtgtaccccagcagcgagaagaacaacagcaacagcctgaacaggatgaatggagtgatgtttcctggcaacagccccagctacacagagaggagcaacatcaatggacctggcaccccccggcccctgaaccggcccaaggtgtccctgagcgcccccatgaccaccaacggcctgcctgagagcacagacagcaaggaggccaacctgcagcagaatgaggagaagaaccacagcgacagcagcaccagcgagagcgaggtgtcctctgtgagccccctgaagaacaagcacccagatgaagatgctgtggaggccgagggccacgaggtgaagaggctgcgctttgacaaggagggggaggtgcgggagacagccagccagaccaccagcagcgagatcagctctgtgatggtgggggagacagaggccagcagcagcagccaggacaaggacaaggacagccgctgcacccggcagcactgcacagaagaagatgaggaggaggatgaggaggaggaggaggagagcttcatgaccagccgggagatgatccctgagaggaagaaccaggagaaggagagtgatgatgccctgactgtgaatgaggagaccagcgaggagaacaaccagatggaggagagtgatgtgtcccaggccgagaaggacctgctgcacagcgagggctctgaaaatgaaggacctgtgagcagcagcagcagtgactgccgggagacagaggagctggtgggcagcaacagcagcaagacaggagagatcctgtctgagagctccatggagaatgatgatgaggccacagaggtgacagatgagcccatggagcaggactag

SEQ ID NO: 166194 - DNA, 1083 bp, Artificial Sequence
  Description of Artificial Sequence: Synthetic coding sequence
atggatgtggagcggctgcaggaggccctgaaggactttgagaagaggggcaagaaggaggtgtgccctgtgctggaccagttcctgtgccacgtggccaagacaggagagaccatcatccccttcaccatccagaggctgtgtgagctgctgacagaccccaggaggaactacacaggaacagacaagttcctgcggggcgtggagaagaatgtgatggtggtgtcctgtgtgtaccccagcagcgagaagaacaacagcaacagcctgaacaggatgaatggagtgatgtttcctggcaacagccccagctacacagagaggagcaacatcaatggacctggcaccccccggcccctgaaccggcccaaggtgtccctgagcgcccccatgaccaccaacggcctgcctgagagcacagacagcaaggaggccaacctgcagcagaatgaggagaagaaccacagcgacagcagcaccagcgagagcgaggtgtcctctgtgagccccctgaagaacaagcacccagatgaagatgctgtggaggccgagggccacgaggtgaagaggctgcgctttgacaaggagggggaggtgcgggagacagccagccagaccaccagcagcgagatcagctctgtgatggtgggggagacagaggccagcagcagcagccaggacaaggacaaggacagccgctgcacccggcagcactgcacagaggaggatgaggaggaggatgaggaggaggaggaggagagcttcatgaccagccgggagatgatccctgagaggaagaaccaggagaaggagagtgatgatgccctgactgtgaatgaggagaccagcgaggagaacaaccagatggaggagagtgatgtgtcccaggccgagaaggacctgctgcacagcgagggctctgaaaatgaaggacctgtgagcagcagcagcagtgactgccgggagacagaggagctggtgggcagcaacagcagcaagacaggagagatcctgtctgagagctccatggagaatgatgatgaggccacagaggtgacagatgagcccatggagcaggactag

SEQ ID NO: 166195 - DNA, 1116 bp, Artificial Sequence
  Description of Artificial Sequence: Synthetic coding sequence
atggccctgggcaagttccgggccgccctgcgggactatgaaacagtggtgaaggtgaagccccatgacaaggatgccaagatgaagtaccaggagtgcaacaagatcgtgaagcagaaggcctttgagcgggccatcgctggagatgagcacaagaggtctgtggtggacagcctggacattgaatccatgaccattgaagatgagtacagcggccccaagctggaggatggcaaggtgaccatctccttcatgaaggagctgatgcagtggtacaaggaccagaagaagctgcacaggaaatgtgcctaccagacagagaagatcaccgtgtgtggggacacccacggccagttctatgacctgctgaacatctttgagctgaatggcctgcccagcgagaccaacccctacatcttcaatggagactttgtggaccggggcagcttctctgtggaggtgatcctgaccctgtttggcttcaagctgctgtacccagaccacttccacctgctgcggggcaaccacgagacagacaacatgaaccagatctacggctttgaaggagaggtgaaggccaagtacacagcccagatgtatgagctgttcagcgaggtgtttgagtggctgcccctggcccagtgcatcaatggcaaggtgctgatcatgcacggcggcctcttctctgaagatggagtgaccctggatgacatcaggaagattgaaagaaaccggcagcccccagacagcggccccatgtgtgacctgctgtggagcgacccccagccccagaatggccgcagcatcagcaagaggggcgtgtcctgccagtttggaccagatgtgaccaaggccttcctggaggagaacaacctggactacatcatccgcagccatgaggtgaaggccgagggctatgaggtggcccacggcggccgctgtgtgaccgtcttcagcgcccccaactactgtgaccagatgggcaacaaggccagctacatccacctgcagggcagtgacctgcggccccagttccaccagttcaccgctgtgccccaccccaacgtgaagcccatggcctatgccaacaccctgctgcagctgggcatgatgtag

SEQ ID NO: 166196 - DNA, 1500 bp, Artificial Sequence
  Description of Artificial Sequence: Synthetic coding sequence
atggccatggccgagggggagaggacagaatgtgccgagcccccaagagatgagcccccagcagatggagccctgaagagagctgaggagctgaagacccaggccaatgactacttcaaggccaaggactatgaaaatgccatcaagttctacagccaggccatcgagctgaaccccagcaatgccatctactacggcaacagaagcctggcctacctgaggacagagtgctacggctacgccctgggagatgccacccgggccatcgagctggacaagaagtacatcaagggctactacagaagagctgccagcaacatggccctgggcaagttccgggccgccctgcgggactatgaaacagtggtgaaggtgaagccccatgacaaggatgccaagatgaagtaccaggagtgcaacaagatcgtgaagcagaaggcctttgagcgggccatcgctggagatgagcacaagaggtctgtggtggacagcctggacattgaatccatgaccattgaagatgagtacagcggccccaagctggaggatggcaaggtgaccatctccttcatgaaggagctgatgcagtggtacaaggaccagaagaagctgcacaggaaatgtgcctaccagatcctggtgcaggtgaaggaggtgctgagcaagctgagcaccctggtggagaccaccctgaaggagacagagaagatcaccgtgtgtggggacacccacggccagttctatgacctgctgaacatctttgagctgaatggcctgcccagcgagaccaacccctacatcttcaatggagactttgtggaccggggcagcttctctgtggaggtgatcctgaccctgtttggcttcaagctgctgtacccagaccacttccacctgctgcggggcaaccacgagacagacaacatgaaccagatctacggctttgaaggagaggtgaaggccaagtacacagcccagatgtatgagctgttcagcgaggtgtttgagtggctgcccctggcccagtgcatcaatggcaaggtgctgatcatgcacggcggcctcttctctgaagatggagtgaccctggatgacatcaggaagattgaaagaaaccggcagcccccagacagcggccccatgtgtgacctgctgtggagcgacccccagccccagaatggccgcagcatcagcaagaggggcgtgtcctgccagtttggaccagatgtgaccaaggccttcctggaggagaacaacctggactacatcatccgcagccatgaggtgaaggccgagggctatgaggtggcccacggcggccgctgtgtgaccgtcttcagcgcccccaactactgtgaccagatgggcaacaaggccagctacatccacctgcagggcagtgacctgcggccccagttccaccagttcaccgctgtgccccaccccaacgtgaagcccatggcctatgccaacaccctgctgcagctgggcatgatgtag

SEQ ID NO: 166197 - DNA, 1461 bp, Artificial Sequence
  Description of Artificial Sequence: Synthetic coding sequence
atggccatggccgagggggagaggacagaatgtgccgagcccccaagagatgagcccccagcagatggagccctgaagagagctgaggagctgaagacccaggccaatgactacttcaaggccaaggactatgaaaatgccatcaagttctacagccaggccatcgagctgaaccccagcaatgccatctactacggctacgccctgggagatgccacccgggccatcgagctggacaagaagtacatcaagggctactaccgccgggccgccagcaacatggccctgggcaagttccgggccgccctgcgggactatgagaccgtggtgaaggtgaagccccatgacaaggatgccaagatgaagtaccaggagtgcaacaagatcgtgaagcagaaggcctttgagcgggccatcgctggagatgagcacaagaggtctgtggtggacagcctggacatcgagagcatgaccattgaagatgagtacagcggccccaagctggaggatggcaaggtgaccatctccttcatgaaggagctgatgcagtggtacaaggaccagaagaagctgcacaggaaatgtgcctaccagatcctggtgcaggtgaaggaggtgctgagcaagctgagcaccctggtggagaccaccctgaaggagacagagaagatcaccgtgtgtggggacacccacggccagttctatgacctgctgaacatctttgagctgaatggcctgcccagcgagaccaacccctacatcttcaacggggactttgtggaccggggcagcttctctgtggaggtgatcctgaccctgtttggcttcaagctgctgtacccagaccacttccacctgctgcggggcaaccatgaaacagacaacatgaaccagatctacggctttgaaggagaggtgaaggccaagtacacagcccagatgtatgagctgttcagcgaggtgtttgagtggctgcccctggcccagtgcatcaacgggaaggtgctgatcatgcatggaggcctcttctctgaagatggagtgaccctggatgacatcaggaagattgaaagaaaccggcagcccccagattctggccccatgtgtgacctgctgtggagcgacccccagccccagaatggccgcagcatcagcaagaggggcgtgtcctgccagtttggaccagatgtgaccaaggccttcctggaggagaacaacctggactacatcatccgcagccatgaggtgaaggccgagggctatgaggtggcccatggaggccgctgtgtgacagtgttcagcgcccccaactactgtgaccagatgggcaacaaggccagctacatccacctgcagggcagtgacctgcggccccagttccaccagttcaccgctgtgccccaccccaacgtgaagcccatggcctatgccaacaccctgctgcagctgggcatgatgtag

SEQ ID NO: 166198 - DNA, 1458 bp, Artificial Sequence
  Description of Artificial Sequence: Synthetic coding sequence
tgaatggccgagggggagaggacagaatgtgccgagcccccaagagatgagcccccagcagatggagccctgaagagagctgaggagctgaagacccaggccaatgactacttcaaggccaaggactatgaaaatgccatcaagttctacagccaggccatcgagctgaaccccagcaatgccatctactacggcaacagaagcctggcctacctgaggacagaatgttatggctacgccctgggagatgccacccgggccatcgagctggacaagaagtacatcaagggctactaccgccgggccgccagcaacatggccctgggcaagttccgggccgccctgcgggactatgagaccgtggtgaaggtgaagccccatgacaaggatgccaagatgaagtaccaggagtgcaacaagatcgtgaagcagaaggcctttgagcgggccatcgctggagatgagcacaagaggtctgtggtggacagcctggacatcgagagcatgaccattgaagatgagtacagcggccccaagctggaggatggcaaggtgaccatctccttcatgaaggagctgatgcagtggtacaaggaccagaagaagctgcacaggaaatgtgcctaccagatcctggtgcaggtgaaggaggtgctgagcaagctgagcaccctggtggagaccaccctgaaggagacagagaagatcaccgtgtgtggggacacccacggccagttctatgacctgctgaacatctttgagctgaatggcctgcccagcgagaccaacccctacatcttcaacggggactttgtggaccggggcagcttctctgtggaggtgatcctgaccctgtttggcttcaagctgctgtacccagaccacttccacctgctgcggggcaaccatgaaacagacaacatgaaccagatctacggctttgaaggagaggtgaaggccaagtacacagcccagatgtatgagctgttcagcgaggtgtttgagtggctgcccctggcccagtgcatcaacgggaaggtgctgatcatgcatggaggcctcttctctgaagatggagtgaccctggatgacatcaggaagattgaaagaaaccggcagcccccagattctggccccatgtgtgacctgctgtggagcgacccccagccccagaatggccgcagcatcagcaagaggggcgtgtcctgccagtttggaccagatgtgaccaaggccttcctggaggagaacaacctggactacatcatccgcagccatgaggtgaaggccgagggctatgaggtggcccatggaggccgctgtgtgacagtgttcagcgcccccaactactgtgaccagatgggcaacaaggccagctacatccacctgcagggcagtgacctgcggccccagttccaccagttcaccgctgtgggccggcccagcagcggcagctag

SEQ ID NO: 166199 - DNA, 477 bp, Artificial Sequence
  Description of Artificial Sequence: Synthetic coding sequence
atgctgactgtggccgccctgattgatgagcagatcctgtgtgtgcacggcggcctgagcccagacatcaagaccctggaccagatccgcaccatcgagaggaaccaggagatcccccacaagggggccttctgtgacctggtgtggagcgaccctgaagatgtggacacctgggccatcagccccagaggagctggctggctgtttggagccaaggtgaccaatgaatttgtgcacatcaacaacctgaagctgatctgccgggcccaccagctggtgcatgagggctacaagttcatgtttgatgagaagctggtgacagtgtggagcgcccccaactactgctaccgctgtggcaacatcgccagcatcatggtgttcaaggatgtgaacacccgggagcccaagctgttccgggctgtgcctgacagcgagagggtcatcccccccaggaccaccaccccctacttcctgtag

SEQ ID NO: 166200 - DNA, 918 bp, Artificial Sequence
  Description of Artificial Sequence: Synthetic coding sequence
atggcccccctggacctggacaagtatgtggagatcgcccggctgtgcaagtacctgcctgaaaatgacctgaagaggctgtgtgactatgtgtgtgacctgctgctggaggagagcaatgtgcagcctgtgtccacccctgtgacagtgtgtggggacatccacggccagttctatgacctgtgtgagctgttcagaactggaggccaggtgcctgacaccaactacatcttcatgggagactttgtggaccggggctactacagcctggagaccttcacctacctgctggccctgaaggccaagtggccagaccgcatcaccctgctgcggggcaaccacgagagccggcagatcacccaggtgtatggcttctatgatgagtgccagaccaagtatggaaatgccaatgcctggagatactgcaccaaggtgtttgacatgctgactgtggccgccctgattgatgagcagatcctgtgtgtgcatggaggcctgagcccagacatcaagaccctggaccagatccgcaccattgaaagaaaccaggagatcccccacaagggggccttctgtgacctggtgtggagcgaccctgaagatgtggacacctgggccatcagccccaggggggccggctggctgtttggagccaaggtgaccaatgaatttgtgcacatcaacaacctgaagctgatctgccgggcccaccagctggtgcatgagggctacaagttcatgtttgatgagaagctggtgacagtgtggagcgcccccaactactgctaccgctgtggcaacatcgccagcatcatggtgttcaaggatgtgaacacccgggagcccaagctgttccgggctgtgcctgattctgagagggtcatcccccccaggaccaccaccccctacttcctgtag

SEQ ID NO: 166201 - DNA, 852 bp, Artificial Sequence
  Description of Artificial Sequence: Synthetic coding sequence
atggcccccctggacctggacaagtatgtggagatcgcccggctgtgcaagtacctgcctgaaaatgacctgaagaggctgtgtgactatgtgtgtgacctgctgctggaggagagcaatgtgcagcctgtgtccacccctgtgacagtgtgtggggacatccacggccagggcgactttgtggaccggggctactacagcctggagaccttcacctacctgctggccctgaaggccaagtggccagaccgcatcaccctgctgcggggcaaccacgagagccggcagatcacccaggtgtatggcttctatgatgagtgccagaccaagtatggaaatgccaatgcctggagatactgcaccaaggtgtttgacatgctgactgtggccgccctgattgatgagcagatcctgtgtgtgcatggaggcctgagcccagacatcaagaccctggaccagatccgcaccattgaaagaaaccaggagatcccccacaagggggccttctgtgacctggtgtggagcgaccctgaagatgtggacacctgggccatcagccccaggggggccggctggctgtttggagccaaggtgaccaatgaatttgtgcacatcaacaacctgaagctgatctgccgggcccaccagctggtgcatgagggctacaagttcatgtttgatgagaagctggtgacagtgtggagcgcccccaactactgctaccgctgtggcaacatcgccagcatcatggtgttcaaggatgtgaacacccgggagcccaagctgttccgggctgtgcctgattctgagagggtcatcccccccaggaccaccaccccctacttcctgtag

SEQ ID NO: 166202 - DNA, 1029 bp, Artificial Sequence
  Description of Artificial Sequence: Synthetic coding sequence
atggcccccctggacctggacaagtatgtggagatcgcccggctgtgcaagtacctgcctgaaaatgacctgaaggtgagccccatctgtggcctggcccccagcggctgtggggccccagctggccggcccttcctgagccctggccccccacctgtgttccacttcctgcgcttcctgaaggagcggctgtgtgactatgtgtgtgacctgctgctggaggagagcaatgtgcagcctgtgtccacccctgtgacagtgtgtggggacatccacggccagttctatgacctgtgtgagctgttcagaactggaggccaggtgcctgacaccaactacatcttcatgggagactttgtggaccggggctactacagcctggagaccttcacctacctgctggccctgaaggccaagtggccagaccgcatcaccctgctgcggggcaaccacgagagccggcagatcacccaggtgtatggcttctatgatgagtgccagaccaagtatggaaatgccaatgcctggagatactgcaccaaggtgtttgacatgctgactgtggccgccctgattgatgagcagatcctgtgtgtgcacggcggcctgagcccagacatcaagaccctggaccagatccgcaccatcgagaggaaccaggagatcccccacaagggggccttctgtgacctggtgtggagcgaccctgaagatgtggacacctgggccatcagccccagaggagctggctggctgtttggagccaaggtgaccaatgaatttgtgcacatcaacaacctgaagctgatctgccgggcccaccagctggtgcatgagggctacaagttcatgtttgatgagaagctggtgacagtgtggagcgcccccaactactgctaccgctgtggcaacatcgccagcatcatggtgttcaaggatgtgaacacccgggagcccaagctgttccgggctgtgcctgacagcgagagggtcatcccccccaggaccaccaccccctacttcctgtag

SEQ ID NO: 166203 - DNA, 378 bp, Artificial Sequence
  Description of Artificial Sequence: Synthetic coding sequence
atgttcctgctgccccggctgcagctgctgggccagatgaggctgtgtgactatgtgtgtgacctgctgctggaggagagcaatgtgcagcctgtgtccacccctgtgacagtgtgtggggacatccacggccagttctatgacctgtgtgagctgttcagaactggaggccaggtgcctgacaccaactacatcttcatgggagactttgtggaccggggctactacagcctggagaccttcacctacctgctggccctgaaggccaagtggccagaccgcatcaccctgctgcggggcaaccacgagagccggcagatcacccaggtgtatggcttctatgatgagtgccagaccaagtatggaaatgccaactag

SEQ ID NO: 166204 - DNA, 1161 bp, Artificial Sequence
  Description of Artificial Sequence: Synthetic coding sequence
atgtctgccctggagaagtccatgcacctgggccgcctgcccagcaggcctcccctgcccggcagcggcggcagccagagcggggccaagatgaggatgggccctggcaggaagagggacttcagccctgtgccctggagccagtactttgagagcatggaggatgtggaggtggagaatgagaccgggaaggacaccttccgggtgtacaagagcggcagcgagggccctgtgctgctgctgctgcatggaggcggccacagcgccctgtcctgggccgtgttcaccgctgccatcatcagccgggtgcagtgcagaattgtggccctggacctgcggagccatggagagaccaaggtgaagaaccctgaggacctgtctgctgagaccatggccaaggatgtgggcaatgtggtggaggccatgtatggagacctgcccccacccatcatgctgattggccacagcatgggcggggccatcgctgtgcacacagccagcagcaacctggtgcccagcctgctgggcctgtgcatgattgatgtggtggagggcacagccatggatgccctgaacagcatgcagaacttcctgcggggccggcccaagaccttcaagagcctggagaatgccatcgagtggagcgtgaagagcggccagatccggaacctggagagcgcccgggtgtccatggtgggccaggtgaagcagtgtgagggcatcaccagccctgagggcagcaagagcatcgtggagggcatcatcgaggaggaggaggaggatgaggagggcagcgagagcatcagcaagaggaagaaggaggatgacatggagaccaagaaggaccacccctacacctggagaattgagctggccaagacagagaagtactgggatggctggttccggggcctgagcaacctcttcctgagctgccccatccccaagctgctgctgctggccggcgtggaccggctggacaaggacctgaccatcggccagatgcagggcaagttccagatgcaggtgctgccccagtgtggccatgctgtgcatgaagatgccccagacaaggtggccgaggccgtggccaccttcctgatccgccacagatttgctgagcccatcggcggcttccagtgtgtgtttcctggctgctag

SEQ ID NO: 166205 - DNA, 600 bp, Artificial Sequence
  Description of Artificial Sequence: Synthetic coding sequence
atggatgccctgaacagcatgcagaacttcctgcggggccggcccaagaccttcaagagcctggagaatgccatcgagtggagcgtgaagagcggccagatccggaacctggagagcgcccgggtgtccatggtgggccaggtgaagcagtgtgagggcatcaccagccctgagggcagcaagagcatcgtggagggcatcatcgaggaggaggaggaggatgaggagggcagcgagagcatcagcaagaggaagaaggaggatgacatggagaccaagaaggaccacccctacacctggagaattgagctggccaagacagagaagtactgggatggctggttccggggcctgagcaacctcttcctgagctgccccatccccaagctgctgctgctggccggcgtggaccggctggacaaggacctgaccatcggccagatgcagggcaagttccagatgcaggtgctgccccagtgtggccatgctgtgcatgaagatgccccagacaaggtggccgaggccgtggccaccttcctgatccgccacagatttgctgagcccatcggcggcttccagtgtgtgtttcctggctgctag

SEQ ID NO: 166206 - DNA, 1203 bp, Artificial Sequence
  Description of Artificial Sequence: Synthetic coding sequence
atgtctgccctggagaagtccatgcacctgggccgcctgcccagcaggcctcccctgcccggcagcggcggcagccagagcggggccaagatgaggatgggccctggcaggaagagggacttcagccctgtgccctggagccagtactttgagagcatggaggatgtggaggtggagaatgagaccgggaaggacaccttccgggtgtacaagagcggcagcgagggccctgtgctgctgctgctgcatggaggcggccacagcgccctgtcctgggccgtgttcaccgctgccatcatcagccgggtgcagtgcagaattgtggccctggacctgcggagccatggagagaccaaggtgaagaaccctgaggacctgtctgctgagaccatggccaaggatgtgggcaatgtggtggaggccatgtatggagacctgcccccacccatcatgctgattggccacagcatgggcggggccatcgctgtgcacacagccagcagcaacctggtgcccagcctgctgggcctgtgcatgattgatgtggtggagggcacagccatggatgccctgaacagcatgcagaacttcctgcggggccggcccaagaccttcaagagcctggagaatgccatcgagtggagcgtgaagagcggccagatccggaacctggagagcgcccgggtgtccatggtgggccaggtgaagcagtgtgagggcatcaccagccctgagggcagcaagagcatcgtggagggcatcatcgaggaggaggaggaggatgaggagggcagcgagagcatcagcaagaggaagaaggaggatgacatggagggcctgcccagcgagacccagaacctgctgctcttcctgcagaccaagaaggaccacccctacacctggagaattgagctggccaagacagagaagtactgggatggctggttccggggcctgagcaacctcttcctgagctgccccatccccaagctgctgctgctggccggcgtggaccggctggacaaggacctgaccatcggccagatgcagggcaagttccagatgcaggtgctgccccagtgtggccatgctgtgcatgaagatgccccagacaaggtggccgaggccgtggccaccttcctgatccgccacagatttgctgagcccatcggcggcttccagtgtgtgtttcctggctgctag

SEQ ID NO: 166207 - DNA, 1776 bp, Artificial Sequence
  Description of Artificial Sequence: Synthetic coding sequence
atgggctgcagcagcagcagcaccaagaccaggagaagtgacaccagcctgcgggccgccctgatcatccagaactggtaccggggctacaaggcccggctgaaggcccggcagcactacgccctgaccatcttccagagcattgaatatgcagatgagcagggccagatgcagctgagcaccttcttctccttcatgctggagaactacacccacatccacaaggaggagctggagctgaggaaccagagcctggagagcgagcaggacatgagggaccgctgggactatgtggacagcattgatgtgcctgacagctacaacggcccccggctgcagttccccctgacctgcacagacatcgacctgctgctggaggccttcaaggagcagcagatcctgcacgcccactacgtgctggaggtgctgtttgagaccaagaaggtgctgaagcagatgcccaacttcacccacatccagaccagccccagcaaggaggtgaccatctgtggggacctgcacggcaagctggatgacctcttcctgatcttctacaagaatggcctgcccagcgagaggaacccctacgtgttcaatggagactttgtggaccggggcaagaacagcattgagatcctgatgatcctgtgtgtgtccttcctggtgtacccaaatgacctgcacctgaacagaggcaaccacgaggacttcatgatgaacctgcgctatggcttcaccaaggagatcctgcacaagtacaagctgcacggcaagaggatcctgcagatcctggaggagttctacgcctggctgcccatcggcaccatcgtggacaatgagatcctggtgattcatggaggcatcagcgagaccacagacctgaacctgctgcaccgggtggagaggaacaagatgaagtctgtgctgatccccccaacagagaccaacagagaccatgacacagacagcaagcacaacaaggtgggcgtgaccttcaatgcccacggccgcatcaagaccaacggcagccccacagagcacctgacagaacatgagtgggagcaggtggtgaccatcttcagcgccagcaactactatgaggagggcagcaacagaggagcctacatcaagctgtgcagcggcaccaccccccgcttcttccagtaccaggtgaccaaggccacctgcttccagcccctgcggcagagggtggacaccatggagaacagcgccatcaagatcctgcgggagagggtcatcagcaggaagagtgacctgacccgggccttccagctgcaggaccacaggaagagcggcaagctgtctgtgtcccagtgggccttctgcatggagaacatcctgggcctgaacctgccctggaggagcctgagcagcaacctggtgaacatcgaccagaatggaaatgtggagtacatgagcagcttccagaacatcagaattgagaagcctgtgcaggaggcccacagcaccctggtggagaccctgtaccgctacagaagtgacctggagatcatcttcaatgccatcgacacagaccacagcggcctcatctctgtggaggagttccgggccatgtggaagctgttcagcagccactacaacgtgcacattgatgacagccaggtgaacaagctggccaacatcatggacctgaacaaggatggcagcattgacttcaatgagttcctgaaggccttctacgtggtgcacagatatgaggacctgatgaagccagatgtgaccaacctgggctag

SEQ ID NO: 166208 - DNA, 1803 bp, Artificial Sequence
  Description of Artificial Sequence: Synthetic coding sequence
atgggctgcagcagcagcagcaccaagaccaggagaagtgacaccagcctgcgggccgccctgatcatccagaactggtaccggggctacaaggcccggctgaaggcccggcagcactacgccctgaccatcttccagagcattgaatatgcagatgagcagggccagatgcagctgagcaccttcttctccttcatgctggagaactacacccacatccacaaggaggagctggagatcctgcacgcccactacgtgctggaggtgctgtttgagaccaagaaggtgctgaagcagatgcccaacttcacccacatccagaccagccccagcaaggaggtgaccatctgtggggacctgcacggcaagctggatgacctcttcctgatcttctacaagaatggcctgcccagcgagaggaacccctacgtgttcaacggggactttgtggaccggggcaagaacagcattgagatcctgatgatcctgtgtgtgtccttcctggtgtacccaaatgacctgcacctgaacagaggcaaccacgaggacttcatgatgaacctgcgctatggcttcaccaaggagatcctgcacaagtacaagctgcacggcaagaggatcctgcagatcctggaggagttctacgcctggctgcccatcggcaccatcgtggacaatgagatcctggtgatccacggcggcatcagcgagaccacagacctgaacctgctgcaccgggtggagaggaacaagatgaagtctgtgctgatccccccaacagagaccaacagagaccatgacacagacagcaagcacaacaaggtgggcgtgaccttcaatgcccacggccgcatcaagaccaacggcagccccacagagcacctgacagagcacgagtgggagcagatcatcgacatcctgtggagcgacccccggggcaagaatggctgcttccccaacacctgccggggcggcggctgctactttggaccagatgtgaccagcaagatcctgaacaagtaccagctgaagatgctgatccgcagccatgagtgcaagccagagggctatgagatctgccatgatggcaaggtggtgaccatcttcagcgccagcaactactatgaggagggcagcaacagaggagcctacatcaagctgtgcagcggcaccaccccccgcttcttccagtaccaggtgaccaaggccacctgcttccagcccctgcggcagagggtggacaccatggagaacagcgccatcaagatcctgcgggagagggtcatcagcaggaagagtgacctgacccgggccttccagctgcaggaccacaggaagagcggcaagctgtctgtgtcccagtgggccttctgcatggagaacatcctgggcctgaacctgccctggaggagcctgagcagcaacctggtgaacatcgaccagaatggaaatgtggagtacatgagcagcttccagaacatccgcatcgagaagcctgtgcaggaggcccacagcaccctggtggagaccctgtaccgctacagaagtgacctggagatcatcttcaatgccatcgacacagaccacagcggcctcatctctgtggaggagttccgggccatgtggaagctgttcagcagccactacaacgtgcacattgatgacagccaggtgaacaagctggccaacatcatggacctgaacaaggatggcagcattgacttcaatgagttcctgaaggccttctacgtggtgcacagatatgaggacctgatgaagccagatgtgaccaacctgggctag

SEQ ID NO: 166209 - DNA, 1962 bp, Artificial Sequence
  Description of Artificial Sequence: Synthetic coding sequence
atgggctgcagcagcagcagcaccaagaccaggagaagtgacaccagcctgcgggccgccctgatcatccagaactggtaccggggctacaaggcccggctgaaggcccggcagcactacgccctgaccatcttccagagcattgaatatgcagatgagcagggccagatgcagctgagcaccttcttctccttcatgctggagaactacacccacatccacaaggaggagctggagctgaggaaccagagcctggagagcgagcaggacatgagggaccgctgggactatgtggacagcattgatgtgcctgacagctacaacggcccccggctgcagttccccctgacctgcacagacatcgacctgctgctggaggccttcaaggagcagcagatcctgcacgcccactacgtgctggaggtgctgtttgagaccaagaaggtgctgaagcagatgcccaacttcacccacatccagaccagccccagcaaggaggtgaccatctgtggggacctgcacggcaagctggatgacctcttcctgatcttctacaagaatggcctgcccagcgagaggaacccctacgtgttcaatggagactttgtggaccggggcaagaacagcattgagatcctgatgatcctgtgtgtgtccttcctggtgtacccaaatgacctgcacctgaacagaggcaaccacgaggacttcatgatgaacctgcgctatggcttcaccaaggagatcctgcacaagtacaagctgcacggcaagaggatcctgcagatcctggaggagttctacgcctggctgcccatcggcaccatcgtggacaatgagatcctggtgattcatggaggcatcagcgagaccacagacctgaacctgctgcaccgggtggagaggaacaagatgaagtctgtgctgatccccccaacagagaccaacagagaccatgacacagacagcaagcacaacaaggtgggcgtgaccttcaatgcccacggccgcatcaagaccaacggcagccccacagagcacctgacagaacatgagtgggagcagatcatcgacatcctgtggagcgacccccggggcaagaatggctgcttccccaacacctgccggggcggcggctgctacttcggcccagatgtgaccagcaagatcctgaacaagtaccagctgaagatgctgatccgcagccatgagtgcaagccagagggctatgagatctgccatgatggcaaggtggtgaccatcttcagcgccagcaactactatgaggagggcagcaacagaggagcctacatcaagctgtgcagcggcaccaccccccgcttcttccagtaccaggtgaccaaggccacctgcttccagcccctgcggcagagggtggacaccatggagaacagcgccatcaagatcctgcgggagagggtcatcagcaggaagagtgacctgacccgggccttccagctgcaggaccacaggaagagcggcaagctgtctgtgtcccagtgggccttctgcatggagaacatcctgggcctgaacctgccctggaggagcctgagcagcaacctggtgaacatcgaccagaatggaaatgtggagtacatgagcagcttccagaacatcagaattgagaagcctgtgcaggaggcccacagcaccctggtggagaccctgtaccgctacagaagtgacctggagatcatcttcaatgccatcgacacagaccacagcggcctcatctctgtggaggagttccgggccatgtggaagctgttcagcagccactacaacgtgcacattgatgacagccaggtgaacaagctggccaacatcatggacctgaacaaggatggcagcattgacttcaatgagttcctgaaggccttctacgtggtgcacagatatgaggacctgatgaagccagatgtgaccaacctgggctag

SEQ ID NO: 166210 - DNA, 1131 bp, Artificial Sequence
  Description of Artificial Sequence: Synthetic coding sequence
atgggctgcagcagcagcagcaccaagaccaggagaagtgacaccagcctgcgggccgccctgatcatccagaactggtaccggggctacaaggcccggctgaaggcccggcagcactacgccctgaccatcttccagagcattgaatatgcagatgagcagggccagatgcagctgagcaccttcttctccttcatgctggagaactacacccacatccacaaggaggagctggagctgaggaaccagagcctggagagcgagcaggacatgagggaccgctgggactatgtggacagcattgatgtgcctgacagctacaacggcccccggctgcagttccccctgacctgcacagacatcgacctgctgctggaggccttcaaggagcagcagatcctgcacgcccactacgtgctggaggtgctgtttgagaccaagaaggtgctgaagcagatgcccaacttcacccacatccagaccagccccagcaaggaggtgaccatctgtggggacctgcacggcaagctggatgacctcttcctgatcttctacaagaatggcctgcccagcgagaggaacccctacgtgttcaatggagactttgtggaccggggcaagaacagcattgagatcctgatgatcctgtgtgtgtccttcctggtgtacccaaatgacctgcacctgaacagaggcaaccacgaggacttcatgatgaacctgcgctatggcttcaccaaggagatcctgcacaagtacaagctgcacggcaagaggatcctgcagatcctggaggagttctacgcctggctgcccatcggcaccatcgtggacaatgagatcctggtgattcatggaggcatcagcgagaccacagacctgaacctgctgcaccgggtggagaggaacaagatgaagtctgtgctgatccccccaacagagaccaacagagaccatgacacagacagcaagcacaacaaggtgggcgtgaccttcaatgcccacggccgcatcaagaccaacggcagccccacagagcacctgacagaacatgagtgggagcagagcggctactacggcaagcagaggcaccaggacatcaagcgggagagtgacttcaccaagaagtag

SEQ ID NO: 166211 - DNA, 1767 bp, Artificial Sequence
  Description of Artificial Sequence: Synthetic coding sequence
atgctggagaactacacccacatccacaaggaggagctggagctgaggaaccagagcctggagagcgagcaggacatgagggaccgctgggactatgtggacagcattgatgtgcctgacagctacaacggcccccggctgcagttccccctgacctgcacagacatcgacctgctgctggaggccttcaaggagcagcagatcctgcacgcccactacgtgctggaggtgctgtttgagaccaagaaggtgctgaagcagatgcccaacttcacccacatccagaccagccccagcaaggaggtgaccatctgtggggacctgcacggcaagctggatgacctcttcctgatcttctacaagaatggcctgcccagcgagaggaacccctacgtgttcaacggggactttgtggaccggggcaagaacagcattgagatcctgatgatcctgtgtgtgtccttcctggtgtacccaaatgacctgcacctgaacagaggcaaccacgaggacttcatgatgaacctgcgctatggcttcaccaaggagatcctgcacaagtacaagctgcacggcaagaggatcctgcagatcctggaggagttctacgcctggctgcccatcggcaccatcgtggacaatgagatcctggtgatccacggcggcatcagcgagaccacagacctgaacctgctgcaccgggtggagaggaacaagatgaagtctgtgctgatccccccaacagagaccaacagagaccatgacacagacagcaagcacaacaaggtgggcgtgaccttcaatgcccacggccgcatcaagaccaacggcagccccacagagcacctgacagagcacgagtgggagcagatcatcgacatcctgtggagcgacccccggggcaagaatggctgcttccccaacacctgccggggcggcggctgctactttggaccagatgtgaccagcaagatcctgaacaagtaccagctgaagatgctgatccgcagccatgagtgcaagccagagggctatgagatctgccatgatggcaaggtggtgaccatcttcagcgccagcaactactatgaggagggcagcaacagaggagcctacatcaagctgtgcagcggcaccaccccccgcttcttccagtaccaggtgaccaaggccacctgcttccagcccctgcggcagagggtggacaccatggagaacagcgccatcaagatcctgcgggagagggtcatcagcaggaagagtgacctgacccgggccttccagctgcaggaccacaggaagagcggcaagctgtctgtgtcccagtgggccttctgcatggagaacatcctgggcctgaacctgccctggaggagcctgagcagcaacctggtgaacatcgaccagaatggaaatgtggagtacatgagcagcttccagaacatccgcatcgagaagcctgtgcaggaggcccacagcaccctggtggagaccctgtaccgctacagaagtgacctggagatcatcttcaatgccatcgacacagaccacagcggcctcatctctgtggaggagttccgggccatgtggaagctgttcagcagccactacaacgtgcacattgatgacagccaggtgaacaagctggccaacatcatggacctgaacaaggatggcagcattgacttcaatgagttcctgaaggccttctacgtggtgcacagatatgaggacctgatgaagccagatgtgaccaacctgggctag

SEQ ID NO: 166212 - DNA, 2262 bp, Artificial Sequence
  Description of Artificial Sequence: Synthetic coding sequence
atgggcagcggcaccagcacccagcaccactttgccttccagaatgctgagcgggccttcaaggctgctgccctgatccagcgctggtacagaagatatgtggcccggctggagatgagaagacgctgcacctggagcatcttccagagcattgaatatgccggccagcaggaccaggtgaagctgcatgacttcttctcctacctgatggaccacttcatccccagcagccacaatgaccgggacttcctgacccgcatcttcacagaggacagatttgcccaggacagcgagatgaagaagtgcagcgactatgagagcattgaggtgcctgacagctacacaggcccccggctgtccttccccctgctgcctgaccacgccacagccctggtggaggccttccggctgaagcagcagctgcacgcccgctacgtgctgaacctgctgtatgagaccaagaagcacctggtgcagctgcccaacatcaacagagtgtccacctgctacagcgaggagatcaccgtgtgtggggacctgcacggccagctggatgacctgatcttcatcttctacaagaatggcctgcccagccctgagaggagctatgtgttcaacggggactttgtggaccggggcaaggacagcgtggagatcctgatgatcctgtttgccttcatgctggtgtaccccaaggagttccacctgaacagaggcaaccacgaggaccacatggtgaacctgcgctatggcttcaccaaggaggtgatgaacaagtacaaggtgcacggcaaggagatcctgcggaccctgcaggatgtgttctgctggctgcccctggccaccctgattgatgagaaggtgctgatcctgcacggcggcgtgtctgacatcacagacctggagctgctggacaagattgaaagaagcaagatcgtgtccaccatgcgctgcaagacccggcagaagtctgagaagcagatggaggagaagaggcgggccaaccagaagagcagcgcccagggccccatcccctggttcctgcctgagagccgcagcctgcccagcagccccctgcggctgggcagctacaaggcccagaagaccagccgcagcagcagcatcccctgcagcggcagcctggatggccgggagctgagccggcaggtgcgcagctctgtggagctggagctggagcgctgccggcagcaggccggcctgctggtgactggagagaaggaggagcccagccgcagcgccagcgaggccgacagcgaggccggggagctgaggaagcccacccaggaggagtggaggcaggtggtggacatcctgtggagcgaccccatggcccaggagggctgcaaggccaacaccatccggggcggcggctgctactttggaccagatgtgacccagcagctgctgcagaagtacaacatgcagttcctgatccgcagccatgagtgcaagccagagggctatgagttctgccacaacaggaaggtgctgaccatcttcagcgccagcaactactatgaggtgggcagcaacagaggagcctacgtgaagctgggccctgccctgaccccccacatcgtgcagtaccaggccaacaaggtgacccacaccctgaccatgaggcagaggatcagccgggtggaggagagcgccctgcgggccctgcgggagaagctgtttgcccacagcagtgacctgctgtctgagttcaagaagcatgatgctgacaaggtgggcctcatcaccctgagtgactgggccgctgctgtggagagcgtgctgcacctgggcctgccctggaggatgctgcggccccagctggtgaacagcagcgctgacaacatgctggagtacaagtcctggctgaagaacctggccaaggagcagctgagccgggagaacatccagagcagcctgctggagaccctgtacagaaacagaagcaacctggagaccatcttccgcatcatcgacagcgaccacagcggcttcatcagcctggatgagttccggcagacctggaagctgttcagcagccacatgaacatcgacatcacagatgactgcatctgtgacctggcccggagcattgacttcaacaaggatggccacatcgacatcaatgagttcctggaggccttccggctggtggagaagagctgcccagaaggagatgcctctgaatgtccccaggccaccaatgccaaggacagcggctgcagcagccctggggcccactag

SEQ ID NO: 166213 - DNA, 1797 bp, Artificial Sequence
  Description of Artificial Sequence: Synthetic coding sequence
atgggcagcggcaccagcacccagcaccactttgccttccagaatgctgagcgggccttcaaggctgctgccctgatccagcgctggtacagaagatatgtggcccggctggagatgagaagacgctgcacctggagcatcttccagagcattgaatatgccggccagcaggaccaggtgaagctgcatgacttcttctcctacctgatggaccacttcatccccagcagccacaatgaccgggacttcctgacccgcatcttcacagaggacagatttgcccaggacagcgagatgaagaagtgcagcgactatgagagcattgaggtgcctgacagctacacaggcccccggctgtccttccccctgctgcctgaccacgccacagccctggtggaggccttccggctgaagcagcagctgcacgcccgctacgtgctgaacctgctgtatgagaccaagaagcacctggtgcagctgcccaacatcaacagagtgtccacctgctacagcgaggagatcaccgtgtgtggggacctgcacggccagctggatgacctgatcttcatcttctacaagaatggcctgcccagccctgagaggagctatgtgttcaacggggactttgtggaccggggcaaggacagcgtggagatcctgatgatcctgtttgccttcatgctggtgtaccccaaggagttccacctgaacagaggcaaccacgaggaccacatggtgaacctgcgctatggcttcaccaaggaggtgatgaacaagtacaaggtgcacggcaaggagatcctgcggaccctgcaggatgtgttctgctggctgcccctggccaccctgattgatgagaaggtgctgatcctgcacggcggcgtgtctgacatcacagacctggagctgctggacaagattgaaagaagcaagatcgtgtccaccatgcgctgcaagacccggcagaagtctgagaagcagatggaggagaagaggcgggccaaccagaagagcagcgcccagggccccatcccctggttcctgcctgagagccgcagcctgcccagcagccccctgcggctgggcagctacaaggcccagaagaccagccgcagcagcagcatcccctgcagcggcagcctggatggccgggagctgagccggcaggtgcgcagctctgtggagctggagctggagcgctgccggcagcaggccggcctgctggtgactggagagaaggaggagcccagccgcagcgccagcgaggccgacagcgaggccggggagctgaggaagcccacccaggaggagtggaggcaggtggtggacatcctgtggagcgaccccatggcccaggagggctgcaaggccaacaccatccggggcggcggctgctactttggaccagatgtgacccagcagctgctgcagaagtacaacatgcagttcctgatccgcagccatgagtgcaagccagagggctatgagttctgccacaacaggaaggtgctgaccatcttcagcgccagcaactactatgaggtgggcagcaacagaggagcctacgtgaagctgggccctgccctgaccccccacatcgtgcagtaccaggccaacaaggtgacccacaccctgaccatgaggcagaggatcagccgggtggaggagagcgccctgcgggccctgcgggagaagctgtttgcccacagcagtgacctgctgtctgagttcaagaagcatgatgctgacaaggtgggcctggccagcagccagctgtgctactaccagcagaagtag

SEQ ID NO: 166214 - DNA, 1440 bp, Artificial Sequence
  Description of Artificial Sequence: Synthetic coding sequence
atgggcgccttcctggacaagcccaagacagagaagcacaatgcccacggggctggaaatggcctgcgctatggcctgagctccatgcagggctggagggtggagatggaggatgcccacacagctgtggtgggcatcccccacggcctggaggactggagcttctttgctgtgtatgatggccatgctggcagccgggtggccaactactgcagcacccacctgctggagcacatcaccaccaatgaagacttccgggccgccggcaagagcggcagcgccctggagctgtctgtggagaatgtgaagaatggcatcagaacaggcttcctgaagattgatgagtacatgaggaacttcagtgacctgagaaatggcatggacaggagcggcagcacagctgtgggcgtgatgatcagccccaagcacatctacttcatcaactgtggggacagcagagctgtgctgtacagaaatggccaggtgtgcttcagcacccaggaccacaagccctgcaacccccgggagaaggagcgcatccagaatgccggcggctctgtgatgatccagagggtgaatggcagcctggccgtgtcccgggccctgggggactatgactacaagtgtgtggatggcaagggccccacagagcagctggtgtccccagagcctgaggtgtatgagatcctgcgggcagaggaggatgagttcatcatcctggcctgtgatggcatctgggatgtgatgagcaatgaggagctgtgtgaatatgtgaagagccggctggaggtgtctgatgacctggagaatgtgtgcaactgggtggtggacacctgcctgcacaagggcagccgggacaacatgagcatcgtgctggtgtgcttcagcaatgcccccaaggtgtctgatgaagctgtgaagaaggacagcgagctggacaagcacctggagagccgggtggaggagatcatggagaagtctggagaggagggcatgccagacctggcccacgtgatgaggatcctgtctgctgagaacatccccaacctgcccccaggcggcggcctggccggcaagagaaatgtgattgaagctgtgtacagccggctgaacccccaccgggagagtgatggagccagtgatgaagctgaggagagcggcagccagggcaagctggtggaggccctgcggcagatgaggatcaaccaccggggcaactaccggcagctgctggaggagatgctgaccagctaccgcctggccaaggtggagggggaggagagccctgctgagcctgctgccacagccaccagcagcaacagtgatgctggcaaccctgtgaccatgcaggagagccacacagagagcgagagcggcctggccgagctggacagcagcaatgaagatgctggcaccaagatgtctggagagaagatctag

SEQ ID NO: 166215 - DNA, 579 bp, Artificial Sequence
  Description of Artificial Sequence: Synthetic coding sequence
atgagcatcgtgctggtgtgcttcagcaatgcccccaaggtgtctgatgaggccgtgaagaaggacagcgagctggacaagcacctggagagccgggtggaggagatcatggagaagagcggggaggagggcatgccagacctggcccacgtgatgaggatcctgtctgctgagaacatccccaacctgcccccaggcggcggcctggccggcaagagaaatgtcatcgaggccgtgtacagccggctgaacccccaccgggagagtgatggagccagtgatgaggccgaggagagcggcagccagggcaagctggtggaggccctgcggcagatgaggatcaaccaccggggcaactaccggcagctgctggaggagatgctgaccagctaccgcctggccaaggtggagggggaggagagccctgctgagcctgctgccacagccaccagcagcaacagtgatgctggcaaccctgtgaccatgcaggagagccacacagaaagtgaaagtggcctggccgagctggacagcagcaatgaagatgctggcaccaagatgtctggagagaagatctag

SEQ ID NO: 166216 - DNA, 1164 bp, Artificial Sequence
  Description of Artificial Sequence: Synthetic coding sequence
atgggcgccttcctggacaagcccaagacagagaagcacaatgcccacggggctggaaatggcctgcgctatggcctgagctccatgcagggctggagggtggagatggaggatgcccacacagctgtggtgggcatcccccacggcctggaggactggagcttctttgctgtgtatgatggccatgctggcagccgggtggccaactactgcagcacccacctgctggagcacatcaccaccaatgaagacttccgggccgccggcaagagcggcagcgccctggagctgtctgtggagaatgtgaagaatggcatcagaacaggcttcctgaagattgatgagtacatgaggaacttcagtgacctgagaaatggcatggacaggagcggcagcacagctgtgggcgtgatgatcagccccaagcacatctacttcatcaactgtggggacagcagagctgtgctgtacagaaatggccaggtgtgcttcagcacccaggaccacaagccctgcaacccccgggagaaggagcgcatccagaatgccggcggctctgtgatgatccagagggtgaatggcagcctggccgtgtcccgggccctgggggactatgactacaagtgtgtggatggcaagggccccacagagcagctggtgtccccagagcctgaggtgtatgagatcctgcgggcagaggaggatgagttcatcatcctggcctgtgatggcatctgggatgtgatgagcaatgaggagctgtgtgaatatgtgaagagccggctggaggtgtctgatgacctggagaatgtgtgcaactgggtggtggacacctgcctgcacaagggcagccgggacaacatgagcatcgtgctggtgtgcttcagcaatgcccccaaggtgtctgatgaagctgtgaagaaggacagcgagctggacaagcacctggagagccgggtggaggagatcatggagaagtctggagaggagggcatgccagacctggcccacgtgatgaggatcctgtctgctgagaacatccccaacctgcccccaggcggcggcctggccggcaagagaaatgtgattgaagctgtgtacagccggctgaacccccaccgggagagtgatggaggagctggggacctggaggacccctggtag

SEQ ID NO: 166217 - DNA, 1143 bp, Artificial Sequence
  Description of Artificial Sequence: Synthetic coding sequence
atgggcgccttcctggacaagcccaagacagagaagcacaatgcccacggggctggaaatggcctgcgctatggcctgagctccatgcagggctggagggtggagatggaggatgcccacacagctgtggtgggcatcccccacggcctggaggactggagcttctttgctgtgtatgatggccatgctggcagccgggtggccaactactgcagcacccacctgctggagcacatcaccaccaatgaagacttccgggccgccggcaagagcggcagcgccctggagctgtctgtggagaatgtgaagaatggcatcagaacaggcttcctgaagattgatgagtacatgaggaacttcagtgacctgagaaatggcatggacaggagcggcagcacagctgtgggcgtgatgatcagccccaagcacatctacttcatcaactgtggggacagcagagctgtgctgtacagaaatggccaggtgtgcttcagcacccaggaccacaagccctgcaacccccgggagaaggagcgcatccagaatgccggcggctctgtgatgatccagagggtgaatggcagcctggccgtgtcccgggccctgggggactatgactacaagtgtgtggatggcaagggccccacagagcagctggtgtccccagagcctgaggtgtatgagatcctgcgggcagaggaggatgagttcatcatcctggcctgtgatggcatctgggatgtgatgagcaatgaggagctgtgtgaatatgtgaagagccggctggaggtgtctgatgacctggagaatgtgtgcaactgggtggtggacacctgcctgcacaagggcagccgggacaacatgagcatcgtgctggtgtgcttcagcaatgcccccaaggtgtctgatgaagctgtgaagaaggacagcgagctggacaagcacctggagagccgggtggaggagatcatggagaagtctggagaggagggcatgccagacctggcccacgtgatgaggatcctgtctgctgagaacatccccaacctgcccccaggcggcggcctggccggcaagagaaatgtgattgaagctgtgtacagccggctgaacccccaccgggagagtgatggccagaagtag

SEQ ID NO: 166218 - DNA, 984 bp, Artificial Sequence
  Description of Artificial Sequence: Synthetic coding sequence
atgggcgccttcctggacaagcccaagacagagaagcacaatgcccacggggctggaaatggcctgcgctatggcctgagctccatgcagggctggagggtggagatggaggatgcccacacagctgtggtgggcatcccccacggcctggaggactggagcttctttgctgtgtatgatggccatgctggcagccgggtggccaactactgcagcacccacctgctggagcacatcaccaccaatgaagacttccgggccgccggcaagagcggcagcgccctggagctgtctgtggagaatgtgaagaatggcatcagaacaggcttcctgaagattgatgagtacatgaggaacttcagtgacctgagaaatggcatggacaggagcggcagcacagctgtgggcgtgatgatcagccccaagcacatctacttcatcaactgtggggacagcagagctgtgctgtacagaaatggccaggtgtgcttcagcacccaggaccacaagccctgcaacccccgggagaaggagcgcatccagaatgccggcggctctgtgatgatccagagggtgaatggcagcctggccgtgtcccgggccctgggggactatgactacaagtgtgtggatggcaagggccccacagagcagctggtgtccccagagcctgaggtgtatgagatcctgcgggcagaggaggatgagttcatcatcctggcctgtgatggcatctgggatgtgatgagcaatgaggagctgtgtgaatatgtgaagagccggctggaggtgtctgatgacctggagaatgtgtgcaactgggtggtggacacctgcctgcacaagggcagccgggacaacatgagcatcgtgctggtgtgcttcagcaatgcccccaaggtgtctgatgaagctgtgaagaaggacagcgagctggacaagcacctggagagccgggtggagggcaagaccaatgccttctag

SEQ ID NO: 166219 - DNA, 1137 bp, Artificial Sequence
  Description of Artificial Sequence: Synthetic coding sequence
atgggcgccttcctggacaagcccaagacagagaagcacaatgcccacggggctggaaatggcctgcgctatggcctgagctccatgcagggctggagggtggagatggaggatgcccacacagctgtggtgggcatcccccacggcctggaggactggagcttctttgctgtgtatgatggccatgctggcagccgggtggccaactactgcagcacccacctgctggagcacatcaccaccaatgaagacttccgggccgccggcaagagcggcagcgccctggagctgtctgtggagaatgtgaagaatggcatcagaacaggcttcctgaagattgatgagtacatgaggaacttcagtgacctgagaaatggcatggacaggagcggcagcacagctgtgggcgtgatgatcagccccaagcacatctacttcatcaactgtggggacagcagagctgtgctgtacagaaatggccaggtgtgcttcagcacccaggaccacaagccctgcaacccccgggagaaggagcgcatccagaatgccggcggctctgtgatgatccagagggtgaatggcagcctggccgtgtcccgggccctgggggactatgactacaagtgtgtggatggcaagggccccacagagcagctggtgtccccagagcctgaggtgtatgagatcctgcgggcagaggaggatgagttcatcatcctggcctgtgatggcatctgggatgtgatgagcaatgaggagctgtgtgaatatgtgaagagccggctggaggtgtctgatgacctggagaatgtgtgcaactgggtggtggacacctgcctgcacaagggcagccgggacaacatgagcatcgtgctggtgtgcttcagcaatgcccccaaggtgtctgatgaagctgtgaagaaggacagcgagctggacaagcacctggagagccgggtggaggagatcatggagaagtctggagaggagggcatgccagacctggcccacgtgatgaggatcctgtctgctgagaacatccccaacctgcccccaggcggcggcctggccggcaagagaaatgtgattgaagctgtgtacagccggctgaacccccaccgggagagtgatggatag

SEQ ID NO: 166220 - DNA, 1518 bp, Artificial Sequence
  Description of Artificial Sequence: Synthetic coding sequence
atgctgaacagagtgcgctctgctgtggcccacctggtgtcctctggaggagcccccccaccccggcccaagagcccagacctgcccaatgctgccagcgcccctcctgctgctgcccctgaggcccccaggagccccccagccaaggccggcagcggcagcgccaccccagccaaggctgtggaggcccgggccagcttcagccggcccaccttcctgcagctgagccctgggggcctgcggcgggcagatgaccatgctggccgggctgtgcagagccccccagacacaggaagaaggctgccctggagcacaggctacgccgaggtgatcaatgccggcaagagccgccacaatgaagaccaggcctgctgtgaggtggtgtatgtggagggcagaagatctgtgactggagtgccccgggagcccagccggggccagggcctgtgcttctactactggggcctgtttgatggccatgctgggggcggcgctgctgagatggccagccggctgctgcaccgccacatccgggagcagctgaaggacctggtggagatcctgcaggaccccagccccccacccctgtgcctgcccaccaccccaggcaccccagacagcagtgaccccagccacctgctgggcccccagagctgctggagcagccagaaggaggtgtcccatgagagcctggtggtgggcgctgtggagaatgccttccagctgatggatgagcagatggcccgggagcggcggggccaccaggtggagggcggctgctgtgccctggtggtgatctacctgctgggcaaggtgtatgtggccaatgctggggacagccgggccatcatcgtgagaaatggagagatcatccccatgagccgggagttcaccccagagacagagcggcagaggctgcagctgctgggcttcctgaagccagagctgctgggcagcgagttcacccacctggagttcccccggcgggtgctgcccaaggagctgggccagaggatgctgtacagagaccagaacatgacaggctgggcctacaagaagattgagctggaggacctgcgcttccccctggtgtgtggggagggcaagaaggcccgggtgatggccaccatcggcgtgacccggggcctgggggaccacagcctgaaggtgtgcagcagcaccctgcccatcaagcccttcctgagctgcttccctgaggtgcgggtgtatgacctgacccagtatgagcactgcccagatgatgtgctggtgctgggcacagatggcctgtgggatgtgaccacagactgtgaggtggccgccaccgtggacagagtgctgagcgcctatgagcccaatgaccacagccgctacacagccctggcccaggccctggtgctgggcgcccggggcaccccccgggaccggggctggaggctgcccaacaacaagctgggcagcggagatgacatctctgtgtttgtgatccccctgggcggccctggcagctacagctag

SEQ ID NO: 166221 - DNA, 900 bp, Artificial Sequence
  Description of Artificial Sequence: Synthetic coding sequence
atggccagccggctgctgcaccgccacatccgggagcagctgaaggacctgaaggaggtgtcccatgagagcctggtggtgggcgctgtggagaatgccttccagctgatggatgagcagatggcccgggagcggcggggccaccaggtggagggcggctgctgtgccctggtggtgatctacctgctgggcaaggtgtatgtggccaatgctggggacagccgggccatcatcgtgagaaatggagagatcatccccatgagccgggagttcaccccagagacagagcggcagaggctgcagctgctgggcttcctgaagccagagctgctgggcagcgagttcacccacctggagttcccccggcgggtgctgcccaaggagctgggccagaggatgctgtacagagaccagaacatgacaggctgggcctacaagaagattgagctggaggacctgcgcttccccctggtgtgtggggagggcaagaaggcccgggtgatggccaccatcggcgtgacccggggcctgggggaccacagcctgaaggtgtgcagcagcaccctgcccatcaagcccttcctgagctgcttccctgaggtgcgggtgtatgacctgacccagtatgagcactgcccagatgatgtgctggtgctgggcacagatggcctgtgggatgtgaccacagactgtgaggtggccgccaccgtggacagagtgctgagcgcctatgagcccaatgaccacagccgctacacagccctggcccaggccctggtgctgggcgcccggggcaccccccgggaccggggctggaggctgcccaacaacaagctgggcagcggagatgacatctctgtgtttgtgatccccctgggcggccctggcagctacagctag

SEQ ID NO: 166222 - DNA, 1119 bp, Artificial Sequence
  Description of Artificial Sequence: Synthetic coding sequence
atgagcacagctgccctgatcaccctggtgcgcagcggcggcaaccaggtgagaagaagagtgctgctgagcagccggctgctgcaggatgaccggcgggtgacccccacctgccacagcagcaccagcgagccccgctgcagcagatttgatcctgatggcagcggcagccctgccacctgggacaactttggcatctgggacaacagaattgatgagcccatcctgctgccccccagcatcaagtatggcaagcccatccccaagatcagcctggagaatgtgggctgtgccagccagatcggcaagaggaaagaaaatgaagatagatttgattttgcccagctgacagatgaggtgctgtactttgctgtgtatgatggccatggaggccctgctgctgctgacttctgccacacccacatggagaagtgcatcatggacctgctgcccaaggagaagaacctggagaccctgctgaccctggccttcctggagattgacaaggccttcagcagccacgcccggctgtctgcagatgccaccctgctgaccagcggcaccacagccaccgtggccctgctgagagatggcatcgagctggtggtggcctctgtgggggacagccgggccatcctgtgcaggaagggcaagcccatgaagctgaccatcgaccacaccccagagaggaaggatgagaaggagcgcatcaagaagtgtggcggctttgtggcctggaacagcctgggccagccccacgtgaatggccgcctggccatgaccaggagcatcggggacctggacctgaagaccagcggcgtgattgctgagcctgagaccaagaggatcaagctgcaccacgcagatgacagcttcctggtgctgaccacagatggcatcaacttcatggtgaacagccaggagatctgtgactttgtgaaccagtgccacgaccccaatgaggccgcccatgctgtgacagagcaggccatccagtatggaacagaggacaacagcacagctgtggtggtgccctttggagcctggggcaagtacaagaacagcgagatcaacttctccttcagccgcagctttgccagcagcggccgctgggcctag

SEQ ID NO: 166223 - DNA, 702 bp, Artificial Sequence
  Description of Artificial Sequence: Synthetic coding sequence
atgagcacagctgccctgatcaccctggtgcgcagcggcggcaaccaggtgagaagaagagtgctgctgagcagccggctgctgcaggatgaccggcgggtgacccccacctgccacagcagcaccagcgagccccgctgcagcagatttgatcctgatggcagcggcagccctgccacctgggacaactttggcatctgggacaacagaattgatgagcccatcctgctgccccccagcatcaagtatggcaagcccatccccaagatcagcctggagaatgtgggctgtgccagccagatcggcaagaggaaagaaaatgaagatagatttgattttgcccagctgacagatgaggtgctgtactttgctgtgtatgatggccatggaggccctgctgctgctgacttctgccacacccacatggagaagtgcatcatggacctgctgcccaaggagaagaacctggagaccctgctgaccctggccttcctggagattgacaaggccttcagcagccacgcccggctgtctgcagatgagaactgtgcctggagcgctgccctggacctggagcctgtggacaccatctgtggggcctctgtggagcgggagatctgcctgatcctgagccaggtgaaggagagcagcggcagctacccaggcctgcgggagggcagccacatcagcctgagccactag

SEQ ID NO: 166224 - DNA, 702 bp, Artificial Sequence; identical to SEQ ID NO: 166223
  Description of Artificial Sequence: Synthetic coding sequence

SEQ ID NO: 166225 - DNA, 585 bp, Artificial Sequence
  Description of Artificial Sequence: Synthetic coding sequence
atgattgaggacaccatgaccctgctgagcctgctgggccgcatcatgagatacttcctgctgcggcctgagaccctcttcctgctgtgcatcagcctggccctgtggagctacttcttccacacagatgaggtgaagaccatcgtgaagagcagcagagatgctgtgaagatggtgaagggcaaggtggccgagatcatgcagaatgaccggctgggcggcctggatgtgctggaggccgagttcagcaagacctgggagttcaagaaccacaacgtggccgtgtacagcatccagggcagaagagaccacatggaggacagatttgaggtgctgacagacctggccaacaagacccaccccagcatcttcggcatctttgatggccacggcggggagacagctgctgaatatgtgaagagccggctgcctgaggccctgaagcagcacctgcaggactatgagaaggacaaggaaaattctgtgctgagctaccagaccatcctggagcagcagatcctgagcattgaccgggagatgctggagaagctgactgtgtcctatgatgaagctgtgaccttctag

SEQ ID NO: 166226 - DNA, 1083 bp, Artificial Sequence
  Description of Artificial Sequence: Synthetic coding sequence
atgattgaggacaccatgaccctgctgagcctgctgggccgcatcatgagatacttcctgctgcggcctgagaccctcttcctgctgtgcatcagcctggccctgtggagctacttcttccacacagatgaggtgaagaccatcgtgaagagcagcagagatgctgtgaagatggtgaagggcaaggtggccgagatcatgcagaatgaccggctgggcggcctggatgtgctggaggccgagttcagcaagacctgggagttcaagaaccacaacgtggccgtgtacagcatccagggcagaagagaccacatggaggacagatttgaggtgctgacagacctggccaacaagacccaccccagcatcttcggcatctttgatggccacggcggggagacagctgctgaatatgtgaagagccggctgcctgaggccctgaagcagcacctgcaggactatgagaaggacaaggaaaattctgtgctgagctaccagaccatcctggagcagcagatcctgagcattgaccgggagatgctggagaagctgactgtgtcctatgatgaagctggcaccacctgcctgattgccctgctgagtgacaaggacctgactgtggccaacgtgggggacagcagaggagtgctgtgtgacaaggatggaaatgccatccccctgagccatgaccacaagccctaccagctgaaggagaggaagaggatcaagagagctgggggcttcatctccttcaacggctcctggagggtgcagggcatcctggccatgagccgcagcctgggggactaccccctgaagaacctgaatgtggtgatcccagaccctgacatcctgacctttgacctggacaagctgcagcctgagttcatgatcctggccagtgatggcctgtgggatgccttcagcaatgaggaggccgtgcgcttcatcaaggagcggctggatgagccccactttggagccaagagcatcgtgctgcagagcttctaccggggctgcccagacaacatcaccgtgatggtggtgaagttcaggaacagcagcaagacagaggagcagtag

SEQ ID NO: 166227 - DNA, 813 bp, Artificial Sequence
  Description of Artificial Sequence: Synthetic coding sequence
atgcacctgaatggccgctgcatctgccccagcgacccccagtttgtggaggagaagggcatccgggcagaggacctggtgattggagccctggagagcgccttccaggagtgtgatgaagtcatcggccgggagctggaggccagcggccagatgggcggctgcacagccctggtggccgtgtccctgcagggcaagctgtacatggccaatgctggggacagccgggccatcctggtgagaagagatgagatccggcccctgagctttgagttcaccccagagacagagcggcagaggatccagcagctggcctttgtgtacccagagctgctggccggggagttcacccggctggagttcccccggcggctgaagggagatgacctgggccagaaggtgctcttccgggaccaccacatgagcggctggagctacaagagggtggagaagagtgacctgaagtaccccctcatccacggccagggccggcaggcccggctgctgggcaccctggccgtgtcccggggcctgggggaccaccagctgcgggtgctggacaccaacatccagctgaagcccttcctgctgtctgtgccccaggtgacagtgctggatgtggaccagctggagctgcaggaggatgatgtggtggtgatggccacagatggcctgtgggatgtgctgagcaatgagcaggtggcctggctggtgcgctccttcctgcccggcaaccaggaggacccccaccgctactgcagctgctggggccctgcctgggcctgggtgggcgccagcagcaagcccaagtag

SEQ ID NO: 166228 - DNA, 897 bp, Artificial Sequence
  Description of Artificial Sequence: Synthetic coding sequence
atgcacctgaatggccgctgcatctgccccagcgacccccagtttgtggaggagaagggcatccgggcagaggacctggtgattggagccctggagagcgccttccaggagtgtgatgaagtcatcggccgggagctggaggccagcggccagatgggcggctgcacagccctggtggccgtgtccctgcagggcaagctgtacatggccaatgctggggacagccgggccatcctggtgagaagagatgagatccggcccctgagctttgagttcaccccagagacagagcggcagaggatccagcagctggcctttgtgtacccagagctgctggccggggagttcacccggctggagttcccccggcggctgaagggagatgacctgggccagaaggtgctcttccgggaccaccacatgagcggctggagctacaagagggtggagaagagtgacctgaagtaccccctcatccacggccagggccggcaggcccggctgctgggcaccctggccgtgtcccggggcctgggggaccaccagctgcgggtgctggacaccaacatccagctgaagcccttcctgctgtctgtgccccaggtgacagtgctggatgtggaccagctggagctgcaggaggatgatgtggtggtgatggccacagatggcctgtgggatgtgctgagcaatgagcaggtggcctggctggtgcgctccttcctgcccggcaaccaggaggacccccaccgcttcagcaagctggcccagatgctgatccacagcacccagggcaaggaggacagcctgacagaggagggccaggtgtcctatgatgatgtgtctgtgtttgtgatccccctgcacagccagggccaggagagcagtgaccactag

SEQ ID NO: 166229 - DNA, 744 bp, Artificial Sequence
  Description of Artificial Sequence: Synthetic coding sequence
atgggcggctgcacagccctggtggccgtgtccctgcagggcaagctgtacatggccaatgctggggacagccgggccatcctggtgagaagagatgagatccggcccctgagctttgagttcaccccagagacagagcggcagaggatccagcagctggcctttgtgtacccagagctgctggccggggagttcacccggctggagttcccccggcggctgaagggagatgacctgggccagaaggtgctcttccgggaccaccacatgagcggctggagctacaagagggtggagaagagtgacctgaagtaccccctcatccacggccagggccggcaggcccggctgctgggcaccctggccgtgtcccggggcctgggggaccaccagctgcgggtgctggacaccaacatccagctgaagcccttcctgctgtctgtgccccaggtgacagtgctggatgtggaccagctggagctgcaggaggatgatgtggtggtgatggccacagatggcctgtgggatgtgctgagcaatgagcaggtggcctggctggtgcgctccttcctgcccggcaaccaggaggacccccaccgcttcagcaagctggcccagatgctgatccacagcacccagggcaaggaggacagcctgacagaggagggccaggtgtcctatgatgatgtgtctgtgtttgtgatccccctgcacagccagggccaggagagcagtgaccactag

SEQ ID NO: 166230 - DNA, 1380 bp, Artificial Sequence
  Description of Artificial Sequence: Synthetic coding sequence
atgtctgctggctggttcagaagacgcttcctgcccggggagcccctgcctgcccccaggcctcctggcccccacgccagccctgtgccctaccgccggccccgcttcctgcggggcagcagcagcagccctggagctgctgatgccagcagaagaccagacagcaggcctgtgcgcagccctgcccggggccgcaccctgccctggaatgccggctacgccgagatcatcaatgctgagaagtctgagttcaatgaagaccaggccgcctgtgggaagctgtgcatcagaagatgtgaatttggagctgaggaggagtggctgaccctgtgcccagaggagttcctgaccggccactactgggccctgtttgatggccatggaggccctgctgctgccatcctggccgccaacaccctgcacagctgcctgcggcggcagctggaggccgtggtggagggcctggtggccacccagccccccatgcacctgaatggccgctgcatctgccccagcgacccccagtttgtggaggagaagggcatccgggcagaggacctggtgattggagccctggagagcgccttccaggagtgtgatgaggtgattggccgggagctggaggccagcggccagatgggcggctgcacagccctggtggccgtgtccctgcagggcaagctgtacatggccaatgctggggacagccgggccatcctggtgagaagagatgagatccggcccctgagctttgagttcaccccagagacagagcggcagaggatccagcagctggcctttgtgtacccagagctgctggccggggagttcacccggctggagttcccccggcggctgaagggagatgacctgggccagaaggtgctcttccgggaccaccacatgagcggctggagctacaagagggtggagaagagtgacctgaagtaccccctcatccacggccagggccggcaggcccggctgctgggcaccctggccgtgtcccggggcctgggggaccaccagctgcgggtgctggacaccaacatccagctgaagcccttcctgctgtctgtgccccaggtgacagtgctggatgtggaccagctggagctgcaggaggatgatgtggtggtgatggccacagatggcctgtgggatgtgctgagcaatgagcaggtggcctggctggtgcgctccttcctgcccggcaaccaggaggacccccaccgcttcagcaagctggcccagatgctgatccacagcacccagggcaaggaggacagcctgacagaggagggccaggtgtcctatgatgatgtgtctgtgtttgtgatccccctgcacagccagggccaggagagcagtgaccactag

SEQ ID NO: 166231 - DNA, 1821 bp, Artificial Sequence
  Description of Artificial Sequence: Synthetic coding sequence
atgagaagaagtgaggtgctggccgaggagagcatcgtgtgcctgcagaaggccctgaaccacctgcgggagatctgggagctgattggcatccctgaggaccagaggctgcagaggacagaggtggtgaagaagcacatcaaggagctgctggacatgatgattgctgaggaggagagcctgaaggagcggctcatcaagagcatctctgtgtgccagaaggagctgaacaccctgtgcagcgagctgcacgtggagcccttccaggaggagggggagaccaccatcctgcagctggagaaggacctgcggacccaggtggagctgatgaggaagcagaagaaggagaggaagcaggagctgaagctgctgcaggagcaggaccaggagctgtgtgagatcctgtgcatgccccactatgacatcgacagcgcctctgtgcccagcctggaggagctgaaccagttccggcagcacgtgaccaccctgcgggagaccaaggccagccggcgggaggagtttgtgtccatcaagaggcagatcatcctgtgcatggaggccctggaccacaccccagacaccagctttgaaagagatgtggtgtgtgaagatgaagatgccttctgcctgagcctggagaacatcgccaccctgcagaagctgctgcggcagctggagatgcagaagagccagaatgaggccgtgtgtgagggcctgcggacccagatccgggagctgtgggaccggctgcagatccctgaggaggagcgggaggccgtggccaccatcatgagcggcagcaaggccaaggtgaggaaggccctgcagctggaggtggaccggctggaggagctgaagatgcagaacatgaagaaggtgattgaggccatccgggtggagctggtgcagtactgggaccagtgcttctacagccaggagcagaggcaggcctttgcccccttctgtgccgaggactacacagagagcctgctgcagctgcatgatgctgagatcgtgcggctgaagaactactatgaggtgcacaaggagctgtttgagggcgtgcagaagtgggaggagacctggaggctcttcctggagtttgagaggaaggccagtgaccccaaccgcttcaccaacagaggaggcaacctgctgaaggaggagaagcagagggccaagctgcagaagatgctgcccaagctggaggaggagctgaaggcccgcatcgagctgtgggagcaggagcacagcaaggccttcatggtgaatggccagaagttcatggagtatgtggccgagcagtgggagatgcaccggctggagaaggagcgggccaagcaggagcggcagctgaagaacaagaagcagacagaaacagagatgctgtatggcagcgcccccaggacccccagcaagaggcggggcctggcccccaacacccctgggaaggccaggaagctgaacaccaccaccatgagcaatgccacagccaacagcagcatccggcccatctttggaggcaccgtgtaccacagccctgtgtcccggctgcccccatctggcagcaagcctgtggccgccagcacctgcagcggcaagaagacccccaggacaggccgccacggggccaacaaggagaacctggagctgaatggcagcatcctgagcggcggctacccaggcagcgcccccctgcagaggaacttcagcatcaacagcgtggccagcacctacagcgagtttgcccgggagctgagcaaggccagcaagagtgatgccaccagcggcatcctgaacagcaccaacatccagagctag

SEQ ID NO: 166232 - DNA, 1701 bp, Artificial Sequence
  Description of Artificial Sequence: Synthetic coding sequence
atgagaagaagtgaggtgctggccgaggagagcatcgtgtgcctgcagaaggccctgaaccacctgcgggagatctgggagctgattggcatccctgaggaccagaggctgcagaggacagaggtggtgaagaagcacatcaaggagctgctggacatgatgattgctgaggaggagagcctgaaggagcggctcatcaagagcatctctgtgtgccagaaggagctgaacaccctgtgcagcgagctgcacgtggagcccttccaggaggagggggagaccaccatcctgcagctggagaaggacctgcggacccaggtggagctgatgaggaagcagaagaaggagaggaagcaggagctgaagctgctgcaggagcaggaccaggagctgtgtgagatcctgtgcatgccccactatgacatcgacagcgcctctgtgcccagcctggaggagctgaaccagttccggcagcacgtgaccaccctgcgggagaccaaggccagccggcgggaggagtttgtgtccatcaagaggcagatcatcctgtgcatggaggccctggaccacaccccagacaccagctttgaaagagatgtggtgtgtgaagatgaagatgccttctgcctgagcctggagaacatcgccaccctgcagaagctgctgcggcagctggagatgcagaagagccagaatgaggccgtgtgtgagggcctgcggacccagatccgggagctgtgggaccggctgcagatccctgaggaggagcgggaggccgtggccaccatcatgagcggcagcaaggccaaggtgaggaaggccctgcagctggaggtggaccggctggaggagctgaagatgcagaacatgaagaaggtgattgaggccatccgggtggagctggtgcagtactgggaccagtgcttctacagccaggagcagaggcaggcctttgcccccttctgtgccgaggactacacagagagcctgctgcagctgcatgatgctgagatcgtgcggctgaagaactactatgaggtgcacaaggagctgtttgagggcgtgcagaagtgggaggagacctggaggctcttcctggagtttgagaggaaggccagtgaccccaaccgcttcaccaacagaggaggcaacctgctgaaggaggagaagcagagggccaagctgcagaagatgctgcccaagctggaggaggagctgaaggcccgcatcgagctgtgggagcaggagcacagcaaggccttcatggtgaatggccagaagttcatggagtatgtggccgagcagtgggagatgcaccggctggagaaggagcgggccaagcaggagcggcagctgaagaacaagaagcagacagaaacagagatgctgtatggcagcgcccccaggacccccagcaagaggcggggcctggcccccaacacccctgggaaggccaggaagctgaacaccaccaccatgagcaatgccacagccaacagcagcatccggcccatctttggaggcaccgtgtaccacagccctgtgtcccggctgcccccatctggcagcaagcctgtggccgccagcacctgcagcggcaagaagacccccaggacaggccgccacggggccaacaaggagaacctggagctgaatggcagcatcctgagcgcccggaccttcaagggcttccagatctag

SEQ ID NO: 166233 - DNA, 1863 bp, Artificial Sequence
  Description of Artificial Sequence: Synthetic coding sequence
atgagaagaagtgaggtgctggccgaggagagcatcgtgtgcctgcagaaggccctgaaccacctgcgggagatctgggagctgattggcatccctgaggaccagaggctgcagaggacagaggtggtgaagaagcacatcaaggagctgctggacatgatgattgctgaggaggagagcctgaaggagcggctcatcaagagcatctctgtgtgccagaaggagctgaacaccctgtgcagcgagctgcacgtggagcccttccaggaggagggggagaccaccatcctgcagctggagaaggacctgcggacccaggtggagctgatgaggaagcagaagaaggagaggaagcaggagctgaagctgctgcaggagcaggaccaggagctgtgtgagatcctgtgcatgccccactatgacatcgacagcgcctctgtgcccagcctggaggagctgaaccagttccggcagcacgtgaccaccctgcgggagaccaaggccagccggcgggaggagtttgtgtccatcaagaggcagatcatcctgtgcatggaggccctggaccacaccccagacaccagctttgaaagagatgtggtgtgtgaagatgaagatgccttctgcctgagcctggagaacatcgccaccctgcagaagctgctgcggcagctggagatgcagaagagccagaatgaggccgtgtgtgagggcctgcggacccagatccgggagctgtgggaccggctgcagatccctgaggaggagcgggaggccgtggccaccatcatgagcggcagcaaggccaaggtgaggaaggccctgcagctggaggtggaccggctggaggagctgaagatgcagaacatgaagaaggtgattgaggccatccgggtggagctggtgcagtactgggaccagtgcttctacagccaggagcagaggcaggcctttgcccccttctgtgccgaggactacacagagagcctgctgcagctgcatgatgctgagatcgtgcggctgaagaactactatgaggtgcacaaggagctgtttgagggcgtgcagaagtgggaggagacctggaggctcttcctggagtttgagaggaaggccagtgaccccaaccgcttcaccaacagaggaggcaacctgctgaaggaggagaagcagagggccaagctgcagaagatgctgcccaagctggaggaggagctgaaggcccgcatcgagctgtgggagcaggagcacagcaaggccttcatggtgaatggccagaagttcatggagtatgtggccgagcagtgggagatgcaccggctggagaaggagcgggccaagcaggagcggcagctgaagaacaagaagcagacagaaacagagatgctgtatggcagcgcccccaggacccccagcaagaggcggggcctggcccccaacacccctgggaaggccaggaagctgaacaccaccaccatgagcaatgccacagccaacagcagcatccggcccatctttggaggcaccgtgtaccacagccctgtgtcccggctgcccccatctggcagcaagcctgtggccgccagcacctgcagcggcaagaagacccccaggacaggccgccacggggccaacaaggagaacctggagctgaatggcagcatcctgagcggcggctacccaggcagcgcccccctgcagaggaacttcagcatcaacagcgtggccagcacctacagcgagtttgccaaggaccccagcctgagtgacagcagcacagtgggcctgcagcgggagctgagcaaggccagcaagagtgatgccaccagcggcatcctgaacagcaccaacatccagagctag

SEQ ID NO: 166234 - DNA, 1578 bp, Artificial Sequence
  Description of Artificial Sequence: Synthetic coding sequence
atgagaagaagtgaggtgctggccgaggagagcatcgtgtgcctgcagaaggccctgaaccacctgcgggagatctgggagctgattggcatccctgaggaccagaggctgcagaggacagaggtggtgaagaagcacatcaaggaggagggggagaccaccatcctgcagctggagaaggacctgcggacccaggtggagctgatgaggaagcagaagaaggagaggaagcaggagctgaagctgctgcaggagcaggaccaggagctgtgtgagatcctgtgcatgccccactatgacattgattctgcctctgtgcccagcctggaggagctgaaccagttccggcagcacgtgaccaccctgcgggagaccaaggccagcagaagagaggagtttgtgtccatcaagaggcagatcatcctgtgcatggaggccctggaccacaccccagacaccagctttgaaagagatgtggtgtgtgaagatgaagatgccttctgcctgagcctggagaacatcgccaccctgcagaagctgctgcggcagctggagatgcagaagagccagaatgaagctgtgtgtgagggcctgcggacccagatccgggagctgtgggaccggctgcagatccctgaggaggagcgggaggccgtggccaccatcatgagcggcagcaaggccaaggtgaggaaggccctgcagctggaggtggaccggctggaggagctgaagatgcagaacatgaagaaggtgattgaggccatccgggtggagctggtgcagtactgggaccagtgcttctacagccaggagcagaggcaggcctttgcccccttctgtgccgaggactacacagagagcctgctgcagctgcatgatgctgagatcgtgcggctgaagaactactatgaggtgcacaaggagctgtttgaaggagtgcagaagtgggaggagacctggaggctcttcctggagtttgagaggaaggccagtgaccccaaccgcttcaccaacagaggaggcaacctgctgaaggaggagaagcagagggccaagctgcagaagatgctgcccaagctggaggaggagctgaaggccagaattgagctgtgggagcaggagcacagcaaggccttcatggtgaatggccagaagttcatggagtatgtggccgagcagtgggagatgcaccggctggagaaggagcgggccaagcaggagcggcagctgaagaacaagaagcagacagaaacagagatgctgtatggcagcgcccccaggacccccagcaagagaagaggcctggcccccaacaccccaggcaaggccaggaagctgaacaccaccaccatgagcaatgccacagccaacagcagcatccggcccatctttggaggcaccgtgtaccacagccctgtgtcccggctgccccccagcggcagcaagcctgtggccgccagcacctgcagcggcaagaagacccccaggactggaagacatggagccaacaaggagaacctggagctgaatggcagcatcctgagcgcccggaccttcaagggcttccagatctag

SEQ ID NO: 166235 - DNA, 696 bp, Artificial Sequence
  Description of Artificial Sequence: Synthetic coding sequence
atgagggtgctgggcggccgctgtggggccctgctggcctgcctgctgctggtgctgcctgtgtctgaggccaacttctgcctgtacttcagaaatgacttcatctacaacagagcctgcatctctgtgctggtgggcctgagcggctgcaacttcttctacagcatctgcttcctgagcaagcagcaggccagccaggtgctggtgaggaagaggcgggccaacagcctgctggaggagaccaagcagggcaacctggagagagaatgtattgaggagctgtgcaacaaggaggaggcccgggaggtgtttgaaaatgaccctgagacagactacttctaccccaagtacctggtgtgcctgcgctccttccagacaggcctcttcaccgctgcccggcagagcaccaatgcctacccagacctgcggagctgtgtgaatgccatcccagaccagtgcagccccctgccctgcaatgaagatggctacatgagctgcaaggatggcaaggccagcttcacctgcacctgcaagccaggctggcagggcgagaagtgtgaatttgacatcaatgaatgcaaggaccccagcaacatcaatggaggctgcagccagatctgtgacaacaccccaggcagctaccactgcagctgcaagaatggatttgtgatgctgagcaacaagaaggactgctag

SEQ ID NO: 166236 - DNA, 2031 bp, Artificial Sequence
  Description of Artificial Sequence: Synthetic coding sequence
atgagggtgctgggcggccgctgtggggccctgctggcctgcctgctgctggtgctgcctgtgtctgaggccaacttcctgagcaagcagcaggccagccaggtgctggtgaggaagaggcgggccaacagcctgctggaggagaccaagcagggcaacctggagagagaatgtattgaggagctgtgcaacaaggaggaggcccgggaggtgtttgaaaatgaccctgagacagactacttctaccccaagtacctggtgtgcctgcgctccttccagacaggcctcttcaccgctgcccggcagagcaccaatgcctacccagacctgcggagctgtgtgaatgccatcccagaccagtgcagccccctgccctgcaatgaagatggctacatgagctgcaaggatggcaaggccagcttcacctgcacctgcaagccaggctggcagggcgagaagtgtgaatttgacatcaatgaatgcaaggaccccagcaacatcaatggaggctgcagccagatctgtgacaacaccccaggcagctaccactgcagctgcaagaatggatttgtgatgctgagcaacaagaaggactgcaaggatgtggatgagtgcagcctgaagcccagcatctgtggcacagctgtgtgcaagaacatccctggggactttgaatgtgaatgtcctgagggctaccgctacaacctgaagagcaagagctgtgaggacattgatgagtgcagcgagaacatgtgtgcccagctgtgtgtgaactacccaggcggctacacctgctactgtgatggcaagaagggcttcaagctggcccaggaccagaagagctgtgaggtggtgtctgtgtgcctgcccctgaacctggacaccaagtatgagctgctgtacctggccgagcagtttgctggggtggtgctgtacctgaagttccggctgcctgagatcagccgcttctctgctgagtttgacttccgcacctatgacagcgagggcgtcatcctgtatgcagagagcattgaccacagcgcctggctgctgattgccctgcggggcggcaagattgaggtgcagctgaagaatgagcacaccagcaagatcaccactggaggagatgtgatcaacaacggcctgtggaacatggtgtctgtggaggagctggagcacagcatcagcatcaagatcgccaaggaggccgtgatggacatcaacaagccaggccccctcttcaagccagaaaatggcctgctggagaccaaggtgtactttgctggcttccccaggaaggtggagagcgagctgatcaagcccatcaacccccggctggatggctgcatccgctcctggaacctgatgaagcagggcgccagcggcatcaaggagatcatccaggagaagcagaacaagcactgcctggtgacagtggagaagggcagctactacccaggcagcggcatcgcccagttccacatcgactacaacaacgtgagcagcgctgagggctggcacgtgaatgtgaccctgaacatccggcccagcacaggcaccggggtgatgctggccctggtgtctggcaacaacacagtgccctttgctgtgtccctggtggacagcaccagcgagaagagccaggacatcctgctgtctgtggagaacacagtcatctaccgcatccaggccctgagcctgtgcagcgaccagcagagccacctggagttccgggtgaacagaaacaacctggagctgagcacccccctgaagattgagaccatcagccatgaggacctgcagaggcagctggccgtgctggacaaggccatgaaggccaaggtggccacctacctgggcggcctgcctgatgtgcccttcagcgccacccctgtgaatgccttctacaacggctgcatggaggtgaacatcaatggagtgcagctggacctggatgaggccatcagcaagcacaatgacatccgggcccacagctgccccagcgtgtggaagaagaccaagaacagctag

SEQ ID NO: 166237 - DNA, 1275 bp, Artificial Sequence
  Description of Artificial Sequence: Synthetic coding sequence
atgggctgcggcaccagcaaggtgctgcctgagccccccaaggatgtgcagctggacctggtgaagaaggtggagcccttcagcggcaccaagagtgatgtgtacaagcacttcatcacagaggtggacagcgtgggccctgtgaaggccggcttccctgctgccagccagtatgcccacccctgccccggccccccaacagctggccacacagagcccccatctgagcccccaagaagagcccgggtggccaagtaccgggccaagtttgacccccgggtgacagccaagtatgacatcaaggccctgattggccggggcagcttcagccgggtggtgcgggtggagcaccgggccacccggcagccctatgccatcaagatgattgagaccaagtaccgggagggccgggaggtgtgtgagagcgagctgcgggtgctgcggcgggtgagacatgccaacatcatccagctggtggaggtgtttgagacccaggagcgggtgtacatggtgatggagctggccaccggcggggagctgtttgaccgcatcatcgccaagggcagcttcacagaaagagatgccaccagggtgctgcagatggtgctggatggagtgcgctacctgcacgccctgggcatcacccaccgggacctgaagccagagaacctgctgtactaccaccctggaacagacagcaagatcatcatcacagactttggcctggccagcgccaggaagaagggagatgactgcctgatgaagaccacctgtggcaccccagagtacatcgcccctgaggtgctggtgaggaagccctacaccaacagcgtggacatgtgggccctgggcgtcatcgcctacatcctgctgagcggcaccatgccctttgaagatgacaacagaacccggctgtaccggcagatcctgcggggcaagtacagctacagcggggagccctggcccagcgtgagcaacctggccaaggacttcatcgaccggctgctgactgtggaccccggggccaggatgacagccctgcaggccctgcggcacccctgggtggtgtccatggccgccagcagctccatgaagaacctgcacaggagcatcagccagaacctgctgaagagggccagcagccgctgccagagcaccaagagcgcccagagcaccaggagcagccgcagcaccaggagcaacaagagccggcgggtgcgggagcgggagctgcgggagctgaacctgcgctaccagcagcagtacaatggatag

SEQ ID NO: 166238 - DNA, 1953 bp, Artificial Sequence
  Description of Artificial Sequence: Synthetic coding sequence
atggcctgccgggagtttgagatgggcaggaagaagtgtgagcgctactggcccctgtatggagaggaccccatcacctttgcccccttcaagatcagctgtgaagatgagcaggccaggacagactacttcatccgcaccctgctgctggagttccagaatgaaagcagaagactctaccagttccactacgtgaactggccagaccatgatgtgcccagcagctttgacagcatcctggacatgatcagcctgatgaggaagtaccaggagcatgaagatgtgcccatctgcatccactgcagcgctggctgcggccgcactggagccatctgtgccatcgactacacctggaacctgctgaaggccggcaagatccctgaggagttcaacgtgttcaacctgatccaggagatgaggacccagaggcacagcgctgtgcagaccaaggagcagtatgagctggtgcaccgggccatcgcccagctgtttgagaagcagctgcagctgtatgagatccacggggcccagaagattgctgatggagtgaatgagatcaacacagagaacatggtgagcagcattgagcctgagaagcaggacagccccccacccaagccacccaggaccaggagctgcctggtggagggagatgccaaggaggagatcctgcagcccccagagccccaccctgtgccccccatcctgacccccagcccccccagcgccttccccaccgtgaccaccgtgtggcaggacaatgaccgctaccaccccaagcctgtgctgcacatggtgagcagcgagcagcacagcgctgacctgaacagaaactacagcaagagcacagagctgcccgggaagaatgaaagcaccatcgagcagattgacaagaagctggagaggaacctgagctttgagatcaagaaggtgcccctgcaggagggccccaagagctttgatggcaacaccctgctgaacagaggccacgccatcaagatcaagagcgccagcccctgcatcgctgacaagatcagcaagccccaggagctgagcagtgacctgaatgtgggggacaccagccagaacagctgtgtggactgcagcgtgacccagagcaacaaggtgtctgtgaccccacctgaggagagccagaacagcgacaccccacccaggccagaccggctgcccctggatgagaagggccacgtgacctggagcttccacggcccagaaaatgccatccccatcccagacctgtctgagggcaacagcagtgacatcaactaccagaccaggaagacagtgtccctgacccccagccccaccacccaggtggagaccccagacctggtggaccatgacaacaccagccccctcttccgcacccccctgtccttcaccaaccccctgcacagtgatgacagcgacagtgatgaaagaaacagtgatggagctgtgacccagaacaagaccaacatcagcacagccagcgccaccgtgtctgctgccaccagcacagagagcatcagcaccaggaaggtgctgcccatgagcatcgcccggcacaacattgctggcaccacccacagcggggctgagaaggatgtggatgtgtctgaggacagccccccacccctgcctgagaggaccccagagagctttgtgctggccagcgagcacaacacccctgtgcgctctgagtggagcgagctgcagagccaggagaggtctgagcagaagaagtctgagggcctcatcaccagtgaaaatgaaaaatgtgaccaccctgctgggggcatccactatgagatgtgcatcgagtgcccccccaccttcagtgacaagcgggagcagatcagcgagaaccccacagaggccacagacatcggcttcggcaacagatgtgggaagcccaagggcccccgggaccccccatctgagtggacctag

SEQ ID NO: 166239 - DNA, 1062 bp, Artificial Sequence
  Description of Artificial Sequence: Synthetic coding sequence
atgagccgcagcctggacagcgcccggagcttcctggagcggctggaggcccggggcggccgggagggcgctgtgctggccggggagttcagcaagagatgtgagcgctactgggcccaggagcaggagcccctgcagacaggcctcttctgcatcaccctcatcaaggagaagtggctgaatgaagacatcatgctgcggaccctgaaggtgaccttccagaaggagagccgctctgtgtaccagctgcagtacatgtcctggccagaccggggcgtgcccagcagcccagaccacatgctggccatggtggaggaggcccggcggctgcagggcagcggccctgagcccctgtgtgtgcactgcagcgctggctgcggccgcactggagtgctgtgcaccgtggactatgtgcggcagctgctgctgacccagatgatccccccagacttcagcctgtttgatgtggtgctgaagatgaggaagcagaggcctgctgctgtgcagacagaggagcagtaccgcttcctgtaccacacagtggcccagatgttctgcagcaccctgcagaatgccagcccccactaccagaacatcaaggagaactgtgcccccctgtatgatgatgccctcttcctgcggaccccccaggccctgctggccatccccaggcctcctgggggcgtgctgcggagcatctctgtgcccggcagccctggccacgccatggctgacacctatgctgtggtgcagaagagaggagccccagctggagctggcagcggcacccagacaggaactggaactggaactggagcccggtctgctgaggaggcccccctgtacagcaaggtgaccccccgggcccagaggcctggggcccacgcagaagatgcccggggcaccctgcccggccgggtgcctgctgaccagagccctgctggcagcggggcctatgaagatgtggccggcggggcccagacaggaggcctgggcttcaacctgagaattggccggcccaagggcccccgggaccccccagctgagtggaccagggtgtag

SEQ ID NO: 166240 - DNA, 1233 bp, Artificial Sequence
  Description of Artificial Sequence: Synthetic coding sequence
atgcccaccaccatcgagcgggagtttgaggagctggacacccagaggcgctggcagcccctgtacctggagatcagaaatgaaagccatgactacccccaccgggtggccaagttcccagaaaatagaaacagaaaccgctacagagatgtgagcccctatgaccacagccgggtgaagctgcagaatgcagaaaatgactacatcaatgccagcctggtggacatcgaggaggcccagaggagctacatcctgacccagggccccctgcccaacacctgctgccacttctggctgatggtgtggcagcagaagaccaaggctgtggtgatgctgaacagaattgtggagaaggagagcgtgaagtgtgcccagtactggcccacagatgaccaggagatgctgttcaaggagaccggcttctctgtgaagctgctgtctgaagatgtgaagagctactacacagtgcacctgctgcagctggagaacatcaactacatcgagaacctgtggatcaccctgtacctgaagctgctgatgctggatgtgaagaggagcctgaagtctggagagaccaggaccatcagccacttccactacaccacctggccagactttggagtgcctgagagccctgccagcttcctgaacttcctgttcaaggtgcgggagagcggcagcctgaacccagaccacggccctgctgtgatccactgcagcgctggcatcggccgcagcggcaccttcagcctggtggacacctgcctggtgctgatggagaagggagatgacatcaacatcaagcaggtgctgctgaacatgaggaagtacaggatgggcctcatccagaccccagaccagctgcgcttctcctacatggccatcatcgagggcgccaagtgcatcaagggggacagcagcatccagaagcgctggaaggagctgagcaaggaggacctgagccctgcctttgaccacagccccaacaagatcatgacagagaagtacaatggaaacagaattggcctggaggaggagaagctgactggagaccgctgcaccggcctgagcagcaagatgcaggacaccatggaggagaacagcgagagcgccctgaggaagaggatccgggaggacaggaaggccaccacagcccagaaggtgcagcagatgaagcagaggctgaatgaaaatgaaaggaagaggaagaggccccggctgacagacacctag

SEQ ID NO: 166241 - DNA, 2259 bp, Artificial Sequence
  Description of Artificial Sequence: Synthetic coding sequence
atggaccagcgggagatcctgcagaagttcctggatgaggcccagagcaagaagatcaccaaggaggagtttgccaatgagttcctgaagctgaagaggcagagcaccaagtacaaggctgacaagacctaccccaccaccgtggccgagaagcccaagaacatcaagaagaaccgctacaaggacatcctgccctatgactacagccgggtggagctgagcctcatcaccagtgatgaggacagcagctacatcaatgccaacttcatcaagggcgtgtatggccccaaggcctacatcgccacccagggccccctgagcaccaccctgctggacttctggaggatgatctgggagtacagcgtgctgatcatcgtgatggcctgcatggagtatgagatgggcaagaagaagtgtgagcgctactgggccgagcccggggagatgcagctggagtttggccccttctctgtgtcctgtgaggccgagaagaggaagagtgactacatcatccgcaccctgaaggtgaagttcaacagcgagaccaggaccatctaccagttccactacaagaactggccagaccatgatgtgcccagcagcattgaccccatcctggagctgatctgggatgtgcgctgctaccaggaggatgacagcgtgcccatctgcatccactgcagcgctggctgcggccgcactggagtcatctgtgccatcgactacacctggatgctgctgaaggatggcagccaggccaagcactgcatccctgagaagaaccacaccctgcaggccgacagctacagccccaacctgcccaagagcaccaccaaggccgccaagatgatgaaccagcagaggaccaagatggagatcaaggagagcagcagctttgacttccgcaccagcgagatcagcgccaaggaggagctggtgctgcacccagccaagagcagcaccagctttgacttcctggagctgaactacagctttgacaagaatgctgacaccaccatgaagtggcagaccaaggccttccccatcgtgggggagcccctgcagaagcaccagagcctggacctgggcagcctgctgtttgagggctgcagcaacagcaagcctgtgaatgctgctggccgctacttcaacagcaaggtgcccatcaccaggaccaagagcaccccatttgagctgatccagcagcgggagaccaaggaggtggacagcaaggagaacttctcctacctggagagccagccccatgacagctgctttgtggagatgcaggcccagaaggtgatgcacgtgtcctctgctgagctgaactacagcctgccctatgacagcaagcaccagatcagaaatgccagcaatgtgaagcaccacgacagcagcgccctgggcgtgtacagctacatccccctggtggagaacccctacttcagctcctggccacccagcggcaccagcagcaagatgagcctggacctgcctgagaagcaggacggcaccgtcttccccagcagcctgctgcccaccagcagcaccagcctcttctcctactacaacagccatgacagcctgagcctgaacagccccaccaacatcagcagcctgctgaaccaggagagcgctgtgctggccacagcccccagaattgatgatgagatccccccacccctgcctgtgtggaccccagagagcttcatcgtggtggaggaggccggggagttcagccccaacgtgcccaagagcctgagcagcgctgtgaaggtgaagattggcaccagcctggagtggggcggcaccagcgagcccaagaagtttgatgattctgtcatcctgcggcccagcaagtctgtgaagctgcggagccccaagtctgagctgcaccaggacaggagcagccccccaccacccctgcctgagaggaccctggagagcttcttcctggctgatgaggactgcatgcaggcccagagcattgagacctacagcaccagctacccagacaccatggagaacagcaccagcagcaagcagaccctgaagaccccaggcaagagcttcaccaggagcaagagcctgaagatcctgaggaacatgaagaagagcatctgcaacagctgcccccccaacaagccagctgagagcgtgcagagcaacaacagcagcagcttcctgaactttggatttgccaaccgcttcagcaagcccaagggccccaggaaccccccacccacctggaacatctag

SEQ ID NO: 166242 - DNA, 5724 bp, Artificial Sequence
  Description of Artificial Sequence: Synthetic coding sequence
atgctgagccacggggccggcctggccctgtggatcaccctgagcctgctgcagacaggcctggccgagcctgagcgctgcaacttcaccctggccgagagcaaggccagcagccacagcgtgtccatccagtggaggatcctgggcagcccctgcaacttcagcctcatctacagcagtgacaccctgggcgccgccctgtgccccaccttcagaattgacaacaccacctacggctgcaacctgcaggacctgcaggccggcaccatctacaacttccgcatcatcagcctggatgaggagaggacagtggtgctgcagacagaccccctgcccccagcccgcttcggcgtgtccaaggagaagaccaccagcaccagcctgcacgtgtggtggacccccagcagcggcaaggtgaccagctatgaggtgcagctgtttgatgagaacaaccagaagatccagggcgtgcagatccaggagagcacctcctggaatgagtacaccttcttcaacctgacagctggcagcaagtacaacatcgccatcacagctgtgtctgggggcaagaggagcttctctgtgtacaccaacggcagcacagtgcccagccctgtgaaggacatcggcatcagcaccaaggccaacagcctgctgatctcctggagccacggcagcggaaatgtggagcgctaccgcctgatgctgatggacaagggcatcctggtgcacggcggcgtggtggacaagcacgccaccagctatgccttccacggcctgaccccaggctacctgtacaacctgactgtgatgacagaggccgccggcctgcagaactaccgctggaagctggtgaggacagcccccatggaggtgagcaacctgaaggtgaccaatgatggcagcctgaccagcctgaaggtgaagtggcagaggcctcctggaaatgtggacagctacaacatcaccctgagccacaagggcaccatcaaggagagccgggtgctggccccctggatcacagagacccacttcaaggagctggtgcccggccgcctgtaccaggtgacagtgtcctgtgtgtctggagagctgagcgcccagaagatggctgtgggccgcaccttcccagacaaggtggccaacctggaggccaacaacaacggccgcatgaggagcctggtggtgtcctggagccccccagctggggactgggagcagtaccgcatcctgctcttcaatgacagcgtggtgctgctgaacatcaccgtgggcaaggaggagacccagtatgtgatggatgacaccggcctggtgcccggccggcagtatgaggtggaggtgattgtggagagcggcaacctgaagaacagcgagcgctgccagggccgcacagtgcccctggccgtgctgcagctgcgggtgaagcacgccaatgagaccagcctgagcatcatgtggcagacccctgtggccgagtgggagaagtacatcatcagcctggccgaccgggacctgctgctgatccacaagagcctgagcaaggatgccaaggagttcaccttcacagacctggtgcccggcaggaagtacatggccaccgtgaccagcatcagcggggacctgaagaacagcagctctgtgaagggccgcacagtgcctgcccaggtgacagacctgcacgtggccaaccagggcatgaccagcagcctcttcaccaactggacccaggcccagggagatgtggagttctaccaggtgctgctgattcatgaaaatgtggtgatcaagaatgaaagcatcagcagcgagaccagccgctacagcttccacagcctgaagagcggcagcctgtacagcgtggtggtgaccaccgtgtctgggggcatcagcagccggcaggtggtggtggagggccgcacagtgcccagctctgtgtctggagtgacagtgaacaacagcggcagaaatgactacctgtctgtgtcctggctgctggcccctggagatgtggacaactatgaggtgaccctgagccatgatggcaaggtggtgcagagcctggtgattgccaagtctgtgcgggagtgcagcttcagcagcctgaccccaggccgcctgtacacagtgaccatcaccaccaggtctgggaagtatgagaaccacagcttcagccaggagaggacagtgcctgacaaggtgcagggcgtgtctgtgagcaacagcgcccggagtgactacctgcgggtgtcctgggtgcacgccaccggggactttgaccactatgaggtgaccatcaagaacaagaacaacttcatccagaccaagagcatccccaagtcagaaaatgaatgtgtgtttgtgcagctggtgcccggccgcctgtacagcgtgacagtgaccaccaagagcggccagtatgaggccaatgagcagggcaatggccgcaccatccctgagcctgtgaaggacctgaccctgaggaacagaagcacagaggacctgcacgtgacctggagcggggccaatggagatgtggaccagtatgagatccagctgctcttcaatgacatgaaggtgttcccccccttccacctggtgaacacagccacagagtaccgcttcaccagcctgaccccaggccggcagtacaagatcctggtgctgaccatctctggagatgtgcagcagagcgccttcatcgagggcttcaccgtgcccagcgctgtgaagaacatccacatcagccccaacggggccacagacagcctgactgtgaactggaccccaggaggaggagatgtggacagctacacagtgtctgccttccgccacagccagaaggtggacagccagaccatccccaagcacgtgtttgagcacaccttccaccggctggaggccggggagcagtaccagatcatgattgcctctgtgtctggcagcctgaagaaccagatcaacgtggtgggccgcacagtgcctgctgctgtgacagacctgcgcatcacagagaacagcaccaggcacctgtccttccgctggacagccagcgagggggagctgtcctggtacaacatcttcctgtacaacccagatggcaacctgcaggagcgggcccaggtggaccccctggtgcagagcttctccttccagaacctgctgcagggccgcatgtacaagatggtgattgtgacccacagcggggagctgagcaatgaaagcttcatcttcggccgcacagtgcctgcctctgtgagccacctgcggggcagcaacagaaacaccacagacagcctgtggttcaactggagccctgccagcggggactttgacttctatgagctgatcctgtacaaccccaacggcaccaagaaggagaactggaaggacaaggacctgacagagtggaggttccagggcctggtgcccggcaggaaatatgtgctgtgggtggtgacccacagcggggacctgagcaacaaggtgacagctgagagcaggacagcccccagcccccccagcctgatgagctttgctgacatcgccaacaccagcctggccatcacctggaagggccccccagactggacagactacaatgactttgagctgcagtggctgcccagagatgccctgaccgtcttcaacccctacaacaacaggaagtctgagggccgcatcgtgtatggcctgcggcccggccgcagctaccagttcaacgtgaagacagtgtctggggacagctggaagacctacagcaagcccatcttcggctctgtgaggaccaagccagacaagatccagaacctgcactgccggccccagaacagcacagccatcgcctgctcctggatccccccagacagcgactttgatggctacagcattgagtgcaggaagatggacacccaggaggtggagttcagcaggaagctggagaaggagaagagcctgctgaacatcatgatgctggtgccccacaagcgctacctggtgtccatcaaggtgcagagcgctggcatgaccagcgaggtggtggaggacagcaccatcaccatgattgaccggcccccacctcctccaccccacatccgggtgaatgagaaggatgtgctgatcagcaagagcagcatcaacttcaccgtgaactgctcctggttcagtgacaccaacggggctgtgaagtacttcaccgtggtggtgcgggaggctgatggcagtgatgagctgaagccagagcagcagcaccccctgcccagctacctggagtaccgccacaatgccagcatccgggtgtaccagaccaactactttgccagcaaatgtgccgagaaccccaacagcaacagcaagagcttcaacatcaagctgggcgctgagatggagagcctgggcggcaaatgtgaccccacccagcagaagttctgtgatggccccctgaagccccacacagcctaccgcatcagcatccgggccttcacccagctgtttgatgaggacctgaaggagttcaccaagcccctgtacagcgacaccttcttcagcctgcccatcaccacagaaagtgagcccctgtttggagccatcgagggcgtgtctgctggcctcttcctgattggcatgctggtggccgtggtggccctgctgatctgccggcagaaggtgagccacggccgggagcggcccagcgcccggctgagcatccggcgggaccggcccctgtctgtgcacctgaacctgggccagaagggcaacaggaagaccagctgccccatcaagatcaaccagtttgagggccacttcatgaagctgcaggccgacagcaactacctgctgagcaaggagtatgaggagctgaaggatgtgggcaggaaccagagctgtgacatcgccctgctgcctgagaacagaggcaagaaccgctacaacaacatcctgccctatgatgccaccagggtgaagctgagcaatgtggatgatgacccctgcagcgactacatcaatgccagctacatccctggcaacaacttcagaagagagtacatcgtgacccagggccccctgcccggcaccaaggatgacttctggaagatggtgtgggagcagaatgtgcacaacatcgtgatggtgacccagtgtgtggagaagggccgggtgaagtgtgaccactactggccagctgaccaggacagcctgtactatggagacctgatcctgcagatgctgtctgagagcgtgctgcctgagtggaccatccgggagttcaagatctgtggggaggagcagctggatgcccacaggctcatccgccacttccactacacagtgtggccagaccatggagtgcctgagaccacccagagcctcatccagtttgtgaggacagtgcgggactacatcaacagaagccctggagctggccccaccgtggtgcactgcagcgctggggtgggccgcacaggcaccttcatcgccctggaccgcatcctgcagcagctggacagcaaggacagcgtggacatctatggagctgtgcatgacctgcggctgcaccgggtgcacatggtgcagacagagtgccagtatgtgtacctgcaccagtgtgtgagagatgtgctgcgggccaggaagctgcggtctgagcaggagaaccccctcttccccatctatgaaaatgtgaaccctgagtaccaccgggaccctgtgtacagccgccactag

SEQ ID NO: 166243 - DNA, 4518 bp, Artificial Sequence
  Description of Artificial Sequence: Synthetic coding sequence
atggtgcacgtggcccggctgctgctgctgctgctgaccttcttcctgaggacagatgctgagaccccaccccgcttcaccaggacccctgtggaccagacaggagtgtctggaggagtggccagcttcatctgccaggccaccggggacccccggcccaagatcgtgtggaacaagaagggcaagaaggtgagcaaccagagatttgaagtcatcgagtttgatgatggcagcggctctgtgctgcgcatccagcccctgcggaccccaagagatgaggccatctatgaatgtgtggccagcaacaacgtgggggagatctctgtgtccacccggctgactgtgctgcgggaggaccagatcccccggggcttccccaccatcgacatgggcccccagctgaaggtggtggagaggaccaggacagccaccatgctgtgtgccgccagcggcaacccagaccctgagatcacctggttcaaggacttcctgcctgtggacaccagcaacaacaacggccgcatcaagcagctgcggtctgagagcattggagccctgcagatcgagcagagcgaggagagtgaccagggcaagtatgaatgtgtggccaccaacagcgctggcacccgctacagcgccccagccaacctgtatgtgcgggtgcggcgggtgcccccacgcttcagcatcccccccaccaaccacgagatcatgcctgggggctctgtgaacatcacctgtgtggccgtgggcagccccatgccctacgtgaagtggatgctgggcgctgaggacctgaccccagaagatgacatgcccatcggcagaaatgtgctggagctgaatgatgtgcggcagagcgccaactacacctgtgtggccatgagcaccctgggcgtgattgaggccatcgcccagatcaccgtgaaggccctgcccaagcccccaggcacccctgtggtgacagagagcacagccaccagcatcaccctgacctgggacagcggcaaccctgagcctgtgtcctactacatcatccagcacaagcccaagaacagcgaggagctgtacaaggagattgatggagtggccaccacccgctacagcgtggccggcctgagcccctacagcgactatgagttccgggtggtggccgtgaacaacatcggccggggccccccatctgagcctgtgctgacccagaccagcgagcaggcccccagcagcgcccccagagatgtgcaggccaggatgctgagcagcaccaccatcctggtgcagtggaaggagcctgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcattggagatggccccctgagcagtgacatccaggtgatcacccagacaggagtgcccggccagcccctgaacttcaaggccgagcctgagagcgagaccagcatcctgctgtcctggaccccacccaggagtgacaccatcgccaactatgagctggtgtacaaggatggagagcacggggaggagcagaggatcaccatcgagcccggcaccagctaccgcctgcagggcctgaagcccaacagcctgtactacttccggctggccgcccggagcccccagggcctgggcgccagcacagctgagatcagcgcccggaccatgcagagcatgtttgccaagaacttccacgtgaaggctgtgatgaagacctctgtgctgctgtcctgggagatccctgagaactacaacagcgccatgcccttcaagatcctgtatgatgatggcaagatggtggaggaggtggatggccgggccacccagaagctgattgtgaacctgaagccagagaagagctacagctttgtgctgaccaacagaggcaacagcgctgggggcctgcagcaccgggtgacagccaagacagccccagatgtgctgcggaccaagccagccttcatcggcaagaccaacctggatggcatgatcaccgtgcagctgcctgaggtgcctgccaatgaaaacatcaagggctactacatcatcatcgtgcccctgaagaagagccggggcaagttcatcaagccctgggagagcccagatgagatggagctggatgagctgctgaaggagatcagcaggaagaggaggagcatccgctatggccgggaggtggagctgaagccctacatcgccgcccactttgatgtgctgcccacagagttcaccctgggagatgacaagcactacggcggcttcaccaacaagcagctgcagagcggccaggagtatgtgttctttgtgctggccgtgatggagcacgccgagagcaagatgtatgccaccagcccctacagcgaccctgtggtgtccatggacctggacccccagcccatcacagatgaggaggagggcctcatctgggtggtgggccctgtgctggccgtggtgttcatcatctgcatcgtcatcgccatcctgctgtacaagaggaagagagctgagagtgacagcaggaagagcagcatccccaacaacaaggagatccccagccaccaccccacagatcctgtggagctgcggcggctgaacttccagaccccaggcagtgatgattctggctacccaggcaacctgcacagcagctccatggccagccacccccccatccccatcctggagctggccgaccacatcgagcggctgaaggccaatgacaacctgaagttcagccaggagtatgagagcattgatcctggccagcagttcacctgggagcacagcaacctggaggtgaacaagcccaagaacagatatgccaacgtgattgcctatgaccacagccgggtgctgctgagcgccatcgagggcatccctggcagtgactatgtgaatgccaactacattgatggctacaggaagcagaatgcctacatcgccacccagggcagcctgcctgagacctttggagacttctggaggatgatctgggagcagaggtctgccaccgtggtgatgatgaccaagctggaggagaggagccgggtgaagtgtgaccagtactggcccagccggggcacagagacccacggcctggtgcaggtgaccctgctggacacagtggagctggccacctactgtgtgaggacctttgccctgtacaagaatggcagcagcgagaagcgggaggtgcggcagttccagttcaccgcctggccagaccatggagtgcctgagcaccccacccccttcctggccttcctgcggcgggtgaagacctgcaaccccccagatgctggccccatggtggtgcactgcagcgctggggtgggccgcacaggctgcttcatcgtgattgatgccatgctggagcgcatcaagcatgagaagacagtggacatctacggccacgtgaccctgatgagggcccagaggaactacatggtgcagacagaggaccagtacatcttcatccatgatgccctgctggaggccgtgacctgtggcaacacagaggtgcctgccaggaacctgtatgcctacatccagaagctgacccagatcgagaccggggagaatgtgacaggcatggagctggagttcaagaggctggccagcagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagcacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagtctggagagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgaaggagtggtggacatcttccagacagtgaagatgctgcggacccagaggcctgccatggtgcagacagaggaccagtaccagttctcctaccgggccgccctggagtacctgggcagctttgaccactacgccacctag

SEQ ID NO: 166244 - DNA, 4398 bp, Artificial Sequence
  Description of Artificial Sequence: Synthetic coding sequence
atgaggggcctgggcacctgcctggccaccctggccggcctgctgctgacagctgctggggagaccttcagcggcggctgcctgtttgatgagccctacagcacctgtggctacagccagagtgaaggagatgacttcaactgggagcaggtgaacaccctgaccaagcccaccagtgacccctggatgcccagcggcagcttcatgctggtgaatgccagcggccggcctgagggccagagggcccacctgctgctgccccagctgaaggaaaatgacacccactgcatcgacttccactactttgtgagcagcaagagcaacagccccccaggcctgctgaatgtgtatgtgaaggtgaacaacggccccctgggcaaccccatctggaacatcagcggggaccccaccaggacctggaacagagctgagctggccatcagcaccttctggcccaacttctaccaggtgatctttgaagtcatcaccagcggccaccagggctacctggccattgatgaggtgaaggtgctgggccacccctgcaccaggaccccccacttcctgcgcatccagaatgtggaggtgaatgccggccagtttgccaccttccagtgcagcgccatcggccgcacagtggccggggaccggctgtggctgcagggcattgatgtgagagatgcccccctgaaggagatcaaggtgaccagcagccgccgcttcatcgccagcttcaacgtggtgaacaccaccaagagagatgctgggaagtaccgctgcatgatcagaacagagggcggcgtgggcatcagcaactatgcagagctggtggtgaaggagccccctgtgcccatcgccccaccccagctggcctctgtgggcgccacctacctgtggatccagctgaatgccaacagcatcaatggagatggccccatcgtggcccgggaggtggagtactgcacagccagcggctcctggaatgaccggcagcctgtggacagcaccagctacaagattggccacctggaccctgacacagaatatgagatctctgtgctgctgaccaggcctggagagggcggcaccggcagccctggccctgccctgcggaccaggaccaagtgtgccgaccccatgaggggccccaggaagctggaggtggtggaggtgaagagccggcagatcaccatccgctgggagcccttcggctacaacgtgacccgctgccacagctacaacctgactgtgcactactgctaccaggtgggcggccaggagcaggtgcgggaggaggtgtcctgggacacagagaacagccacccccagcacaccatcaccaacctgagcccctacaccaacgtgtctgtgaagctgatcctgatgaaccctgagggcaggaaggagagccaggagctgattgtgcagacagatgaggacctgcccggggctgtgcccacagagagcatccagggcagcacctttgaggagaagatcttcctgcagtggagggagcccacccagacctacggcgtcatcaccctgtatgagatcacctacaaggctgtgtcctcctttgatcctgagattgacctgagcaaccagagcggccgggtgtccaagctgggcaatgagacccacttcctgttcttcggcctgtacccaggcaccacctacagcttcaccatccgggccagcacagccaagggctttggacctccagccaccaaccagttcaccaccaagatcagcgcccccagcatgcctgcctatgagctggagacccccctgaaccagacagacaacacagtgacagtgatgctgaagccagcccacagcagaggagcccctgtgtctgtgtaccagatcgtggtggaggaggagcggcccaggaggaccaagaagaccacagagatcctgaagtgctaccctgtgcccatccacttccagaatgccagcctgctgaacagccagtactactttgctgctgagttccctgctgacagcctgcaggccgcccagcccttcaccatcggggacaacaagacctacaacggctactggaacacccccctgctgccctacaagagctaccgcatctacttccaggccgccagccgggccaatggagagaccaagattgactgtgtgcaggtggccaccaagggggccgccacccccaagcctgtgcctgagcctgagaagcagacagaccacacagtgaagattgctggggtgattgctggcatcctgctgtttgtgatcatcttcctgggcgtggtgctggtgatgaagaagaggaagctggccaagaagaggaaggagaccatgagcagcacccggcaggagatgacagtgatggtgaacagcatggacaagagctatgcagagcagggcaccaactgtgatgaggccttctccttcatggacacccacaacctgaatggccgctctgtgagcagccccagcagcttcaccatgaagaccaacaccctgagcacctctgtgcccaacagctactacccagacccctttgtgcccacagccatcctggtgcccatcaatgatgagacccacaccatggccagtgacaccagcagcctggtgcagagccacacctacaagaagcgggagccagcagatgtgccctaccagacaggccagctgcacccagccatccgggtggccgacctgctgcagcacatcacccagatgaagtgtgccgagggctacggcttcaaggaggagtatgagagcttctttgagggccagagcgccccctgggacagcgccaagaaggatgaaaataggatgaagaacagatatggcaacatcatcgcctatgaccacagccgggtgcggctgcagaccatcgagggggacaccaacagcgactacatcaatggaaactacattgatggctaccaccggcccaaccactacatcgccacccagggccccatgcaggagaccatctatgacttctggaggatggtgtggcatgagaacacagccagcatcatcatggtgaccaacctggtggaggtgggccgggtgaagtgctgcaagtactggccagatgacacagagatctacaaggacatcaaggtgaccctcatcgagacagagctgctggccgagtatgtgatccgcacctttgctgtggagaagaggggcgtgcatgagatccgggagatccggcagttccacttcaccggctggccagaccatggagtgccctaccacgccaccggcctgctgggctttgtgcggcaggtgaagagcaagagcccccccagcgctggccccctggtggtgcactgcagcgctggggccggccgcacaggctgcttcatcgtgattgacatcatgctggacatggccgagcgggagggcgtggtggacatctacaactgtgtgcgggagctgcggagccggcgggtgaacatggtgcagacagaggagcagtatgtgttcatccatgatgccatcctggaggcctgcctgtgtggggacacctctgtgcctgccagccaggtgcgcagcctgtactatgacatgaacaagctggacccccagaccaacagcagccagatcaaggaggagttccgcaccctgaacatggtgacccccaccctgcgggtggaggactgcagcatcgccctgctgcccagaaatcatgagaagaaccgctgcatggacatcctgcccccagaccgctgcctgcccttcctgatcaccattgatggagagagcagcaactacatcaatgctgccctgatggacagctacaagcagcccagcgccttcatcgtgacccagcaccccctgcccaacacagtgaaggacttctggaggctggtgctggactaccactgcacctctgtggtgatgctgaatgatgtggaccctgcccagctgtgcccccagtactggccagaaaatggagtgcaccgccacggccccatccaggtggagtttgtgtctgctgacctggaggaggacatcatcagccgcatcttccgcatctacaatgctgcccggccccaggacggctacaggatggtgcagcagttccagttcctgggctggcccatgtacagagacacccctgtgtccaagaggagcttcctgaagctgatccggcaggtggacaagtggcaggaggagtacaacggcggggagggccgcacagtggtgcactgcctgaatggaggcggccgcagcggcaccttctgtgccatcagcatcgtgtgtgagatgctgcggcaccagaggacagtggatgtgttccacgctgtgaagaccctgaggaacaacaagcccaacatggtggacctgctggaccagtacaagttctgctatgaggtggccctggagtacctgaacagcggctag

SEQ ID NO: 166245 - DNA, 4323 bp, Artificial Sequence
  Description of Artificial Sequence: Synthetic coding sequence
atggcccgggcccaggccctggtgctggccctgaccttccagctgtgtgcccctgagacagagaccccagctgctggctgcacctttgaggaggccagtgaccctgctgtgccctgtgagtacagccaggcccagtatgatgacttccagtgggagcaggtgcgcatccaccctggcacccgggccccagctgacctgccccacggcagctacctgatggtgaacaccagccagcacgcccctggccagagggcccacgtgatcttccagagcctgtctgaaaatgacacccactgtgtgcagttctcctacttcctgtacagcagagatggccacagccctggcaccctgggcgtgtatgtgcgggtgaatggaggccccctgggcagcgctgtgtggaacatgacaggcagccacggccggcagtggcaccaggccgagctggccgtgtccaccttctggcccaatgagtaccaggtgctgtttgaggccctgatcagcccagaccggcggggctacatgggcctggatgacatcctgctgctgagctacccctgtgccaaggccccccacttcagccggctgggagatgtggaggtgaatgccggccagaatgccagcttccagtgcatggctgctggccgggctgctgaggccgagcgcttcctgctgcagaggcagagcggggccctggtgcctgctgctggggtgcgccacatcagccaccggcgcttcctggccaccttccccctggccgctgtgtccagagctgagcaggacctgtaccgctgtgtgtcccaggcccccaggggggccggcgtgagcaactttgctgagctgattgtgaaggagccccccacccccatcgccccaccccagctgctgcgggccggccccacctacctgatcatccagctgaacaccaacagcatcattggagatggccccatcgtgaggaaggagattgagtacaggatggcccggggcccctgggccgaggtgcatgctgtgtccctgcagacctacaagctgtggcacctggaccctgacacagaatatgagatctctgtgctgctgaccaggcctggagatggcggcaccggccggcccggccccccactcatcagcaggaccaagtgtgccgagcccatgagggcccccaagggcctggcctttgctgagatccaggcccggcagctgaccctgcagtgggagcccctgggctacaacgtgacccgctgccacacctacacagtgtccctgtgctaccactacaccctgggcagcagccacaaccagaccatcagagaatgtgtgaagacagagcagggcgtgagccgctacaccatcaagaacctgctgccctacagaaatgtgcacgtgcggctggtgctgaccaaccctgagggcaggaaggagggcaaggaggtgaccttccagacagatgaagatgtgcccagcggcattgctgctgagagcctgaccttcacccccctggaggacatgatcttcctgaagtgggaggagccccaggagcccaacggcctcatcacccagtatgagatctcctaccagagcattgagagcagtgaccctgctgtgaatgtgcccggccccaggaggaccatcagcaagctgagaaatgagacctaccacgtgttcagcaacctgcaccctggcaccacctacctgttctctgtgcgggccaggactggaaaaggatttggccaggccgccctgacagagatcaccaccaacatcagcgcccccagctttgattatgctgacatgcccagccccctgggggagagcgagaacaccatcaccgtgctgctgcggcctgcccagggccgcggggcccccatctctgtgtaccaggtgattgtggaggaggagcgggcccggcggctgcggcgggagcccggcggccaggactgcttccctgtgcccctgacctttgaagctgccctggcccggggcctggtgcactactttggagctgagctggccgccagcagcctgcctgaggccatgcccttcaccgtgggggacaaccagacctaccggggcttctggaacccccccctggagcccaggaaggcctacctgatctacttccaggccgccagccacctgaagggggagacccggctgaactgcatcagaattgccaggaaggccgcctgcaaggagagcaagaggcccctggaggtgtcccagaggtctgaggagatgggcctcatcctgggcatctgtgccggcggcctggccgtgctgatcctgctgctgggcgccatcatcgtcatcatcaggaagggcaagcctgtgaacatgaccaaggccaccgtgaactaccggcaggagaagacccacatgatgtctgctgtggaccgctccttcacagaccagagcaccctgcaggaggatgagcggctgggcctgtccttcatggacacccacggctacagcaccaggggggaccagaggtctgggggcgtgacagaggccagcagcctgctgggcggcagcccccggcggccctgtggcaggaagggcagcccctaccacacaggccagctgcaccctgctgtgcgggtggccgacctgctgcagcacatcaaccagatgaagacagctgagggctacggcttcaagcaggagtatgagagcttctttgagggctgggatgccaccaagaagaaggacaaggtgaagggcagccggcaggagcccatgcctgcctatgacagacaccgggtgaagctgcaccccatgctgggggaccccaatgctgactacatcaatgccaactacatcgacatccgcatcaaccgggagggctaccacaggagcaaccacttcatcgccacccagggccccaagccagagatggtgtatgacttctggaggatggtgtggcaggagcactgcagcagcatcgtgatgatcaccaagctggtggaggtgggccgggtgaagtgcagccgctactggccagaggacagcgacacctatggagacatcaagatcatgctggtgaagacagagaccctggccgagtatgtggtgaggacctttgccctggagcggcggggctacagcgcccggcatgaggtgcggcagttccacttcaccgcctggccagagcacggcgtgccctaccacgccaccggcctgctggccttcatccggcgggtgaaggccagcaccccaccagatgctggccccatcgtcatccactgcagcgctggcactggaagaacaggctgctacatcgtgctggatgtgatgctggacatggccgagtgtgaaggagtggtggacatctacaactgtgtgaagaccctgtgcagcagaagagtgaacatgatccagacagaggagcagtacatcttcatccatgatgccatcctggaggcctgcctgtgtggggagaccaccatccctgtgtctgagttcaaggccacctacaaggagatgatcagaattgacccccagagcaacagcagccagctgcgggaggagttccagaccctgaacagcgtgaccccacccctggatgtggaggagtgcagcatcgccctgctgcccaggaacagagacaagaacagatccatggatgtgctgcccccagaccgctgcctgcccttcctgatcagcacagatggagacagcaacaactacatcaatgctgccctgacagacagctacaccaggtctgctgccttcatcgtgaccctgcaccccctgcagagcaccaccccagacttctggaggctggtgtatgactatggctgcaccagcatcgtgatgctgaaccagctgaaccagagcaacagcgcctggccctgcctgcagtactggccagagcccggccggcagcagtatggcctgatggaggtggagttcatgtctggaacagcagatgaggacctggtggcccgggtcttccgggtgcagaacatcagccgggagggccacctgctggtgcgccacttccagttcctgcgctggagcgcctacagagacaccccagacagcaagaaggccttcctgcacctgctggccgaggtggacaagtggcaggccgagagcggagatggccgcaccatcgtgcactgcctgaatggaggcggccgcagcggcaccttctgtgcctgtgccaccgtgctggagatgatccgctgccacaacctggtggatgtgttctttgctgccaagaccctgaggaactacaagcccaacatggtggagaccatggaccagtaccacttctgctatgatgtggccctggagtacctggagggcctggagagcaggtag

SEQ ID NO: 166246 - DNA, 4347 bp, Artificial Sequence
  Description of Artificial Sequence: Synthetic coding sequence
atgaggatcctgaagcgcttcctggcctgcatccagctgctgtgtgtgtgccgcctggactgggccaacggctactaccggcagcagaggaagctggtggaggagatcggctggagctacacaggagccctgaaccagaagaactggggcaagaagtaccccacctgcaacagccccaagcagagccccatcaacattgatgaggacctgacccaggtgaatgtgaacctgaagaagctgaagttccagggctgggacaagaccagcctggagaacaccttcatccacaacacaggcaagacagtggagatcaacctgaccaatgactacagagtgtctggaggagtgtctgagatggtgttcaaggccagcaagatcaccttccactggggcaagtgcaacatgagcagtgatggcagcgagcacagcctggagggccagaagttccccctggagatgcagatctactgctttgatgctgaccgcttcagcagctttgaggaggccgtgaagggcaagggcaagctgcgggccctgagcatcctgtttgaggtgggcacagaggagaacctggacttcaaggccatcattgatggagtggagagcgtgtccagatttgggaagcaggccgccctggaccccttcatcctgctgaacctgctgcccaacagcacagacaagtactacatctacaacggcagcctgaccagccccccctgcacagacacagtggactggatcgtgttcaaggacacagtgtccatcagcgagagccagctggccgtgttctgtgaggtgctgaccatgcagcagagcggctacgtgatgctgatggactacctgcagaacaacttccgggagcagcagtacaagttcagccggcaggtgttcagcagctacacaggcaaggaggagatccatgaagctgtgtgcagcagcgagccagaaaatgtgcaggccgaccctgagaactacaccagcctgctggtgacctgggagcggccccgggtggtgtatgacaccatgattgagaagtttgctgtgctgtaccagcagctggatggagaggaccagaccaagcatgagttcctgacagatggctaccaggacctgggcgccatcctgaacaacctgctgcccaacatgtcctatgtgctgcagatcgtggccatctgcaccaacggcctgtatggcaagtacagcgaccagctgattgtggacatgcccacagacaaccctgagctggacctcttccctgagctgattggaacagaggagatcatcaaggaggaggaggagggcaaggacatcgaggagggcgccatcgtgaaccctggccgggacagcgccaccaaccagatcaggaagaaggagccccagatcagcaccaccacccactacaaccgcatcggcaccaagtacaatgaggccaagaccaacagaagccccacccggggcagcgagttcagcgggaaaggagatgtgcccaacaccagcctgaacagcaccagccagcctgtgaccaagctggccacagagaaggacatcagcctgaccagccagacagtgacagagctgcccccccacacagtggagggcaccagcgccagcctgaatgatggcagcaagacagtgctgcggagcccccacatgaacctgagcggcacagctgagagcctgaacacagtgtccatcacagaatatgaggaggagagcctgctgaccagcttcaagctggacacaggagctgaggacagcagcggcagcagccctgccaccagcgccatccccttcatcagcgagaacatcagccagggctacatcttcagcagcgagaaccctgagaccatcacctatgatgtgctgatccctgagagcgccagaaatgccagcgaggacagcaccagcagcggcagcgaggagagcctgaaggaccccagcatggagggcaatgtgtggttccccagcagcacagacatcacagcccagccagatgtgggcagcggccgggagagcttcctgcagaccaactacacagagatccgggtggatgagagcgagaagaccaccaagagcttctctgctggccctgtgatgagccagggccccagcgtgacagacctggagatgccccactacagcacctttgcctacttccccacagaggtgaccccccacgccttcacccccagcagccggcagcaggacctggtgtccacagtgaatgtggtgtacagccagaccacccagcctgtgtacaatgaggccagcaacagcagccatgagagcagaattggcctggccgagggcctggagagcgagaagaaggctgtgatccccctggtgattgtgtctgccctgaccttcatctgcctggtggtgctggtgggcatcctgatctactggaggaagtgcttccagacagcccacttctacctggaggacagcaccagccccagggtcatcagcaccccacccacccccatcttccccatcagtgatgatgtgggcgccatccccatcaagcacttccccaagcacgtggccgacctgcacgccagcagcggcttcacagaggagtttgaggaggtgcagagctgcaccgtggacctgggcatcacagctgacagcagcaaccacccagacaacaagcacaagaaccgctacatcaacatcgtggcctatgaccacagccgggtgaagctggcccagctggccgagaaggatggcaagctgacagactacatcaatgccaactacgtggatggctacaaccggcccaaggcctacatcgccgcccagggccccctgaagagcacagctgaggacttctggaggatgatctgggagcacaacgtggaggtgattgtgatgatcaccaacctggtggagaagggcagaagaaaatgtgaccagtactggccagcagatggcagcgaggagtatggcaacttcctggtgacccagaagtctgtgcaggtgctggcctactacacagtgaggaacttcaccctgaggaacaccaagatcaagaagggcagccagaagggccggcccagcggccgggtggtgacccagtaccactacacccagtggccagacatgggcgtgcctgagtacagcctgcctgtgctgacctttgtgaggaaggccgcctatgccaagagacatgctgtgggccctgtggtggtgcactgcagcgctggggtgggccgcacaggcacctacatcgtgctggacagcatgctgcagcagatccagcacgagggcaccgtgaacatcttcggcttcctgaagcacatccgcagccagaggaactacctggtgcagacagaggagcagtatgtgttcatccatgacaccctggtggaggccatcctgagcaaggagacagaggtgctggacagccacatccacgcctacgtgaatgccctgctgatccctggccctgctgggaagaccaagctggagaagcagttccagctgctgagccagagcaacatccagcagagcgactacagcgctgccctgaagcagtgcaaccgggagaagaacagaaccagcagcatcatccctgtggagaggagccgggtgggcatcagcagcctgagcggggagggcacagactacatcaatgccagctacatcatgggctactaccagagcaatgagttcatcatcacccagcaccccctgctgcacaccatcaaggacttctggaggatgatctgggaccacaatgcccagctggtggtgatgatcccagatggccagaacatggccgaggatgaatttgtgtactggcccaacaaggatgagcccatcaactgtgagagcttcaaggtgaccctgatggccgaggagcacaagtgcctgagcaatgaggagaagctgatcatccaggacttcatcctggaggccacccaggatgattatgtgctggaggtgcgccacttccagtgccccaagtggcccaacccagacagccccatcagcaagacctttgagctgatcagcgtcatcaaggaggaggccgccaacagagatggccccatgattgtgcatgatgagcacggcggcgtgacagctggcaccttctgtgccctgaccaccctgatgcaccagctggagaaggaaaattctgtggatgtgtaccaggtggccaagatgatcaacctgatgaggcctggggtgtttgctgacatcgagcagtaccagttcctgtacaaggtgatcctgagcctggtgtccacccggcaggaggagaaccccagcaccagcctggacagcaatggagctgccctgcctgatggcaacattgctgagagcctggagagcctggtgtag

SEQ ID NO: 166247 - DNA, 504 bp, Artificial Sequence
  Description of Artificial Sequence: Synthetic coding sequence
atgaacagacctgcccctgtggagatctcctatgagaacatgaggttcctgatcacccacaaccccaccaatgccaccctgaacaagttcacagaggagctgaagaagtatggagtgaccaccctggtgcgggtgtgtgatgccacctatgacaaggcccctgtggagaaggagggcatccacgtgctggactggccctttgatgatggagcccccccacccaaccagatcgtggatgactggctgaacctgctgaagaccaagttccgggaggagcccggctgctgcgtggccgtgcactgtgtggccggcctgggccgggcccctgtgctggtggccctggccctgattgaatgtggcatgaagtatgaagatgctgtgcagttcatccggcagaagagaagaggagccttcaacagcaagcagctgctgtacctggagaagtaccggcccaagatgaggctgcgcttccgggacaccaacggccactgctgcgtgcagtag

SEQ ID NO: 166248 - DNA, 249 bp, Artificial Sequence
  Description of Artificial Sequence: Synthetic coding sequence
atgaacagacctgcccctgtggagatctcctatgagaacatgaggttcctgatcacccacaaccccaccaatgccaccctgaacaagttcacagaggagctgaagaagtatggagtgaccaccctggtgcgggtgtgtgatgccacctatgacaaggcccctgtggagaaggagggcatccacgtgctgaagaagaagggctctgtgcagttccagacagctgccctgtttggagagatccccacctag

SEQ ID NO: 166249 - DNA, 411 bp, Artificial Sequence
  Description of Artificial Sequence: Synthetic coding sequence
atgaacagacctgcccctgtggagatctcctatgagaacatgaggttcctgatcacccacaaccccaccaatgccaccctgaacaagttcacagaggactggccctttgatgatggagcccccccacccaaccagatcgtggatgactggctgaacctgctgaagaccaagttccgggaggagcccggctgctgcgtggccgtgcactgtgtggccggcctgggccgggcccctgtgctggtggccctggccctgattgaatgtggcatgaagtatgaagatgctgtgcagttcatccggcagaagagaagaggagccttcaacagcaagcagctgctgtacctggagaagtaccggcccaagatgaggctgcgcttccgggacaccaacggccactgctgcgtgcagtag

SEQ ID NO: 166250 - DNA, 192 bp, Artificial Sequence
  Description of Artificial Sequence: Synthetic coding sequence
atgaacagacctgcccctgtggagatctcctatgagaacatgaggttcctgatcacccacaaccccaccaatgccaccctgaacaagttcacagaggagctgaagaagtatggagtgaccaccctggtgcgggtgtgtgatgccacctatgacaaggcccctgtggagaaggagggcatccacgtgctgtag

SEQ ID NO: 166251 - DNA, 69 bp, Artificial Sequence
  Description of Artificial Sequence: Synthetic coding sequence
atgaacagacctgcccctgtggagatctcctatgagaacatgaggttcctgatcacccacaacccctag

SEQ ID NO: 166252 - DNA, 522 bp, Artificial Sequence
  Description of Artificial Sequence: Synthetic coding sequence
atggccaggatgaacagacctgcccctgtggaggtgtcctacaagcacatgaggttcctgatcacccacaaccccaccaatgccaccctgagcaccttcatcgaggacctgaagaagtacggggccaccaccgtggtgcgggtgtgtgaggtgacctatgacaagacccccctggagaaggatggcatcaccgtggtggactggccctttgatgatggagcccctcctcctgggaaggtggtggaggactggctgagcctggtgaaggccaagttctgtgaggcccctggcagctgtgtggccgtgcactgtgtggccggcctgggccgggcccctgtgctggtggccctggccctgattgagagcggcatgaagtatgaagatgccatccagttcatccggcagaagagaagaggagccatcaacagcaagcagctgacctacctggagaagtaccggcccaagcagaggctgcgcttcaaggacccccacacccacaagacccgctgctgcgtgatgtag

SEQ ID NO: 166253 - DNA, 447 bp, Artificial Sequence
  Description of Artificial Sequence: Synthetic coding sequence
atggccaggatgaacagacctgcccctgtggaggtgtcctacaagcacatgaggttcctgatcacccacaaccccaccaatgccaccctgagcaccttcatcgaggacctgaagaagtacggggccaccaccgtggtgcgggtgtgtgaggtgacctatgacaagacccccctggagaaggatggcatcaccgtggtggactggccctttgatgatggagcccctcctcctgggaaggtggtggaggactggctgagcctggtgaaggccaagttctgtgaggcccctggcagctgtgtggccgtgcactgtgtggccggcctgggcaggaagagaagaggagccatcaacagcaagcagctgacctacctggagaagtaccggcccaagcagaggctgcgcttcaaggacccccacacccacaagacccgctgctgcgtgatgtag

SEQ ID NO: 166254 - DNA, 447 bp, Artificial Sequence; identical to SEQ ID NO: 166253
  Description of Artificial Sequence: Synthetic coding sequence

SEQ ID NO: 166255 - DNA, 522 bp, Artificial Sequence; identical to SEQ ID NO: 166252
  Description of Artificial Sequence: Synthetic coding sequence

SEQ ID NO: 166256 - DNA, 213 bp, Artificial Sequence
  Description of Artificial Sequence: Synthetic coding sequence
atggccaggatgaacagacctgcccctgtggaggtgtcctacaagcacatgaggttcctgatcacccacaaccccaccaatgccaccctgagcaccttcatcgaggacctgaagaagtacggggccaccaccgtggtgcgggtgtgtgaggtgacctatgacaagacccccctggagaaggatggcatcaccgtggtggactggcccttctag

SEQ ID NO: 166257 - DNA, 2343 bp, Artificial Sequence
  Description of Artificial Sequence: Synthetic coding sequence
atggagcaggtggagatcctgaggaagttcatccagagggtgcaggccatgaagagcccagaccacaatggagaggacaactttgcccgggacttcatgaggctgcggcggctgagcaccaagtacagaacagagaagatctaccccacagccaccggggagaaggaggagaatgtgaagaagaaccgctacaaggacatcctgccctttgaccacagccgggtgaagctgaccctgaagacccccagccaggacagcgactacatcaatgccaacttcatcaagggcgtgtatggccccaaggcctacgtggccacccagggccccctggccaacacagtgattgacttctggaggatgatctgggagtacaacgtggtgatcatcgtgatggcctgccgggagtttgagatgggcaggaagaagtgtgagcgctactggcccctgtatggagaggaccccatcacctttgcccccttcaagatcagctgtgaagatgagcaggccaggacagactacttcatccgcaccctgctgctggagttccagaatgaaagcagaagactctaccagttccactacgtgaactggccagaccatgatgtgcccagcagctttgacagcatcctggacatgatcagcctgatgaggaagtaccaggagcatgaagatgtgcccatctgcatccactgcagcgctggctgcggccgcactggagccatctgtgccatcgactacacctggaacctgctgaaggccggcaagatccctgaggagttcaacgtgttcaacctgatccaggagatgaggacccagaggcacagcgctgtgcagaccaaggagcagtatgagctggtgcaccgggccatcgcccagctgtttgagaagcagctgcagctgtatgagatccacggggcccagaagattgctgatggagtgaatgagatcaacacagagaacatggtgagcagcattgagcctgagaagcaggacagccccccacccaagccacccaggaccaggagctgcctggtggagggagatgccaaggaggagatcctgcagcccccagagccccaccctgtgccccccatcctgacccccagcccccccagcgccttccccaccgtgaccaccgtgtggcaggacaatgaccgctaccaccccaagcctgtgctgcacatggtgagcagcgagcagcacagcgctgacctgaacagaaactacagcaagagcacagagctgcccgggaagaatgaaagcaccatcgagcagattgacaagaagctggagaggaacctgagctttgagatcaagaaggtgcccctgcaggagggccccaagagctttgatggcaacaccctgctgaacagaggccacgccatcaagatcaagagcgccagcccctgcatcgctgacaagatcagcaagccccaggagctgagcagtgacctgaatgtgggggacaccagccagaacagctgtgtggactgcagcgtgacccagagcaacaaggtgtctgtgaccccacctgaggagagccagaacagcgacaccccacccaggccagaccggctgcccctggatgagaagggccacgtgacctggagcttccacggcccagaaaatgccatccccatcccagacctgtctgagggcaacagcagtgacatcaactaccagaccaggaagacagtgtccctgacccccagccccaccacccaggtggagaccccagacctggtggaccatgacaacaccagccccctcttccgcacccccctgtccttcaccaaccccctgcacagtgatgacagcgacagtgatgaaagaaacagtgatggagctgtgacccagaacaagaccaacatcagcacagccagcgccaccgtgtctgctgccaccagcacagagagcatcagcaccaggaaggtgctgcccatgagcatcgcccggcacaacattgctggcaccacccacagcggggctgagaaggatgtggatgtgtctgaggacagccccccacccctgcctgagaggaccccagagagctttgtgctggccagcgagcacaacacccctgtgcgctctgagtggagcgagctgcagagccaggagaggtctgagcagaagaagtctgagggcctcatcaccagtgaaaatgaaaaatgtgaccaccctgctgggggcatccactatgagatgtgcatcgagtgcccccccaccttcagtgacaagcgggagcagatcagcgagaaccccacagaggccacagacatcggcttcggcaacagatgtgggaagcccaagggcccccgggaccccccatctgagtggacctag

SEQ ID NO: 166258 - DNA, 1986 bp, Artificial Sequence
  Description of Artificial Sequence: Synthetic coding sequence
atgatctgggagtacaacgtggtgatcatcgtgatggcctgccgggagtttgagatgggcaggaagaagtgtgagcgctactggcccctgtatggagaggaccccatcacctttgcccccttcaagatcagctgtgaagatgagcaggccaggacagactacttcatccgcaccctgctgctggagttccagaatgaaagccggcggctgtaccagttccactacgtgaactggccagaccatgatgtgcccagcagctttgacagcatcctggacatgatcagcctgatgaggaagtaccaggagcatgaagatgtgcccatctgcatccactgcagcgctggctgcggccgcactggagccatctgtgccatcgactacacctggaacctgctgaaggccggcaagatccctgaggagttcaacgtgttcaacctgatccaggagatgaggacccagaggcacagcgctgtgcagaccaaggagcagtatgagctggtgcaccgggccatcgcccagctgtttgagaagcagctgcagctgtatgagatccatggagcccagaagattgctgatggagtgaatgagatcaacacagagaacatggtgagcagcattgagcctgagaagcaggacagccccccacccaagccacccaggaccaggagctgcctggtggagggagatgccaaggaggagatcctgcagcccccagagccccaccctgtgccccccatcctgacccccagccccccatctgccttccccaccgtgaccaccgtgtggcaggacaatgaccgctaccaccccaagcctgtgctgcacatggtgtcctctgagcagcacagcgctgacctgaacagaaactacagcaagagcacagagctgcccgggaagaatgaaagcaccatcgagcagattgacaagaagctggagaggaacctgagctttgagatcaagaaggtgcccctgcaggagggccccaagagctttgatggcaacaccctgctgaacagaggacatgccatcaagatcaagagcgccagcccctgcatcgctgacaagatcagcaagccccaggagctgagcagtgacctgaatgtgggggacaccagccagaacagctgtgtggactgcagcgtgacccagagcaacaaggtgtctgtgaccccacctgaggagagccagaacagcgacaccccacccaggccagaccggctgcccctggatgagaagggccacgtgacctggagcttccacggcccagaaaatgccatccccatcccagacctgtctgagggcaacagcagtgacatcaactaccagaccaggaagacagtgtccctgacccccagccccaccacccaggtggagaccccagacctggtggaccatgacaacaccagccccctcttccgcacccccctgtccttcaccaaccccctgcacagtgatgacagcgacagtgatgagaggaacagtgatggagctgtgacccagaacaagaccaacatcagcacagccagcgccaccgtgtctgctgccaccagcacagagagcatcagcaccaggaaggtgctgcccatgagcatcgcccggcacaacattgctggcaccacccacagcggggctgagaaggatgtggatgtgtctgaggacagccccccacccctgcctgagaggaccccagagagctttgtgctggccagcgagcacaacacccctgtgcgctctgagtggagcgagctgcagagccaggagaggtctgagcagaagaagtctgagggcctcatcaccagtgaaaatgagaagtgtgaccaccctgctgggggcatccactatgagatgtgcattgaatgtcctcccaccttcagtgacaagcgggagcagatcagcgagaaccccacagaggccacagacattggatttggaaacagatgtgggaagcccaagggcccccgggacccccccagcgagtggacctag

SEQ ID NO: 166259 - DNA, 1632 bp, Artificial Sequence
  Description of Artificial Sequence: Synthetic coding sequence
atgatctgggagtacaacgtggtgatcatcgtgatggcctgccgggagtttgagatgggcaggaagaagtgtgagcgctactggcccctgtatggagaggaccccatcacctttgcccccttcaagatcagctgtgaagatgagcaggccaggacagactacttcatccgcaccctgctgctggagttccagaatgaaagccggcggctgtaccagttccactacgtgaactggccagaccatgatgtgcccagcagctttgacagcatcctggacatgatcagcctgatgaggaagtaccaggagcatgaagatgtgcccatctgcatccactgcagcgctggctgcggccgcactggagccatctgtgccatcgactacacctggaacctgctgaaggccggcaagatccctgaggagttcaacgtgttcaacctgatccaggagatgaggacccagaggcacagcgctgtgcagaccaaggagcagtatgagctggtgcaccgggccatcgcccagctgtttgagaagcagctgcagctgtatgagatccatggagcccagaagattgctgatggagtgaatgagatcaacacagagaacatggtgagcagcattgagcctgagaagcaggacagccccccacccaagccacccaggaccaggagctgcctggtggagggagatgccaaggaggagatcctgcagcccccagagccccaccctgtgccccccatcctgacccccagccccccatctgccttccccaccgtgaccaccgtgtggcaggacaatgaccgctaccaccccaagcctgtgctgcacatggtgtcctctgagcagcacagcgctgacctgaacagaaactacagcaagagcacagagctgcccgggaagaatgaaagcaccatcgagcagattgacaagaagctggagaggaacctgagctttgagatcaagaaggtgcccctgcaggagggccccaagagctttgatggcaacaccctgctgaacagaggacatgccatcaagatcaagagcgccagcccctgcatcgctgacaagatcagcaagccccaggagctgagcagtgacctgaatgtgggggacaccagccagaacagctgtgtggactgcagcgtgacccagagcaacaaggtgtctgtgaccccacctgaggagagccagaacagcgacaccccacccaggccagaccggctgcccctggatgagaagggccacgtgacctggagcttccacggcccagaaaatgccatccccatcccagacctgtctgagggcaacagcagtgacatcaactaccagaccaggaagacagtgtccctgacccccagccccaccacccaggtggagaccccagacctggtggaccatgacaacaccagccccctcttccgcacccccctgtccttcaccaaccccctgcacagtgatgacagcgacagtgatgagaggaacagtgatggagctgtgacccagaacaagaccaacatcagcacagccagcgccaccgtgtctgctgccaccagcacagagagcatcagcaccaggaaggtgctgcccatgagcatcgcccggcacaacagcaggaacaacaccttccgctgctag

SEQ ID NO: 166260 - DNA, 6885 bp, Artificial Sequence
  Description of Artificial Sequence: Synthetic coding sequence
atgcacgtgtccctggccgaggccctggaggtgcggggcggccccctgcaggaggaggagatctgggccgtgctgaaccagagcgctgagagcctgcaggagctgttcaggaaggtgtccctggccgaccctgctgccctgggcttcatcatcagcccctggagcctgctgctgctgcccagcggctctgtgtccttcacagatgagaacatcagcaaccaggacctgcgggccttcaccgcccctgaggtgctgcagaaccagagcctgaccagcctgagtgatgtggagaagatccacatctacagcctgggcatgaccctgtactggggcgctgactatgaggtgccccagagccagcccatcaagctgggggaccacctgaacagcatcctgctgggcatgtgtgaagatgtgatctatgcccgggtgtctgtgaggacagtgctggatgcctgcagcgcccacatccggaacagcaactgtgcccccagcttctcctatgtgaagcacctggtgaagctggtgctgggcaacctgtctggaacagaccagctgagctgcaacagcgagcagaagccagacaggagccaggccatccgggaccggctgcggggcaagggcctgcccaccggccgcagcagcaccagtgatgtgctggacatccagaagccacccctgagccaccagaccttcctgaacaagggcctgagcaagtccatgggcttcctgagcatcaaggacacccaggatgagaactacttcaaggacatcctgagtgacaacagcggccgggaggacagcgagaacaccttcagcccctaccagttcaagaccagcggccctgagaagaagcccatccctggcattgatgtgctgagcaagaagaagatctgggccagctccatggacctgctgtgcacagctgaccgggacttcagcagtggagaaacagccacctaccgccgctgccaccctgaggccgtgacagtgaggaccagcaccacccccaggaagaaggaggcccgctacagtgatggcagcatcgccctggacatcttcggcccccagaagatggaccccatctaccacacccgggagctgcccaccagcagcgccatcagcagcgccctggaccgcatccgggagcggcagaagaagctgcaggtgctgcgggaggccatgaatgtggaggagcctgtgcggcgctacaagacctaccatggagatgtgttcagcaccagcagcgagagccccagcatcatcagcagcgagagtgacttccggcaggtgcggcgctctgaggccagcaagagatttgagagcagcagcggcctgcccggggtggatgagaccctgagccagggccagagccagaggcccagccggcagtatgagaccccatttgagggcaacctgatcaaccaggagatcatgctgaagaggcaggaggaggagctgatgcagctgcaggccaagatggccctgcggcagagccggctgagcctgtacccaggggacaccatcaaggcctccatgctggacatcacccgggaccccctgcgggagatcgccctggagacagccatgacccagaggaagctgaggaacttctttggacctgagtttgtgaagatgaccatcgagcccttcatcagcctggacctgcccaggagcatcctgaccaagaagggcaagaatgaagacaacagaaggaaggtgaacatcatgctgctgaatggccagaggctggagctgacctgtgacaccaagaccatctgcaaggatgtgtttgacatggtggtggcccacatcggcctggtggagcaccacctgtttgccctggccaccctgaaggacaatgagtacttctttgtggaccctgacctgaagctgaccaaggtggcccctgagggctggaaggaggagcccaagaagaagaccaaggccaccgtgaacttcaccctcttcttccgcatcaagttcttcatggatgatgtgtccctcatccagcacaccctgacctgccaccagtactacctgcagctgaggaaggacatcctggaggagaggatgcactgtgatgatgagaccagcctgctgctggccagcctggccctgcaggccgagtatggagactaccagcctgaggtgcatggagtgtcctacttcaggatggagcactacctgcctgcccgggtgatggagaagctggacctgagctacatcaaggaggagctgcccaagctgcacaacacctacgtgggcgccagcgagaaggagacagagctggagttcctgaaggtgtgccagaggctgacagaatatggagtgcacttccaccgggtgcaccctgagaagaagagccagacaggcatcctgctgggcgtgtgcagcaagggcgtgctggtgtttgaggtgcacaatggagtgaggaccctggtgctgcgcttcccctggagggagaccaagaagatctccttcagcaagaagaagatcaccctgcagaacaccagtgatggcatcaagcacggcttccagacagacaacagcaagatctgccagtacctgctgcacctgtgcagctaccagcacaagttccagctgcagatgagggcccggcagagcaaccaggatgcccaggacattgatgtgctgcacaagcgctggagcatcgtgagcagccctgagcgggagatcaccctggtgaacctgaagaaggatgccaagtatggcctgggcttccagatcatcggcggggagaagatgggccgcctggacctgggcatcttcatcagctctgtggcccctgggggccctgctgacctggatggctgcctgaagccaggggacaggctcatctctgtgaacagcgtgtccctggagggcgtgagccaccacgccgccatcgagatcctgcagaatgccccagaagatgtgaccctggtgatcagccagcccaaggagaagatcagcaaggtgcccagcacccctgtgcacctgaccaatgagatgaagaactacatgaagaagagcagctacatgcaggacagcgccatcgacagcagcagcaaggaccaccactggagccggggcaccctgcggcacatcagtgaaaattcctttggccccagcggcggcctgcgggagggcagcctgagcagccaggacagcaggacagagagcgccagcctgagccagagccaggtgaatggcttctttgccagccacctgggggaccagacctggcaggagagccagcacggcagccccagccccagcgtcatcagcaaggccacagagaaggagaccttcacagacagcaaccagagcaagaccaagaagccaggcatcagtgatgtgacagactacagcgacagaggagacagcgacatggatgaggccacctacagcagcagccaggaccaccagacccccaagcaggagagcagcagctctgtgaacaccagcaacaagatgaacttcaagaccttcagcagcagcccccccaagccaggggacatctttgaggtggagctggccaagaatgacaacagcctgggcatctctgtgactggaggagtgaacacctctgtgagacatggaggcatctacgtgaaggccgtcatcccccagggcgctgctgagagtgatggccgcatccacaagggggacagagtgctggccgtgaatggagtgtccctggagggcgccacccacaagcaggccgtggagaccctgaggaacacaggccaggtggtgcacctgctgctggagaagggccagagccccaccagcaaggagcacgtgcctgtgaccccccagtgcaccctgagtgaccagaatgcccagggccagggccctgagaaggtgaagaagaccacccaggtgaaggactacagctttgtgacagaggagaacacctttgaggtgaagctgttcaagaacagcagcggcctgggcttctccttcagccgggaggacaacctgatccctgagcagatcaatgccagcatcgtgcgggtgaagaagctgtttcctggccagcctgctgctgagagcggcaagattgatgtgggagatgtgatcctgaaggtgaatggagccagcctgaagggcctgagccagcaggaggtgatcagcgccctgcggggcacagcccctgaggtgttcctgctgctgtgcaggcctcctcctggggtgctgcctgagattgacacagccctgctgacccccctgcagagccctgcccaggtgctgcccaacagcagcaaggacagcagccagcccagctgtgtggagcagagcaccagcagtgatgaaaatgagatgtctgacaagagcaagaagcagtgcaagagccccagcagaagagacagctacagcgacagcagcggcagcggagaagatgacctggtgacagccccagccaacatcagcaacagcacctggagcagcgccctgcaccagaccctgagcaacatggtgtcccaggcccagagccaccacgaggcccccaagagccaggaggacaccatctgcaccatgttctactacccccagaagatccccaacaagccagagtttgaggacagcaaccccagccccctgcccccagacatggcccctggccagagctaccagccccagagcgagagcgccagcagcagctccatggacaagtaccacatccaccacatcagcgagcccacccggcaggagaactggacccccctgaagaatgacctggagaaccacctggaggactttgagctggaggtggagctgctgatcaccctcatcaagtctgagaagggcagcctgggcttcaccgtgaccaagggcaaccagagaattggctgctacgtgcatgatgtgatccaggaccctgccaagagtgatggccgcctgaagccaggggacaggctcatcaaggtgaatgacacagatgtgaccaacatgacccacacagatgctgtgaacctgctgcgggccgccagcaagacagtgcggctggtgattggccgggtgctggagctgccccgcatccccatgctgccccacctgctgcctgacatcaccctgacctgcaacaaggaggagctgggcttcagcctgtgtggcggccatgacagcctgtaccaggtggtgtacatcagtgacatcaaccccaggtctgtggccgccatcgagggcaacctgcagctgctggatgtgatccactacgtgaatggagtgtccacccagggcatgaccctggaggaggtgaacagagccctggacatgagcctgcccagcctggtgctgaaggccaccagaaatgacctgcctgtggtgcccagcagcaagaggtctgctgtgtctgcccccaagagcaccaagggaaatggcagctacagcgtgggcagctgcagccagcctgccctgaccccaaatgacagcttcagcacagtggccggggaggagatcaatgagatctcctaccccaagggcaagtgcagcacctaccagatcaagggcagccccaacctgaccctgcccaaggagagctacatccaggaggatgacatctatgatgacagccaggaggccgaggtgatccagagcctgctggatgtggtggatgaggaggcccagaacctgctgaatgaaaataatgctgctggctacagctgtggccctggcaccctgaagatgaatggcaagctgtctgaggagaggacagaggacacagactgtgatggcagccccctgcctgagtacttcacagaggccaccaagatgaatggctgtgaggagtactgtgaggagaaggtgaagtctgagagcctcatccagaagccccaggagaagaagacagatgatgatgagatcacctggggcaatgatgagctgcccattgaaagaaccaaccatgaagattctgacaaggaccacagcttcctgaccaatgatgagctggccgtgctgcctgtggtgaaggtgctgcccagcggcaagtacaccggggccaacctgaagagcgtcatccgggtgctgcggggcctgctggaccagggcatccccagcaaggagctggagaacctgcaggagctgaagcccctggaccagtgcctgattggccagaccaaggaaaatagaaggaagaaccgctacaagaacatcctgccctatgatgccaccagggtgcccctgggagatgaaggaggctacatcaatgccagcttcatcaagatccctgtgggcaaggaggagtttgtgtacatcgcctgccagggccccctgcccaccaccgtgggggacttctggcagatgatctgggagcagaagagcaccgtcatcgccatgatgacccaggaggtggagggggagaagatcaagtgccagcgctactggcccaacatcctgggcaagaccaccatggtgagcaaccggctgcggctggccctggtgaggatgcagcagctgaagggctttgtggtgcgggccatgaccctggaggacatccagacccgggaggtgcgccacatcagccacctgaacttcaccgcctggccagaccatgacacccccagccagccagatgacctgctgaccttcatctcctacatgaggcacatccacaggagcggccccatcatcacccactgcagcgctggcatcggccgcagcggcaccctcatctgcattgatgtggtgctgggcctcatcagccaggacctggactttgacatcagtgacctggtgcgctgcatgaggctgcagagacatggcatggtgcagacagaggaccagtacatcttctgctaccaggtgatcctgtatgtgctgacccggctgcaggccgaggaggagcagaagcagcagccccagctgctgaagtag

SEQ ID NO: 166261 - DNA, 7305 bp, Artificial Sequence
  Description of Artificial Sequence: Synthetic coding sequence
cagttcctgttcaccaaggtgtccctggccgaccctgctgccctgggcttcatcatcagcccctggagcctgctgctgctgcccagcggctctgtgtccttcacagatgagaacatcagcaaccaggacctgcgggccttcaccgcccctgaggtgctgcagaaccagagcctgaccagcctgagtgatgtggagaagatccacatctacagcctgggcatgaccctgtactggggcgctgactatgaggtgccccagagccagcccatcaagctgggggaccacctgaacagcatcctgctgggcatgtgtgaagatgtgatctatgcccgggtgtctgtgaggacagtgctggatgcctgcagcgcccacatccggaacagcaactgtgcccccagcttctcctatgtgaagcacctggtgaagctggtgctgggcaacctgtctggaacagaccagctgagctgcaacagcgagcagaagccagacaggagccaggccatccgggaccggctgcggggcaagggcctgcccaccggccgcagcagcaccagtgatgtgctggacatccagaagccacccctgagccaccagaccttcctgaacaagggcctgagcaagtccatgggcttcctgagcatcaaggacacccaggatgagaactacttcaaggacatcctgagtgacaacagcggccgggaggacagcgagaacaccttcagcccctaccagttcaagaccagcggccctgagaagaagcccatccctggcattgatgtgctgagcaagaagaagatctgggccagctccatggacctgctgtgcacagctgaccgggacttcagcagtggagaaacagccacctaccgccgctgccaccctgaggccgtgacagtgaggaccagcaccacccccaggaagaaggaggcccgctacagtgatggcagcatcgccctggacatcttcggcccccagaagatggaccccatctaccacacccgggagctgcccaccagcagcgccatcagcagcgccctggaccgcatccgggagcggcagaagaagctgcaggtgctgcgggaggccatgaatgtggaggagcctgtgcggcgctacaagacctaccatggagatgtgttcagcaccagcagcgagagccccagcatcatcagcagcgagagtgacttccggcaggtgcggcgctctgaggccagcaagagatttgagagcagcagcggcctgcccggggtggatgagaccctgagccagggccagagccagaggcccagccggcagtatgagaccccatttgagggcaacctgatcaaccaggagatcatgctgaagaggcaggaggaggagctgatgcagctgcaggccaagatggccctgcggcagagccggctgagcctgtacccaggggacaccatcaaggcctccatgctggacatcacccgggaccccctgcgggagatcgccctggagacagccatgacccagaggaagctgaggaacttctttggacctgagtttgtgaagatgaccatcgagcccttcatcagcctggacctgcccaggagcatcctgaccaagaagggcaagaatgaagacaacagaaggaaggtgaacatcatgctgctgaatggccagaggctggagctgacctgtgacaccaagaccatctgcaaggatgtgtttgacatggtggtggcccacatcggcctggtggagcaccacctgtttgccctggccaccctgaaggacaatgagtacttctttgtggaccctgacctgaagctgaccaaggtggcccctgagggctggaaggaggagcccaagaagaagaccaaggccaccgtgaacttcaccctcttcttccgcatcaagttcttcatggatgatgtgtccctcatccagcacaccctgacctgccaccagtactacctgcagctgaggaaggacatcctggaggagaggatgcactgtgatgatgagaccagcctgctgctggccagcctggccctgcaggccgagtatggagactaccagcctgaggtgcatggagtgtcctacttcaggatggagcactacctgcctgcccgggtgatggagaagctggacctgagctacatcaaggaggagctgcccaagctgcacaacacctacgtgggcgccagcgagaaggagacagagctggagttcctgaaggtgtgccagaggctgacagaatatggagtgcacttccaccgggtgcaccctgagaagaagagccagacaggcatcctgctgggcgtgtgcagcaagggcgtgctggtgtttgaggtgcacaatggagtgaggaccctggtgctgcgcttcccctggagggagaccaagaagatctccttcagcaagaagaagatcaccctgcagaacaccagtgatggcatcaagcacggcttccagacagacaacagcaagatctgccagtacctgctgcacctgtgcagctaccagcacaagttccagctgcagatgagggcccggcagagcaaccaggatgcccaggacatcgagcgggccagcttccgcagcctgaacctgcaggccgagagcgtgcggggcttcaacatgggccgggccatcagcacaggcagcctggccagcagcaccctgaacaagctggccgtgcggcccctgtctgtgcaggccgagatcctgaagaggctgagctgcagcgagctgagcctgtaccagcccctgcagaacagcagcaaggagaagaatgacaaggcctcctgggaggagaagccccgggagatgagcaagagctaccatgacctgagccaggccagcctgtacccccacaggaagaatgtcatcgtgaacatggagcccccaccccagacagtggccgagctggtgggcaagcccagccaccagatgagcagaagtgatgctgagagcctggccggcgtgaccaagctgaacaacagcaagtctgtggccagcctgaacagaagccctgagaggaggaagcatgaaagtgacagcagcagcattgaagatcctggccaggcctacgtgctggatgtgctgcacaagcgctggagcatcgtgagcagccctgagcgggagatcaccctggtgaacctgaagaaggatgccaagtatggcctgggcttccagatcatcggcggggagaagatgggccgcctggacctgggcatcttcatcagctctgtggcccctgggggccctgctgacctggatggctgcctgaagccaggggacaggctcatctctgtgaacagcgtgtccctggagggcgtgagccaccacgccgccatcgagatcctgcagaatgccccagaagatgtgaccctggtgatcagccagcccaaggagaagatcagcaaggtgcccagcacccctgtgcacctgaccaatgagatgaagaactacatgaagaagagcagctacatgcaggacagcgccatcgacagcagcagcaaggaccaccactggagccggggcaccctgcggcacatcagtgaaaattcctttggccccagcggcggcctgcgggagggcagcctgagcagccaggacagcaggacagagagcgccagcctgagccagagccaggtgaatggcttctttgccagccacctgggggaccagacctggcaggagagccagcacggcagccccagccccagcgtcatcagcaaggccacagagaaggagaccttcacagacagcaaccagagcaagaccaagaagccaggcatcagtgatgtgacagactacagcgacagaggagacagcgacatggatgaggccacctacagcagcagccaggaccaccagacccccaagcaggagagcagcagctctgtgaacaccagcaacaagatgaacttcaagaccttcagcagcagcccccccaagccaggggacatctttgaggtggagctggccaagaatgacaacagcctgggcatctctgtgactggaggagtgaacacctctgtgagacatggaggcatctacgtgaaggccgtcatcccccagggcgctgctgagagtgatggccgcatccacaagggggacagagtgctggccgtgaatggagtgtccctggagggcgccacccacaagcaggccgtggagaccctgaggaacacaggccaggtggtgcacctgctgctggagaagggccagagccccaccagcaaggagcacgtgcctgtgaccccccagtgcaccctgagtgaccagaatgcccagggccagggccctgagaaggtgaagaagaccacccaggtgaaggactacagctttgtgacagaggagaacacctttgaggtgaagctgttcaagaacagcagcggcctgggcttctccttcagccgggaggacaacctgatccctgagcagatcaatgccagcatcgtgcgggtgaagaagctgtttcctggccagcctgctgctgagagcggcaagattgatgtgggagatgtgatcctgaaggtgaatggagccagcctgaagggcctgagccagcaggaggtgatcagcgccctgcggggcacagcccctgaggtgttcctgctgctgtgcaggcctcctcctggggtgctgcctgagattgacacagccctgctgacccccctgcagagccctgcccaggtgctgcccaacagcagcaaggacagcagccagcccagctgtgtggagcagagcaccagcagtgatgaaaatgagatgtctgacaagagcaagaagcagtgcaagagccccagcagaagagacagctacagcgacagcagcggcagcggagaagatgacctggtgacagccccagccaacatcagcaacagcacctggagcagcgccctgcaccagaccctgagcaacatggtgtcccaggcccagagccaccacgaggcccccaagagccaggaggacaccatctgcaccatgttctactacccccagaagatccccaacaagccagagtttgaggacagcaaccccagccccctgcccccagacatggcccctggccagagctaccagccccagagcgagagcgccagcagcagctccatggacaagtaccacatccaccacatcagcgagcccacccggcaggagaactggacccccctgaagaatgacctggagaaccacctggaggactttgagctggaggtggagctgctgatcaccctcatcaagtctgagaagggcagcctgggcttcaccgtgaccaagggcaaccagagaattggctgctacgtgcatgatgtgatccaggaccctgccaagagtgatggccgcctgaagccaggggacaggctcatcaaggtgaatgacacagatgtgaccaacatgacccacacagatgctgtgaacctgctgcgggccgccagcaagacagtgcggctggtgattggccgggtgctggagctgccccgcatccccatgctgccccacctgctgcctgacatcaccctgacctgcaacaaggaggagctgggcttcagcctgtgtggcggccatgacagcctgtaccaggtggtgtacatcagtgacatcaaccccaggtctgtggccgccatcgagggcaacctgcagctgctggatgtgatccactacgtgaatggagtgtccacccagggcatgaccctggaggaggtgaacagagccctggacatgagcctgcccagcctggtgctgaaggccaccagaaatgacctgcctgtggtgcccagcagcaagaggtctgctgtgtctgcccccaagagcaccaagggaaatggcagctacagcgtgggcagctgcagccagcctgccctgaccccaaatgacagcttcagcacagtggccggggaggagatcaatgagatctcctaccccaagggcaagtgcagcacctaccagatcaagggcagccccaacctgaccctgcccaaggagagctacatccaggaggatgacatctatgatgacagccaggaggccgaggtgatccagagcctgctggatgtggtggatgaggaggcccagaacctgctgaatgaaaataatgctgctggctacagctgtggccctggcaccctgaagatgaatggcaagctgtctgaggagaggacagaggacacagactgtgatggcagccccctgcctgagtacttcacagaggccaccaagatgaatggctgtgaggagtactgtgaggagaaggtgaagtctgagagcctcatccagaagccccaggagaagaagacagatgatgatgagatcacctggggcaatgatgagctgcccattgaaagaaccaaccatgaagattctgacaaggaccacagcttcctgaccaatgatgagctggccgtgctgcctgtggtgaaggtgctgcccagcggcaagtacaccggggccaacctgaagagcgtcatccgggtgctgcggggcctgctggaccagggcatccccagcaaggagctggagaacctgcaggagctgaagcccctggaccagtgcctgattggccagaccaaggaaaatagaaggaagaaccgctacaagaacatcctgccctatgatgccaccagggtgcccctgggagatgaaggaggctacatcaatgccagcttcatcaagatccctgtgggcaaggaggagtttgtgtacatcgcctgccagggccccctgcccaccaccgtgggggacttctggcagatgatctgggagcagaagagcaccgtcatcgccatgatgacccaggaggtggagggggagaagatcaagtgccagcgctactggcccaacatcctgggcaagaccaccatggtgagcaaccggctgcggctggccctggtgaggatgcagcagctgaagggctttgtggtgcgggccatgaccctggaggacatccagacccgggaggtgcgccacatcagccacctgaacttcaccgcctggccagaccatgacacccccagccagccagatgacctgctgaccttcatctcctacatgaggcacatccacaggagcggccccatcatcacccactgcagcgctggcatcggccgcagcggcaccctcatctgcattgatgtggtgctgggcctcatcagccaggacctggactttgacatcagtgacctggtgcgctgcatgaggctgcagagacatggcatggtgcagacagaggaccagtacatcttctgctaccaggtgatcctgtatgtgctgacccggctgcaggccgaggaggagcagaagcagcagccccagctgctgaagtag

SEQ ID NO: 166262 - DNA, 7458 bp, Artificial Sequence
  Description of Artificial Sequence: Synthetic coding sequence
atgcacgtgtccctggccgaggccctggaggtgcggggcggccccctgcaggaggaggagatctgggccgtgctgaaccagagcgctgagagcctgcaggagctgttcaggaaggtgtccctggccgaccctgctgccctgggcttcatcatcagcccctggagcctgctgctgctgcccagcggctctgtgtccttcacagatgagaacatcagcaaccaggacctgcgggccttcaccgcccctgaggtgctgcagaaccagagcctgaccagcctgagtgatgtggagaagatccacatctacagcctgggcatgaccctgtactggggcgctgactatgaggtgccccagagccagcccatcaagctgggggaccacctgaacagcatcctgctgggcatgtgtgaagatgtgatctatgcccgggtgtctgtgaggacagtgctggatgcctgcagcgcccacatccggaacagcaactgtgcccccagcttctcctatgtgaagcacctggtgaagctggtgctgggcaacctgtctggaacagaccagctgagctgcaacagcgagcagaagccagacaggagccaggccatccgggaccggctgcggggcaagggcctgcccaccggccgcagcagcaccagtgatgtgctggacatccagaagccacccctgagccaccagaccttcctgaacaagggcctgagcaagtccatgggcttcctgagcatcaaggacacccaggatgagaactacttcaaggacatcctgagtgacaacagcggccgggaggacagcgagaacaccttcagcccctaccagttcaagaccagcggccctgagaagaagcccatccctggcattgatgtgctgagcaagaagaagatctgggccagctccatggacctgctgtgcacagctgaccgggacttcagcagtggagaaacagccacctaccgccgctgccaccctgaggccgtgacagtgaggaccagcaccacccccaggaagaaggaggcccgctacagtgatggcagcatcgccctggacatcttcggcccccagaagatggaccccatctaccacacccgggagctgcccaccagcagcgccatcagcagcgccctggaccgcatccgggagcggcagaagaagctgcaggtgctgcgggaggccatgaatgtggaggagcctgtgcggcgctacaagacctaccatggagatgtgttcagcaccagcagcgagagccccagcatcatcagcagcgagagtgacttccggcaggtgcggcgctctgaggccagcaagagatttgagagcagcagcggcctgcccggggtggatgagaccctgagccagggccagagccagaggcccagccggcagtatgagaccccatttgagggcaacctgatcaaccaggagatcatgctgaagaggcaggaggaggagctgatgcagctgcaggccaagatggccctgcggcagagccggctgagcctgtacccaggggacaccatcaaggcctccatgctggacatcacccgggaccccctgcgggagatcgccctggagacagccatgacccagaggaagctgaggaacttctttggacctgagtttgtgaagatgaccatcgagcccttcatcagcctggacctgcccaggagcatcctgaccaagaagggcaagaatgaagacaacagaaggaaggtgaacatcatgctgctgaatggccagaggctggagctgacctgtgacaccaagaccatctgcaaggatgtgtttgacatggtggtggcccacatcggcctggtggagcaccacctgtttgccctggccaccctgaaggacaatgagtacttctttgtggaccctgacctgaagctgaccaaggtggcccctgagggctggaaggaggagcccaagaagaagaccaaggccaccgtgaacttcaccctcttcttccgcatcaagttcttcatggatgatgtgtccctcatccagcacaccctgacctgccaccagtactacctgcagctgaggaaggacatcctggaggagaggatgcactgtgatgatgagaccagcctgctgctggccagcctggccctgcaggccgagtatggagactaccagcctgaggtgcatggagtgtcctacttcaggatggagcactacctgcctgcccgggtgatggagaagctggacctgagctacatcaaggaggagctgcccaagctgcacaacacctacgtgggcgccagcgagaaggagacagagctggagttcctgaaggtgtgccagaggctgacagaatatggagtgcacttccaccgggtgcaccctgagaagaagagccagacaggcatcctgctgggcgtgtgcagcaagggcgtgctggtgtttgaggtgcacaatggagtgaggaccctggtgctgcgcttcccctggagggagaccaagaagatctccttcagcaagaagaagatcaccctgcagaacaccagtgatggcatcaagcacggcttccagacagacaacagcaagatctgccagtacctgctgcacctgtgcagctaccagcacaagttccagctgcagatgagggcccggcagagcaaccaggatgcccaggacatcgagcgggccagcttccgcagcctgaacctgcaggccgagagcgtgcggggcttcaacatgggccgggccatcagcacaggcagcctggccagcagcaccctgaacaagctggccgtgcggcccctgtctgtgcaggccgagatcctgaagaggctgagctgcagcgagctgagcctgtaccagcccctgcagaacagcagcaaggagaagaatgacaaggcctcctgggaggagaagccccgggagatgagcaagagctaccatgacctgagccaggccagcctgtacccccacaggaagaatgtcatcgtgaacatggagcccccaccccagacagtggccgagctggtgggcaagcccagccaccagatgagcagaagtgatgctgagagcctggccggcgtgaccaagctgaacaacagcaagtctgtggccagcctgaacagaagccctgagaggaggaagcatgaaagtgacagcagcagcattgaagatcctggccaggcctacgtgctgggcatgaccatgcacagcagcggcaacagcagcagccaggtgcccctgaaggaaaatgatgtgctgcacaagcgctggagcatcgtgagcagccctgagcgggagatcaccctggtgaacctgaagaaggatgccaagtatggcctgggcttccagatcattggaggagagaagatgggccgcctggacctgggcatcttcatcagctctgtggcccctgggggccctgctgacctggatggctgcctgaagccaggggacaggctcatctctgtgaacagcgtgtccctggagggcgtgagccaccacgccgccatcgagatcctgcagaatgccccagaagatgtgaccctggtgatcagccagcccaaggagaagatcagcaaggtgcccagcacccctgtgcacctgaccaatgagatgaagaactacatgaagaagagcagctacatgcaggacagcgccatcgacagcagcagcaaggaccaccactggagccggggcaccctgcggcacatcagcgagaacagctttggccccagcggcggcctgcgggagggcagcctgagcagccaggacagcaggacagaaagtgccagcctgagccagagccaggtgaatggcttctttgccagccacctgggggaccagacctggcaggagagccagcacggcagccccagccccagcgtcatcagcaaggccacagagaaggagaccttcacagacagcaaccagagcaagaccaagaagccaggcatcagtgatgtgacagactacagcgacagaggagacagcgacatggatgaggccacctacagcagcagccaggaccaccagacccccaagcaggagagcagcagctctgtgaacaccagcaacaagatgaacttcaagaccttcagcagcagcccccccaagccaggggacatctttgaggtggagctggccaagaatgacaacagcctgggcatctctgtgactggaggagtgaacacctctgtgcgccacggcggcatctacgtgaaggctgtgatcccccagggcgctgctgagagtgatggccgcatccacaagggggacagagtgctggccgtgaatggagtgtccctggagggcgccacccacaagcaggccgtggagaccctgaggaacacaggccaggtggtgcacctgctgctggagaagggccagagccccaccagcaaggagcacgtgcctgtgaccccccagtgcaccctgagtgaccagaatgcccagggccagggccctgagaaggtgaagaagaccacccaggtgaaggactacagctttgtgacagaggagaacacctttgaggtgaagctgttcaagaacagcagcggcctgggcttctccttcagccgggaggacaacctgatccctgagcagatcaatgccagcatcgtgcgggtgaagaagctgtttcctggccagcctgctgctgagagcggcaagattgatgtgggagatgtgatcctgaaggtgaatggagccagcctgaagggcctgagccagcaggaggtgatcagcgccctgcggggcacagcccctgaggtgttcctgctgctgtgccggcccccacctggggtgctgcctgagattgacacagccctgctgacccccctgcagagccctgcccaggtgctgcccaacagcagcaaggacagcagccagcccagctgtgtggagcagagcaccagcagtgatgaaaatgagatgtctgacaagagcaagaagcagtgcaagagccccagccggcgggacagctacagcgacagcagcggcagcggggaggatgacctggtgacagccccagccaacatcagcaacagcacctggagcagcgccctgcaccagaccctgagcaacatggtgtcccaggcccagagccaccacgaggcccccaagagccaggaggacaccatctgcaccatgttctactacccccagaagatccccaacaagccagagtttgaggacagcaaccccagccccctgcccccagacatggcccctggccagagctaccagccccagagcgagagcgccagcagcagctccatggacaagtaccacatccaccacatcagcgagcccacccggcaggagaactggacccccctgaagaatgacctggagaaccacctggaggactttgagctggaggtggagctgctgatcaccctcatcaagtctgagaagggcagcctgggcttcaccgtgaccaagggcaaccagagaattggctgctacgtgcatgatgtgatccaggaccctgccaagagtgatggccgcctgaagccaggggacaggctcatcaaggtgaatgacacagatgtgaccaacatgacccacacagatgctgtgaacctgctgcgggccgccagcaagacagtgcggctggtgattggccgggtgctggagctgccccgcatccccatgctgccccacctgctgcctgacatcaccctgacctgcaacaaggaggagctgggcttcagcctgtgtggcggccatgacagcctgtaccaggtggtgtacatcagtgacatcaaccccaggtctgtggccgccatcgagggcaacctgcagctgctggatgtgatccactacgtgaatggagtgtccacccagggcatgaccctggaggaggtgaacagagccctggacatgagcctgcccagcctggtgctgaaggccaccagaaatgacctgcctgtggtgcccagcagcaagaggtctgctgtgtctgcccccaagagcaccaagggaaatggcagctacagcgtgggcagctgcagccagcctgccctgaccccaaatgacagcttcagcacagtggccggggaggagatcaatgagatctcctaccccaagggcaagtgcagcacctaccagatcaagggcagccccaacctgaccctgcccaaggagagctacatccaggaggatgacatctatgatgacagccaggaggccgaggtgatccagagcctgctggatgtggtggatgaggaggcccagaacctgctgaatgaaaataatgctgctggctacagctgtggccctggcaccctgaagatgaatggcaagctgtctgaggagaggacagaggacacagactgtgatggcagccccctgcctgagtacttcacagaggccaccaagatgaatggctgtgaggagtactgtgaggagaaggtgaagtctgagagcctcatccagaagccccaggagaagaagacagatgatgatgagatcacctggggcaatgatgagctgcccatcgagaggaccaaccacgaggacagcgacaaggaccacagcttcctgaccaatgatgagctggccgtgctgcctgtggtgaaggtgctgcccagcggcaagtacacaggagccaacctgaagagcgtcatccgggtgctgcggggcctgctggaccagggcatccccagcaaggagctggagaacctgcaggagctgaagcccctggaccagtgcctgattggccagaccaaggagaacagaaggaagaaccgctacaagaacatcctgccctatgatgccaccagggtgcccctgggagatgagggcggctacatcaatgccagcttcatcaagatccctgtgggcaaggaggagtttgtgtacatcgcctgccagggccccctgcccaccaccgtgggggacttctggcagatgatctgggagcagaagagcacagtgattgccatgatgacccaggaggtggagggggagaagatcaagtgccagcgctactggcccaacatcctgggcaagaccaccatggtgagcaaccggctgcggctggccctggtgaggatgcagcagctgaagggctttgtggtgcgggccatgaccctggaggacatccagacccgggaggtgcgccacatcagccacctgaacttcaccgcctggccagaccatgacacccccagccagccagatgacctgctgaccttcatctcctacatgaggcacatccacaggagcggccccatcatcacccactgcagcgctggcatcggccgcagcggcaccctcatctgcattgatgtggtgctgggcctcatcagccaggacctggactttgacatcagtgacctggtgcgctgcatgaggctgcagagacatggcatggtgcagacagaggaccagtacatcttctgctaccaggtgatcctgtatgtgctgacccggctgcaggccgaggaggagcagaagcagcagccccagctgctgaagtag

SEQ ID NO: 166263 - DNA, 7401 bp, Artificial Sequence
  Description of Artificial Sequence: Synthetic coding sequence
atgcacgtgtccctggccgaggccctggaggtgcggggcggccccctgcaggaggaggagatctgggccgtgctgaaccagagcgctgagagcctgcaggagctgttcaggaaggtgtccctggccgaccctgctgccctgggcttcatcatcagcccctggagcctgctgctgctgcccagcggctctgtgtccttcacagatgagaacatcagcaaccaggacctgcgggccttcaccgcccctgaggtgctgcagaaccagagcctgaccagcctgagtgatgtggagaagatccacatctacagcctgggcatgaccctgtactggggcgctgactatgaggtgccccagagccagcccatcaagctgggggaccacctgaacagcatcctgctgggcatgtgtgaagatgtgatctatgcccgggtgtctgtgaggacagtgctggatgcctgcagcgcccacatccggaacagcaactgtgcccccagcttctcctatgtgaagcacctggtgaagctggtgctgggcaacctgtctggaacagaccagctgagctgcaacagcgagcagaagccagacaggagccaggccatccgggaccggctgcggggcaagggcctgcccaccggccgcagcagcaccagtgatgtgctggacatccagaagccacccctgagccaccagaccttcctgaacaagggcctgagcaagtccatgggcttcctgagcatcaaggacacccaggatgagaactacttcaaggacatcctgagtgacaacagcggccgggaggacagcgagaacaccttcagcccctaccagttcaagaccagcggccctgagaagaagcccatccctggcattgatgtgctgagcaagaagaagatctgggccagctccatggacctgctgtgcacagctgaccgggacttcagcagtggagaaacagccacctaccgccgctgccaccctgaggccgtgacagtgaggaccagcaccacccccaggaagaaggaggcccgctacagtgatggcagcatcgccctggacatcttcggcccccagaagatggaccccatctaccacacccgggagctgcccaccagcagcgccatcagcagcgccctggaccgcatccgggagcggcagaagaagctgcaggtgctgcgggaggccatgaatgtggaggagcctgtgcggcgctacaagacctaccatggagatgtgttcagcaccagcagcgagagccccagcatcatcagcagcgagagtgacttccggcaggtgcggcgctctgaggccagcaagagatttgagagcagcagcggcctgcccggggtggatgagaccctgagccagggccagagccagaggcccagccggcagtatgagaccccatttgagggcaacctgatcaaccaggagatcatgctgaagaggcaggaggaggagctgatgcagctgcaggccaagatggccctgcggcagagccggctgagcctgtacccaggggacaccatcaaggcctccatgctggacatcacccgggaccccctgcgggagatcgccctggagacagccatgacccagaggaagctgaggaacttctttggacctgagtttgtgaagatgaccatcgagcccttcatcagcctggacctgcccaggagcatcctgaccaagaagggcaagaatgaagacaacagaaggaaggtgaacatcatgctgctgaatggccagaggctggagctgacctgtgacaccaagaccatctgcaaggatgtgtttgacatggtggtggcccacatcggcctggtggagcaccacctgtttgccctggccaccctgaaggacaatgagtacttctttgtggaccctgacctgaagctgaccaaggtggcccctgagggctggaaggaggagcccaagaagaagaccaaggccaccgtgaacttcaccctcttcttccgcatcaagttcttcatggatgatgtgtccctcatccagcacaccctgacctgccaccagtactacctgcagctgaggaaggacatcctggaggagaggatgcactgtgatgatgagaccagcctgctgctggccagcctggccctgcaggccgagtatggagactaccagcctgaggtgcatggagtgtcctacttcaggatggagcactacctgcctgcccgggtgatggagaagctggacctgagctacatcaaggaggagctgcccaagctgcacaacacctacgtgggcgccagcgagaaggagacagagctggagttcctgaaggtgtgccagaggctgacagaatatggagtgcacttccaccgggtgcaccctgagaagaagagccagacaggcatcctgctgggcgtgtgcagcaagggcgtgctggtgtttgaggtgcacaatggagtgaggaccctggtgctgcgcttcccctggagggagaccaagaagatctccttcagcaagaagaagatcaccctgcagaacaccagtgatggcatcaagcacggcttccagacagacaacagcaagatctgccagtacctgctgcacctgtgcagctaccagcacaagttccagctgcagatgagggcccggcagagcaaccaggatgcccaggacatcgagcgggccagcttccgcagcctgaacctgcaggccgagagcgtgcggggcttcaacatgggccgggccatcagcacaggcagcctggccagcagcaccctgaacaagctggccgtgcggcccctgtctgtgcaggccgagatcctgaagaggctgagctgcagcgagctgagcctgtaccagcccctgcagaacagcagcaaggagaagaatgacaaggcctcctgggaggagaagccccgggagatgagcaagagctaccatgacctgagccaggccagcctgtacccccacaggaagaatgtcatcgtgaacatggagcccccaccccagacagtggccgagctggtgggcaagcccagccaccagatgagcagaagtgatgctgagagcctggccggcgtgaccaagctgaacaacagcaagtctgtggccagcctgaacagaagccctgagaggaggaagcatgaaagtgacagcagcagcattgaagatcctggccaggcctacgtgctggatgtgctgcacaagcgctggagcatcgtgagcagccctgagcgggagatcaccctggtgaacctgaagaaggatgccaagtatggcctgggcttccagatcatcggcggggagaagatgggccgcctggacctgggcatcttcatcagctctgtggcccctgggggccctgctgacctggatggctgcctgaagccaggggacaggctcatctctgtgaacagcgtgtccctggagggcgtgagccaccacgccgccatcgagatcctgcagaatgccccagaagatgtgaccctggtgatcagccagcccaaggagaagatcagcaaggtgcccagcacccctgtgcacctgaccaatgagatgaagaactacatgaagaagagcagctacatgcaggacagcgccatcgacagcagcagcaaggaccaccactggagccggggcaccctgcggcacatcagtgaaaattcctttggccccagcggcggcctgcgggagggcagcctgagcagccaggacagcaggacagagagcgccagcctgagccagagccaggtgaatggcttctttgccagccacctgggggaccagacctggcaggagagccagcacggcagccccagccccagcgtcatcagcaaggccacagagaaggagaccttcacagacagcaaccagagcaagaccaagaagccaggcatcagtgatgtgacagactacagcgacagaggagacagcgacatggatgaggccacctacagcagcagccaggaccaccagacccccaagcaggagagcagcagctctgtgaacaccagcaacaagatgaacttcaagaccttcagcagcagcccccccaagccaggggacatctttgaggtggagctggccaagaatgacaacagcctgggcatctctgtgactggaggagtgaacacctctgtgagacatggaggcatctacgtgaaggccgtcatcccccagggcgctgctgagagtgatggccgcatccacaagggggacagagtgctggccgtgaatggagtgtccctggagggcgccacccacaagcaggccgtggagaccctgaggaacacaggccaggtggtgcacctgctgctggagaagggccagagccccaccagcaaggagcacgtgcctgtgaccccccagtgcaccctgagtgaccagaatgcccagggccagggccctgagaaggtgaagaagaccacccaggtgaaggactacagctttgtgacagaggagaacacctttgaggtgaagctgttcaagaacagcagcggcctgggcttctccttcagccgggaggacaacctgatccctgagcagatcaatgccagcatcgtgcgggtgaagaagctgtttcctggccagcctgctgctgagagcggcaagattgatgtgggagatgtgatcctgaaggtgaatggagccagcctgaagggcctgagccagcaggaggtgatcagcgccctgcggggcacagcccctgaggtgttcctgctgctgtgcaggcctcctcctggggtgctgcctgagattgacacagccctgctgacccccctgcagagccctgcccaggtgctgcccaacagcagcaaggacagcagccagcccagctgtgtggagcagagcaccagcagtgatgaaaatgagatgtctgacaagagcaagaagcagtgcaagagccccagcagaagagacagctacagcgacagcagcggcagcggagaagatgacctggtgacagccccagccaacatcagcaacagcacctggagcagcgccctgcaccagaccctgagcaacatggtgtcccaggcccagagccaccacgaggcccccaagagccaggaggacaccatctgcaccatgttctactacccccagaagatccccaacaagccagagtttgaggacagcaaccccagccccctgcccccagacatggcccctggccagagctaccagccccagagcgagagcgccagcagcagctccatggacaagtaccacatccaccacatcagcgagcccacccggcaggagaactggacccccctgaagaatgacctggagaaccacctggaggactttgagctggaggtggagctgctgatcaccctcatcaagtctgagaagggcagcctgggcttcaccgtgaccaagggcaaccagagaattggctgctacgtgcatgatgtgatccaggaccctgccaagagtgatggccgcctgaagccaggggacaggctcatcaaggtgaatgacacagatgtgaccaacatgacccacacagatgctgtgaacctgctgcgggccgccagcaagacagtgcggctggtgattggccgggtgctggagctgccccgcatccccatgctgccccacctgctgcctgacatcaccctgacctgcaacaaggaggagctgggcttcagcctgtgtggcggccatgacagcctgtaccaggtggtgtacatcagtgacatcaaccccaggtctgtggccgccatcgagggcaacctgcagctgctggatgtgatccactacgtgaatggagtgtccacccagggcatgaccctggaggaggtgaacagagccctggacatgagcctgcccagcctggtgctgaaggccaccagaaatgacctgcctgtggtgcccagcagcaagaggtctgctgtgtctgcccccaagagcaccaagggaaatggcagctacagcgtgggcagctgcagccagcctgccctgaccccaaatgacagcttcagcacagtggccggggaggagatcaatgagatctcctaccccaagggcaagtgcagcacctaccagatcaagggcagccccaacctgaccctgcccaaggagagctacatccaggaggatgacatctatgatgacagccaggaggccgaggtgatccagagcctgctggatgtggtggatgaggaggcccagaacctgctgaatgaaaataatgctgctggctacagctgtggccctggcaccctgaagatgaatggcaagctgtctgaggagaggacagaggacacagactgtgatggcagccccctgcctgagtacttcacagaggccaccaagatgaatggctgtgaggagtactgtgaggagaaggtgaagtctgagagcctcatccagaagccccaggagaagaagacagatgatgatgagatcacctggggcaatgatgagctgcccattgaaagaaccaaccatgaagattctgacaaggaccacagcttcctgaccaatgatgagctggccgtgctgcctgtggtgaaggtgctgcccagcggcaagtacaccggggccaacctgaagagcgtcatccgggtgctgcggggcctgctggaccagggcatccccagcaaggagctggagaacctgcaggagctgaagcccctggaccagtgcctgattggccagaccaaggaaaatagaaggaagaaccgctacaagaacatcctgccctatgatgccaccagggtgcccctgggagatgaaggaggctacatcaatgccagcttcatcaagatccctgtgggcaaggaggagtttgtgtacatcgcctgccagggccccctgcccaccaccgtgggggacttctggcagatgatctgggagcagaagagcaccgtcatcgccatgatgacccaggaggtggagggggagaagatcaagtgccagcgctactggcccaacatcctgggcaagaccaccatggtgagcaaccggctgcggctggccctggtgaggatgcagcagctgaagggctttgtggtgcgggccatgaccctggaggacatccagacccgggaggtgcgccacatcagccacctgaacttcaccgcctggccagaccatgacacccccagccagccagatgacctgctgaccttcatctcctacatgaggcacatccacaggagcggccccatcatcacccactgcagcgctggcatcggccgcagcggcaccctcatctgcattgatgtggtgctgggcctcatcagccaggacctggactttgacatcagtgacctggtgcgctgcatgaggctgcagagacatggcatggtgcagacagaggaccagtacatcttctgctaccaggtgatcctgtatgtgctgacccggctgcaggccgaggaggagcagaagcagcagccccagctgctgaagtag

SEQ ID NO: 166264 - DNA, 7473 bp, Artificial Sequence
  Description of Artificial Sequence: Synthetic coding sequence
atgcacgtgtccctggccgaggccctggaggtgcggggcggccccctgcaggaggaggagatctgggccgtgctgaaccagagcgctgagagcctgcaggagctgttcaggaaggtgtccctggccgaccctgctgccctgggcttcatcatcagcccctggagcctgctgctgctgcccagcggctctgtgtccttcacagatgagaacatcagcaaccaggacctgcgggccttcaccgcccctgaggtgctgcagaaccagagcctgaccagcctgagtgatgtggagaagatccacatctacagcctgggcatgaccctgtactggggcgctgactatgaggtgccccagagccagcccatcaagctgggggaccacctgaacagcatcctgctgggcatgtgtgaagatgtgatctatgcccgggtgtctgtgaggacagtgctggatgcctgcagcgcccacatccggaacagcaactgtgcccccagcttctcctatgtgaagcacctggtgaagctggtgctgggcaacctgtctggaacagaccagctgagctgcaacagcgagcagaagccagacaggagccaggccatccgggaccggctgcggggcaagggcctgcccaccggccgcagcagcaccagtgatgtgctggacatccagaagccacccctgagccaccagaccttcctgaacaagggcctgagcaagtccatgggcttcctgagcatcaaggacacccaggatgagaactacttcaaggacatcctgagtgacaacagcggccgggaggacagcgagaacaccttcagcccctaccagttcaagaccagcggccctgagaagaagcccatccctggcattgatgtgctgagcaagaagaagatctgggccagctccatggacctgctgtgcacagctgaccgggacttcagcagtggagaaacagccacctaccgccgctgccaccctgaggccgtgacagtgaggaccagcaccacccccaggaagaaggaggcccgctacagtgatggcagcatcgccctggacatcttcggcccccagaagatggaccccatctaccacacccgggagctgcccaccagcagcgccatcagcagcgccctggaccgcatccgggagcggcagaagaagctgcaggtgctgcgggaggccatgaatgtggaggagcctgtgcggcgctacaagacctaccatggagatgtgttcagcaccagcagcgagagccccagcatcatcagcagcgagagtgacttccggcaggtgcggcgctctgaggccagcaagagatttgagagcagcagcggcctgcccggggtggatgagaccctgagccagggccagagccagaggcccagccggcagtatgagaccccatttgagggcaacctgatcaaccaggagatcatgctgaagaggcaggaggaggagctgatgcagctgcaggccaagatggccctgcggcagagccggctgagcctgtacccaggggacaccatcaaggcctccatgctggacatcacccgggaccccctgcgggagatcgccctggagacagccatgacccagaggaagctgaggaacttctttggacctgagtttgtgaagatgaccatcgagcccttcatcagcctggacctgcccaggagcatcctgaccaagaagggcaagaatgaagacaacagaaggaaggtgaacatcatgctgctgaatggccagaggctggagctgacctgtgacaccaagaccatctgcaaggatgtgtttgacatggtggtggcccacatcggcctggtggagcaccacctgtttgccctggccaccctgaaggacaatgagtacttctttgtggaccctgacctgaagctgaccaaggtggcccctgagggctggaaggaggagcccaagaagaagaccaaggccaccgtgaacttcaccctcttcttccgcatcaagttcttcatggatgatgtgtccctcatccagcacaccctgacctgccaccagtactacctgcagctgaggaaggacatcctggaggagaggatgcactgtgatgatgagaccagcctgctgctggccagcctggccctgcaggccgagtatggagactaccagcctgaggtgcatggagtgtcctacttcaggatggagcactacctgcctgcccgggtgatggagaagctggacctgagctacatcaaggaggagctgcccaagctgcacaacacctacgtgggcgccagcgagaaggagacagagctggagttcctgaaggtgtgccagaggctgacagaatatggagtgcacttccaccgggtgcaccctgagaagaagagccagacaggcatcctgctgggcgtgtgcagcaagggcgtgctggtgtttgaggtgcacaatggagtgaggaccctggtgctgcgcttcccctggagggagaccaagaagatctccttcagcaagaagaagatcaccctgcagaacaccagtgatggcatcaagcacggcttccagacagacaacagcaagatctgccagtacctgctgcacctgtgcagctaccagcacaagttccagctgcagatgagggcccggcagagcaaccaggatgcccaggacatcgagcgggccagcttccgcagcctgaacctgcaggccgagagcgtgcggggcttcaacatgggccgggccatcagcacaggcagcctggccagcagcaccctgaacaagctggccgtgcggcccctgtctgtgcaggccgagatcctgaagaggctgagctgcagcgagctgagcctgtaccagcccctgcagaacagcagcaaggagaagaatgacaaggcctcctgggaggagaagccccgggagatgagcaagagctaccatgacctgagccaggccagcctgtacccccacaggaagaatgtcatcgtgaacatggagcccccaccccagacagtggccgagctggtgggcaagcccagccaccagatgagcagaagtgatgctgagagcctggccggcgtgaccaagctgaacaacagcaagtctgtggccagcctgaacagaagccctgagaggaggaagcatgaaagtgacagcagcagcattgaagatcctggccaggcctacgtgctgggcatgaccatgcacagcagcggcaacagcagcagccaggtgcccctgaaggaaaatgatgtgctgcacaagcgctggagcatcgtgagcagccctgagcgggagatcaccctggtgaacctgaagaaggatgccaagtatggcctgggcttccagatcattggaggagagaagatgggccgcctggacctgggcatcttcatcagctctgtggcccctgggggccctgctgacctggatggctgcctgaagccaggggacaggctcatctctgtgaacagcgtgtccctggagggcgtgagccaccacgccgccatcgagatcctgcagaatgccccagaagatgtgaccctggtgatcagccagcccaaggagaagatcagcaaggtgcccagcacccctgtgcacctgaccaatgagatgaagaactacatgaagaagagcagctacatgcaggacagcgccatcgacagcagcagcaaggaccaccactggagccggggcaccctgcggcacatcagcgagaacagctttggccccagcggcggcctgcgggagggcagcctgagcagccaggacagcaggacagaaagtgccagcctgagccagagccaggtgaatggcttctttgccagccacctgggggaccagacctggcaggagagccagcacggcagccccagccccagcgtcatcagcaaggccacagagaaggagaccttcacagacagcaaccagagcaagaccaagaagccaggcatcagtgatgtgacagactacagcgacagaggagacagcgacatggatgaggccacctacagcagcagccaggaccaccagacccccaagcaggagagcagcagctctgtgaacaccagcaacaagatgaacttcaagaccttcagcagcagcccccccaagccaggggacatctttgaggtggagctggccaagaatgacaacagcctgggcatctctgtgacagtgctgtttgacaagggcggcgtgaacacctctgtgagacatggaggcatctacgtgaaggccgtcatcccccagggcgctgctgagagtgatggccgcatccacaagggggacagagtgctggccgtgaatggagtgtccctggagggcgccacccacaagcaggccgtggagaccctgaggaacacaggccaggtggtgcacctgctgctggagaagggccagagccccaccagcaaggagcacgtgcctgtgaccccccagtgcaccctgagtgaccagaatgcccagggccagggccctgagaaggtgaagaagaccacccaggtgaaggactacagctttgtgacagaggagaacacctttgaggtgaagctgttcaagaacagcagcggcctgggcttctccttcagccgggaggacaacctgatccctgagcagatcaatgccagcatcgtgcgggtgaagaagctgtttcctggccagcctgctgctgagagcggcaagattgatgtgggagatgtgatcctgaaggtgaatggagccagcctgaagggcctgagccagcaggaggtgatcagcgccctgcggggcacagcccctgaggtgttcctgctgctgtgcaggcctcctcctggggtgctgcctgagattgacacagccctgctgacccccctgcagagccctgcccaggtgctgcccaacagcagcaaggacagcagccagcccagctgtgtggagcagagcaccagcagtgatgaaaatgagatgtctgacaagagcaagaagcagtgcaagagccccagcagaagagacagctacagcgacagcagcggcagcggagaagatgacctggtgacagccccagccaacatcagcaacagcacctggagcagcgccctgcaccagaccctgagcaacatggtgtcccaggcccagagccaccacgaggcccccaagagccaggaggacaccatctgcaccatgttctactacccccagaagatccccaacaagccagagtttgaggacagcaaccccagccccctgcccccagacatggcccctggccagagctaccagccccagagcgagagcgccagcagcagctccatggacaagtaccacatccaccacatcagcgagcccacccggcaggagaactggacccccctgaagaatgacctggagaaccacctggaggactttgagctggaggtggagctgctgatcaccctcatcaagtctgagaagggcagcctgggcttcaccgtgaccaagggcaaccagagaattggctgctacgtgcatgatgtgatccaggaccctgccaagagtgatggccgcctgaagccaggggacaggctcatcaaggtgaatgacacagatgtgaccaacatgacccacacagatgctgtgaacctgctgcgggccgccagcaagacagtgcggctggtgattggccgggtgctggagctgccccgcatccccatgctgccccacctgctgcctgacatcaccctgacctgcaacaaggaggagctgggcttcagcctgtgtggcggccatgacagcctgtaccaggtggtgtacatcagtgacatcaaccccaggtctgtggccgccatcgagggcaacctgcagctgctggatgtgatccactacgtgaatggagtgtccacccagggcatgaccctggaggaggtgaacagagccctggacatgagcctgcccagcctggtgctgaaggccaccagaaatgacctgcctgtggtgcccagcagcaagaggtctgctgtgtctgcccccaagagcaccaagggaaatggcagctacagcgtgggcagctgcagccagcctgccctgaccccaaatgacagcttcagcacagtggccggggaggagatcaatgagatctcctaccccaagggcaagtgcagcacctaccagatcaagggcagccccaacctgaccctgcccaaggagagctacatccaggaggatgacatctatgatgacagccaggaggccgaggtgatccagagcctgctggatgtggtggatgaggaggcccagaacctgctgaatgaaaataatgctgctggctacagctgtggccctggcaccctgaagatgaatggcaagctgtctgaggagaggacagaggacacagactgtgatggcagccccctgcctgagtacttcacagaggccaccaagatgaatggctgtgaggagtactgtgaggagaaggtgaagtctgagagcctcatccagaagccccaggagaagaagacagatgatgatgagatcacctggggcaatgatgagctgcccattgaaagaaccaaccatgaagattctgacaaggaccacagcttcctgaccaatgatgagctggccgtgctgcctgtggtgaaggtgctgcccagcggcaagtacaccggggccaacctgaagagcgtcatccgggtgctgcggggcctgctggaccagggcatccccagcaaggagctggagaacctgcaggagctgaagcccctggaccagtgcctgattggccagaccaaggaaaatagaaggaagaaccgctacaagaacatcctgccctatgatgccaccagggtgcccctgggagatgaaggaggctacatcaatgccagcttcatcaagatccctgtgggcaaggaggagtttgtgtacatcgcctgccagggccccctgcccaccaccgtgggggacttctggcagatgatctgggagcagaagagcaccgtcatcgccatgatgacccaggaggtggagggggagaagatcaagtgccagcgctactggcccaacatcctgggcaagaccaccatggtgagcaaccggctgcggctggccctggtgaggatgcagcagctgaagggctttgtggtgcgggccatgaccctggaggacatccagacccgggaggtgcgccacatcagccacctgaacttcaccgcctggccagaccatgacacccccagccagccagatgacctgctgaccttcatctcctacatgaggcacatccacaggagcggccccatcatcacccactgcagcgctggcatcggccgcagcggcaccctcatctgcattgatgtggtgctgggcctcatcagccaggacctggactttgacatcagtgacctggtgcgctgcatgaggctgcagagacatggcatggtgcagacagaggaccagtacatcttctgctaccaggtgatcctgtatgtgctgacccggctgcaggccgaggaggagcagaagcagcagccccagctgctgaagtag

SEQ ID NO: 166265 - DNA, 420 bp, Artificial Sequence
  Description of Artificial Sequence: Synthetic coding sequence
atgcacgtgtccctggccgaggccctggaggtgcggggcggccccctgcaggaggaggagatctgggccgtgctgaaccagagcgctgagagcctgcaggagctgttcaggaaggtgtccctggccgaccctgctgccctgggcttcatcatcagcccctggagcctgctgctgctgcccagcggctctgtgtccttcacagatgagaacatcagcaaccaggacctgcgggccttcaccgcccctgaggtgctgcagaaccagagcctgaccagcctgagtgatgtggagaagatccacatctacagcctgggcatgaccctgtactggggcgctgactatgaggtgccccagagccagcccatcaagctgggggaccacctgaacagcatcctgctgggcatgtgtgaagatgtgtag

SEQ ID NO: 166266 - DNA, 7473 bp, Artificial Sequence; identical to SEQ ID NO: 166264
  Description of Artificial Sequence: Synthetic coding sequence

SEQ ID NO: 166267 - DNA, 3564 bp, Artificial Sequence
  Description of Artificial Sequence: Synthetic coding sequence
atgcccttcggcctgaagctgcggaggacccggcgctacaacgtgctgagcaagaactgctttgtgacccgcatccggctgctggacagcaatgtgattgagtgcaccctgtctgtggagagcacaggccaggagtgcctggaggccgtggcccagaggctggagctgcgggagacccactacttcggcctgtggttcctgagcaagagccagcaggcccgctgggtggagctggagaagcccctgaagaagcacctggacaagtttgccaatgagcccctgctcttctttggagtgatgttctacgtgcccaacgtgtcctggctgcagcaggaggccacccgctaccagtactacctgcaggtgaagaaggatgtgctggagggccgcctgcgctgcaccctggaccaggtgatccggctggccggcctggccgtgcaggccgactttggagactacaaccagtttgacagccaggacttcctgcgggagtatgtgctcttccccatggacctggccctggaggaggccgtgctggaggagctgacccagaaggtggcccaggagcacaaggcccacagcggcatcctgcctgctgaggccgagctgatgtacatcaatgaggtggagcggctggatggcttcggccaggagatcttccctgtgaaggacaaccacggcaactgtgtgcacctgggcatcttcttcatgggcatctttgtgaggaacagaattggccggcaggccgtcatctaccgctggaatgacatgggcaacatcacccacaacaagagcaccatcctggtggagctgatcaacaaggaggagacagccctcttccacacagatgacattgaaaatgccaagtacatcagccggctgtttgccaccaggcacaagttctacaagcagaacaagatctgcacagagcagagcaacagccccccacccatccggcggcagcccacctggagccgcagcagcctgccccggcagcagccctacatcctgccccctgtgcacgtgcagtgtggggagcactacagcgagacccacaccagccaggacagcatcttccacggcaatgaggaggccctgtactgcaacagccacaacagcctggacctgaactacctgaatggcaccgtgaccaatggatctgtgtgcagcgtgcacagcgtgaacagcctgaactgcagccagagcttcatccaggccagccctgtgagcagcaacctgagcatccctggcagtgacatcatgagagctgactacatccccagccaccgccacagcgccatcatcgtgcccagctaccggcccaccccagactatgaaacagtgatgaggcagatgaagaggggcatcctgcacacagacagccagagccagagcctgaggaacctgaacatcatcaacacccacgcctacaaccagcctgaggacctggtgtacagccagcctgagatgagggagcggcacccctacacagtgccctacggcccccagggcgtgtacagcaacaagctggtgagccccagcgaccagaggaaccccaagaacaacgtggtgcccagcaagccaggggccagcgccatcagccacacagtgtccaccccagagctggccaacatgcagctgcagggcagccacaactacagcacagcccacatgctgaagaactacctgttccggcccccaccaccctacccccggcccaggcctgccaccagcaccccagacctggccagccaccgccacaagtatgtgtctggcagcagcccagacctggtgaccaggaaggtgcagctgtctgtgaagaccttccaggaggacagcagccctgtggtgcaccagagcctgcaggaggtgtctgagcccctgacagccaccaagcaccacggcaccgtgaacaagaggcacagcctggaggtgatgaacagcatggtgcggggcatggaggccatgaccctgaagagcctgcacctgcccatggcccggaggaacaccctgcgggagcagggccccccagaggagggcagcggcagccatgaggtgccccagctgccccagtaccaccacaagaagaccttcagtgatgccaccatgctgatccacagcagcgagagcgaggaggaggaggaggaggcccctgagagcgtgccccagatccccatgctgcgggagaagatggagtacagcgcccagctgcaggccgccctggcccgcatccccaacaagcccccacctgagtacccaggccccaggaagtctgtgtccaatggagccctgcggcaggaccaggccagcctgcccccagccatggcccgggcccgggtgctgcggcacggccctgccaaggccatctccatgagcaggacagaccccccagctgtgaatggagccagcctgggccccagcatcagcgagccagacctgacctctgtgaaggagcgggtgaagaaggagcctgtgaaggagaggcctgtgtctgagatgttcagcctggaggacagcatcatcgagcgggagatgatgatccggaacctggagaagcagaagatggccggcctggaggcccagaagaggcccctgatgctggccgccctgaatggcctgtctgtggcccgggtgtctggccgggaggagaacagagtggatgccaccagggtgcccatggatgagcgcttccgcaccctgaagaagaagctggaggagggcatggtgttcacagaatatgagcagatccccaagaagaaggccaacggcatcttcagcacagctgccctgcctgaaaatgctgagaggagccgcatccgggaggtggtgccctatgaagaaaatagagtggagctgatccccaccaaggagaacaacacaggctacatcaatgccagccacatcaaggtggtggtgggcggcgctgagtggcactacatcgccacccagggccccctgccccacacctgccacgacttctggcagatggtgtgggagcagggcgtgaatgtgattgccatggtgacagctgaggaggagggcggccgcaccaagagccaccgctactggcccaagctgggcagcaagcacagcagcgccacctacggcaagttcaaggtgaccaccaagttcagaacagacagcgtgtgctacgccaccaccggcctgaaggtgaagcacctgctgagcggccaggagaggacagtgtggcacctgcagtacacagactggccagaccacggctgcccagaagatgtgcagggcttcctgagctacctggaggagatccagagcgtgcggcggcacaccaacagcatgctggagggcaccaagaacagacacccccccatcgtggtgcactgcagcgctggggtgggccgcactggagtgctgatcctgtctgagctgatgatctactgcctggagcacaatgagaaggtggaggtgcccatgatgctgcggctgctgcgggagcagaggatgttcatgatccagaccatcgcccagtacaagtttgtgtaccaggtgctgatccagttcctgcagaacagccgcctcatctag

SEQ ID NO: 166268 - DNA, 636 bp, Artificial Sequence
  Description of Artificial Sequence: Synthetic coding sequence
atgcccttcggcctgaagctgcggaggacccggcgctacaacgtgctgagcaagaactgctttgtgacccgcatccggctgctggacagcaatgtgattgagtgcaccctgtctgtggagagcacaggccaggagtgcctggaggccgtggcccagaggctggagctgcgggagacccactacttcggcctgtggttcctgagcaagagccagcaggcccgctgggtggagctggagaagcccctgaagaagcacctggacaagtttgccaatgagcccctgctcttctttggagtgatgttctacgtgcccaacgtgtcctggctgcagcaggaggccacccgctaccagtactacctgcaggtgaagaaggatgtgctggagggccgcctgcgctgcaccctggaccaggtgatccggctggccggcctggccgtgcaggccgactttggagactacaaccagtttgacagccaggacttcctgcgggagtatgtgctcttccccatggacctggccctggaggaggccgtgctggaggagctgacccagaaggtggcccaggagcacaaggcccacaggaccatcatggagaccgtgtacaccctggccttcagcctgtggggcttctcctag

SEQ ID NO: 166269 - DNA, 1383 bp, Artificial Sequence
  Description of Artificial Sequence: Synthetic coding sequence
atgagccgcagcctggacagcgcccggagcttcctggagcggctggaggcccggggcggccgggagggcgctgtgctggccggggagttcagtgacatccaggcctgcagcgctgcctggaaggcagatggagtgtgcagcacagtggccggcagcaggccagaaaatgtgaggaagaaccgctacaaggatgtgctgccctatgaccagaccagggtcatcctgagcctgctgcaggaggagggccacagcgactacatcaatggaaacttcatccggggcgtggatggcagcctggcctacatcgccacccagggccccctgccccacaccctgctggacttctggaggctggtgtgggagtttggagtgaaggtgatcctgatggcctgccgggagattgaaaatggaaggaagagatgtgagcgctactgggcccaggagcaggagcccctgcagacaggcctcttctgcatcaccctcatcaaggagaagtggctgaatgaagacatcatgctgcggaccctgaaggtgaccttccagaaggagagccgctctgtgtaccagctgcagtacatgtcctggccagacagaggagtgcccagcagcccagaccacatgctggccatggtggaggaggcccggcggctgcagggcagcggccctgagcccctgtgtgtgcactgcagcgctggctgcggccgcactggagtgctgtgcaccgtggactatgtgcggcagctgctgctgacccagatgatccccccagacttcagcctgtttgatgtggtgctgaagatgaggaagcagaggcctgctgctgtgcagacagaggagcagtaccgcttcctgtaccacacagtggcccagatgttctgcagcaccctgcagaatgccagcccccactaccagaacatcaaggagaactgtgcccccctgtatgatgatgccctcttcctgcggaccccccaggccctgctggccatcccccggcccccaggaggagtgctgcggagcatctctgtgcccggcagccctggccacgccatggctgacacctatgctgtggtgcagaagagaggagccccagctggggccggcagcggcacccagacaggcaccggcaccggcaccggggcccggtctgctgaggaggcccccctgtacagcaaggtgaccccccgggcccagaggcctggggcccatgctgaagatgcccggggcaccctgcccggccgggtgcctgctgaccagagccctgctggcagcggggcctatgaagatgtggccggcggggcccagacaggaggcctgggcttcaacctgcgcatcggccggcccaagggcccccgggaccccccagctgagtggaccagggtgtag

SEQ ID NO: 166270 - DNA, 1248 bp, Artificial Sequence
  Description of Artificial Sequence: Synthetic coding sequence
atgcccaccaccatcgagcgggagtttgaggagctggacacccagaggcgctggcagcccctgtacctggagatcagaaatgaaagccatgactacccccaccgggtggccaagttcccagaaaatagaaacagaaaccgctacagagatgtgagcccctatgaccacagccgggtgaagctgcagaatgcagaaaatgactacatcaatgccagcctggtggacatcgaggaggcccagaggagctacatcctgacccagggccccctgcccaacacctgctgccacttctggctgatggtgtggcagcagaagaccaaggctgtggtgatgctgaacagaattgtggagaaggagagcgtgaagtgtgcccagtactggcccacagatgaccaggagatgctgttcaaggagaccggcttctctgtgaagctgctgtctgaagatgtgaagagctactacacagtgcacctgctgcagctggagaacatcaacagcggggagaccaggaccatcagccacttccactacaccacctggccagactttggagtgcctgagagccctgccagcttcctgaacttcctgttcaaggtgcgggagagcggcagcctgaacccagaccacggccctgctgtgatccactgcagcgctggcatcggccgcagcggcaccttcagcctggtggacacctgcctggtgctgatggagaagggagatgacatcaacatcaagcaggtgctgctgaacatgaggaagtacaggatgggcctcatccagaccccagaccagctgcgcttctcctacatggccatcattgaaggagccaagtgcatcaagggggacagcagcatccagaagcgctggaaggagctgagcaaagaagacctgagccctgcctttgaccacagccccaacaagatcatgacagagaagtacaacggcaaccgcatcggcctggaggaggagaagctgaccggggaccgctgcaccggcctgagcagcaagatgcaggacaccatggaggagaacagcgagagcgccctgaggaagaggatccgggaggacaggaaggccaccacagcccagaaggtgcagcagatgaagcagaggctgaatgaaaatgaaaggaagaggaagcgctggctgtactggcagcccatcctgaccaagatgggcttcatgtctgtcatcctggtgggcgcctttgtgggctggaccctcttcttccagcagaatgccctgtag

SEQ ID NO: 166271 - DNA, 1164 bp, Artificial Sequence
  Description of Artificial Sequence: Synthetic coding sequence
atgcccaccaccatcgagcgggagtttgaggagctggacacccagaggcgctggcagcccctgtacctggagatcagaaatgaaagccatgactacccccaccgggtggccaagttcccagaaaatagaaacagaaaccgctacagagatgtgagcccctatgaccacagccgggtgaagctgcagaatgcagaaaatgactacatcaatgccagcctggtggacatcgaggaggcccagaggagctacatcctgacccagggccccctgcccaacacctgctgccacttctggctgatggtgtggcagcagaagaccaaggctgtggtgatgctgaacagaattgtggagaaggagagcgtgaagtgtgcccagtactggcccacagatgaccaggagatgctgttcaaggagaccggcttctctgtgaagctgctgtctgaagatgtgaagagctactacacagtgcacctgctgcagctggagaacatcaacagcggggagaccaggaccatcagccacttccactacaccacctggccagactttggagtgcctgagagccctgccagcttcctgaacttcctgttcaaggtgcgggagagcggcagcctgaacccagaccacggccctgctgtgatccactgcagcgctggcatcggccgcagcggcaccttcagcctggtggacacctgcctggtgctgatggagaagggagatgacatcaacatcaagcaggtgctgctgaacatgaggaagtacaggatgggcctcatccagaccccagaccagctgcgcttctcctacatggccatcattgaaggagccaagtgcatcaagggggacagcagcatccagaagcgctggaaggagctgagcaaagaagacctgagccctgcctttgaccacagccccaacaagatcatgacagagaagtacaacggcaaccgcatcggcctggaggaggagaagctgaccggggaccgctgcaccggcctgagcagcaagatgcaggacaccatggaggagaacagcgagagcgccctgaggaagaggatccgggaggacaggaaggccaccacagcccagaaggtgcagcagatgaagcagaggctgaatgaaaatgaaaggaagaggaagaggccccggctgacagacacctag

SEQ ID NO: 166272 - DNA, 1179 bp, Artificial Sequence
  Description of Artificial Sequence: Synthetic coding sequence
tgccagcaggagttcaggatgtatggcaaggatggcaagggcaccaactggatggaccagggcgacatggagtgcaggatgcaggagattgatgaccacagccgggtgaagctgcagaatgcagaaaatgactacatcaatgccagcctggtggacatcgaggaggcccagaggagctacatcctgacccagggccccctgcccaacacctgctgccacttctggctgatggtgtggcagcagaagaccaaggctgtggtgatgctgaaccgcatcgtggagaaggagagcgtgaagtgtgcccagtactggcccacagatgaccaggagatgctgttcaaggagaccggcttctctgtgaagctgctgtctgaagatgtgaagagctactacacagtgcacctgctgcagctggagaacatcaacagcggggagaccaggaccatcagccacttccactacaccacctggccagactttggagtgcctgagagccctgccagcttcctgaacttcctgttcaaggtgcgggagagcggcagcctgaacccagaccacggccctgctgtgatccactgcagcgctggcatcggccgcagcggcaccttcagcctggtggacacctgcctggtgctgatggagaagggagatgacatcaacatcaagcaggtgctgctgaacatgaggaagtacaggatgggcctcatccagaccccagaccagctgcgcttctcctacatggccatcatcgagggcgccaagtgcatcaagggggacagcagcatccagaagcgctggaaggagctgagcaaggaggacctgagccctgcctttgaccacagccccaacaagatcatgacagagaagtacaatggaaacagaattggcctggaggaggagaagctgactggagaccgctgcaccggcctgagcagcaagatgcaggacaccatggaggagaacagcgagagcgccctgaggaagaggatccgggaggacaggaaggccaccacagcccagaaggtgcagcagatgaagcagaggctgaatgaaaatgaaaggaagaggaagcgctggctgtactggcagcccatcctgaccaagatgggcttcatgtctgtcatcctggtgggcgcctttgtgggctggaccctcttcttccagcagaatgccctgtag

SEQ ID NO: 166273 - DNA, 1062 bp, Artificial Sequence
  Description of Artificial Sequence: Synthetic coding sequence
atgcccaccaccatcgagcgggagtttgaggagctggacacccagaggcgctggcagcccctgtacctggagatcagaaatgaaagccatgactacccccaccgggtggccaagttcccagaaaatagaaacagaaaccgctacagagatgtgagcccctatgaccacagccgggtgaagctgcagaatgcagaaaatgactacatcaatgccagcctggtggacatcgaggaggcccagaggagctacatcctgacccagggccccctgcccaacacctgctgccacttctggctgatggtgtggcagcagaagaccaaggctgtggtgatgctgaacagaattgtggagaaggagagcgtgaagtgtgcccagtactggcccacagatgaccaggagatgctgttcaaggagaccggcttctctgtgaagctgctgtctgaagatgtgaagagctactacacagtgcacctgctgcagctggagaacatcaacagcggggagaccaggaccatcagccacttccactacaccacctggccagactttggagtgcctgagagccctgccagcttcctgaacttcctgttcaaggtgcgggagagcggcagcctgaacccagaccacggccctgctgtgatccactgcagcgctggcatcggccgcagcggcaccttcagcctggtggacacctgcctggtgctgatggagaagggagatgacatcaacatcaagcaggtgctgctgaacatgaggaagtacaggatgggcctcatccagaccccagaccagctgcgcttctcctacatggccatcattgaaggagccaagtgcatcaagggggacagcagcatccagaagcgctggaaggagctgagcaaagaagacctgagccctgcctttgaccacagccccaacaagatcatgacagagaagtacaacggcaaccgcatcggcctggaggaggagaagctgaccggggaccgctgcaccggcctgagcagcaagatgcaggacaccatggaggagaacagcgagcggccccggctgacagacacctag

SEQ ID NO: 166274 - DNA, 2424 bp, Artificial Sequence
  Description of Artificial Sequence: Synthetic coding sequence
atggaccagcgggagatcctgcagaagttcctggatgaggcccagagcaagaagatcaccaaggaggagtttgccaatgagttcctgaagctgaagaggcagagcaccaagtacaaggctgacaagacctaccccaccaccgtggccgagaagcccaagaacatcaagaagaaccgctacaaggacatcctgccctatgactacagccgggtggagctgagcctcatcaccagtgatgaggacagcagctacatcaatgccaacttcatcaagggcgtgtatggccccaaggcctacatcgccacccagggccccctgagcaccaccctgctggacttctggaggatgatctgggagtacagcgtgctgatcatcgtgatggcctgcatggagtatgagatgggcaagaagaagtgtgagcgctactgggccgagcccggggagatgcagctggagtttggccccttctctgtgtcctgtgaggccgagaagaggaagagtgactacatcatccgcaccctgaaggtgaagttcaacagcgagaccaggaccatctaccagttccactacaagaactggccagaccatgatgtgcccagcagcattgaccccatcctggagctgatctgggatgtgcgctgctaccaggaggatgacagcgtgcccatctgcatccactgcagcgctggctgcggccgcactggagtcatctgtgccatcgactacacctggatgctgctgaaggatggcatcatccctgagaacttctctgtgttcagcctcatccgggagatgaggacccagaggcccagcctggtgcagacccaggagcagtatgagctggtgtacaatgctgtgctggagctgttcaagaggcagatggatgtgatccgggacaagcacagcggcacagagagccaggccaagcactgcatccctgagaagaaccacaccctgcaggccgacagctacagccccaacctgcccaagagcaccaccaaggccgccaagatgatgaaccagcagaggaccaagatggagatcaaggagagcagcagctttgacttccgcaccagcgagatcagcgccaaggaggagctggtgctgcacccagccaagagcagcaccagctttgacttcctggagctgaactacagctttgacaagaatgctgacaccaccatgaagtggcagaccaaggccttccccatcgtgggggagcccctgcagaagcaccagagcctggacctgggcagcctgctgtttgagggctgcagcaacagcaagcctgtgaatgctgctggccgctacttcaacagcaaggtgcccatcaccaggaccaagagcaccccatttgagctgatccagcagcgggagaccaaggaggtggacagcaaagaaaacttctcctacctggagagccagccccatgacagctgctttgtggagatgcaggcccagaaggtgatgcacgtgagcagcgctgagctgaactacagcctgccctatgacagcaagcaccagatcagaaatgccagcaatgtgaagcaccacgacagcagcgccctgggcgtgtacagctacatccccctggtggagaacccctacttcagctcctggcccccatctggcaccagcagcaagatgagcctggacctgcctgagaagcaggacggcaccgtcttccccagcagcctgctgcccaccagcagcaccagcctcttctcctactacaacagccatgacagcctgagcctgaacagccccaccaacatcagcagcctgctgaaccaggagagcgctgtgctggccacagcccccagaattgatgatgagatccccccacccctgcctgtgtggaccccagagagcttcatcgtggtggaggaggccggggagttcagccccaacgtgcccaagagcctgagcagcgctgtgaaggtgaagattggcaccagcctggagtggggcggcaccagcgagcccaagaagtttgatgacagcgtcatcctgcggcccagcaagtctgtgaagctgcggagccccaagtctgagctgcaccaggacaggagcagccccccaccacccctgcctgagaggaccctggagagcttcttcctggctgatgaggactgcatgcaggcccagagcattgagacctacagcaccagctacccagacaccatggagaacagcaccagcagcaagcagaccctgaagacccctgggaagagcttcaccaggagcaagagcctgaagatcctgaggaacatgaagaagagcatctgcaacagctgcccccccaacaagccagctgagagcgtgcagagcaacaacagcagcagcttcctgaactttggatttgccaaccgcttcagcaagcccaagggccccagaaatcctccacccacctggaacatctag

SEQ ID NO: 166275 - DNA, 1692 bp, Artificial Sequence
  Description of Artificial Sequence: Synthetic coding sequence
atgctgctgaaggatggcatcatccctgagaacttctctgtgttcagcctcatccgggagatgaggacccagaggcccagcctggtgcagacccaggagcagtatgagctggtgtacaatgctgtgctggagctgttcaagaggcagatggatgtgatccgggacaagcacagcggcacagagagccaggccaagcactgcatccctgagaagaaccacaccctgcaggccgacagctacagccccaacctgcccaagagcaccaccaaggccgccaagatgatgaaccagcagaggaccaagatggagatcaaggagagcagcagctttgacttccgcaccagcgagatcagcgccaaggaggagctggtgctgcacccagccaagagcagcaccagctttgacttcctggagctgaactacagctttgacaagaatgctgacaccaccatgaagtggcagaccaaggccttccccatcgtgggggagcccctgcagaagcaccagagcctggacctgggcagcctgctgtttgagggctgcagcaacagcaagcctgtgaatgctgctggccgctacttcaacagcaaggtgcccatcaccaggaccaagagcaccccatttgagctgatccagcagcgggagaccaaggaggtggacagcaaagaaaacttctcctacctggagagccagccccatgacagctgctttgtggagatgcaggcccagaaggtgatgcacgtgagcagcgctgagctgaactacagcctgccctatgacagcaagcaccagatcagaaatgccagcaatgtgaagcaccacgacagcagcgccctgggcgtgtacagctacatccccctggtggagaacccctacttcagctcctggcccccatctggcaccagcagcaagatgagcctggacctgcctgagaagcaggacggcaccgtcttccccagcagcctgctgcccaccagcagcaccagcctcttctcctactacaacagccatgacagcctgagcctgaacagccccaccaacatcagcagcctgctgaaccaggagagcgctgtgctggccacagcccccagaattgatgatgagatccccccacccctgcctgtgtggaccccagagagcttcatcgtggtggaggaggccggggagttcagccccaacgtgcccaagagcctgagcagcgctgtgaaggtgaagattggcaccagcctggagtggggcggcaccagcgagcccaagaagtttgatgacagcgtcatcctgcggcccagcaagtctgtgaagctgcggagccccaagtctgagctgcaccaggacaggagcagccccccaccacccctgcctgagaggaccctggagagcttcttcctggctgatgaggactgcatgcaggcccagagcattgagacctacagcaccagctacccagacaccatggagaacagcaccagcagcaagcagaccctgaagacccctgggaagagcttcaccaggagcaagagcctgaagatcctgaggaacatgaagaagagcatctgcaacagctgcccccccaacaagccagctgagagcgtgcagagcaacaacagcagcagcttcctgaactttggatttgccaaccgcttcagcaagcccaagggccccagaaatcctccacccacctggaacatctag

SEQ ID NO: 166276 - DNA, 4911 bp, Artificial Sequence
  Description of Artificial Sequence: Synthetic coding sequence
atggaggccgtgcccaggatgcccatgatctggctggacctgaaggaggccggggacttccacttccagcctgctgtgaagaagtttgtgctgaagaactacggggagaaccctgaggcctacaatgaggagctgaagaagctggagctgctgcggcagaatgctgtgcgggtgccccgggactttgagggctgcagcgtgctgaggaagtacctgggccagctgcactacctgcagagccgggtgcccatgggcagcggccaggaggccgctgtgcctgtgacctggacagagatcttcagcggcaagtctgtggcccacgaggacatcaagtatgagcaggcctgcatcctgtacaacctgggcgccctgcacagcatgctgggcgccatggacaagagggtgtctgaggagggcatgaaggtgtcctgcacccacttccagtgtgccgccggggcctttgcctacctgcgggagcacttcccccaggcctacagcgtggacatgagccggcagatcctgaccctgaatgtgaacctgatgctgggccaggcccaggagtgcctgctggagaagtccatgctggacaacaggaagagcttcctggtggcccgcatcagcgcccaggtggtggactactacaaggaggcctgccgggccctggagaacccagacacagccagcctgctgggccgcatccagaaggactggaagaagctggtgcagatgaagatctactactttgctgctgtggcccacctgcacatgggcaagcaggccgaggagcagcagaagtttggagagcgggtggcctacttccagagcgccctggacaagctgaatgaggccatcaagctggccaagggccagcctgacacagtgcaggatgccctgcgcttcaccatggatgtgattggaggcaagtacaacagcgccaagaaggacaatgacttcatctaccatgaagctgtgcctgccctggacaccctgcagcctgtgaagggggcccccctggtgaagcccctgcctgtgaaccccacagatcctgctgtgacaggccctgacatctttgccaagctggtgcccatggccgcccacgaggccagcagcctgtacagcgaggagaaggccaagctgctgcgggagatgatggccaagattgaggacaagaatgaggtgctggaccagttcatggacagcatgcagctggaccctgagaccgtggacaacctggatgcctacagccacatccccccccagctgatggagaagtgtgccgccctgtctgtgcggccagacacagtgaggaacctggtgcagagcatgcaggtgctgagcggggtcttcacagatgtggaggccagcctgaaggacatccgggacctgctggaggaggatgagctgctggagcagaagttccaggaggccgtgggccaggccggggccatcagcatcaccagcaaggccgagctggccgaggtgagaagagagtgggccaagtacatggaggtgcatgagaaggccagcttcaccaacagcgagctgcaccgggccatgaacctgcacgtgggcaacctgcggctgctgagcggccccctggaccaggtgcgggccgccctgcccaccccagccctgagccctgaggacaaggctgtgctgcagaacctgaagaggatcctggccaaggtgcaggagatgagggaccagagggtgtccctggagcagcagctgcgggagctgatccagaaggatgacatcacagccagcctggtgaccacagaccacagcgagatgaagaagctgtttgaggagcagctgaagaagtatgaccagctgaaggtgtacctggagcagaacctggccgcccaggacagagtgctgtgtgccctgacagaggccaacgtgcagtatgctgctgtgagaagagtgctgagtgacctggaccagaagtggaacagcaccctgcagaccctggtggccagctatgaggcctatgaggacctgatgaagaagagccaggagggccgggacttctacgccgacctggagagcaaggtggccgccctgctggagaggacccagagcacctgccaggcccgggaggccgcccggcagcagctgctggaccgggagctgaagaagaagcccccaccccggcccacagcccccaagcccctgctgccccggcgggaggagagcgaggccgtggaggccggggaccccccagaggagctgcggagcctgcccccagacatggtggccggcccccggctgcctgacaccttcctgggcagcgccacccccctgcacttcccccccagccccttccccagcagcacaggccctggcccccactacctgagcggccccctgcccccaggcacctacagcggccccacccagctgatccagccccgggcccctggcccccacgccatgcctgtggcccctggccctgccctgtacccagccccagcctacaccccagagctgggcctggtgcccaggagcagcccccagcacggcgtggtgagcagcccctacgtgggcgtgggccctgcccctcctgtggccggcctgcccagcgcccccccaccccagttcagcggccctgagctggccatggctgtgcggcctgccaccaccaccgtggacagcatccaggcccccatccccagccacacagccccccggcccaaccccaccccagcccctcctccaccctgcttccctgtgcccccaccccagcccctgcccaccccctacacctacccagctggggccaagcagcccatcccagcccagcaccacttcagcagcggcatcccagctggcttccctgcccccagaattggcccccagccccagccccacccccagccccaccccagccaggccttcggcccccagcccccccagcagcccctgcccctgcagcacccccacctgtttcctccccaggcccctggcctgctgcccccccagagcccctacccctatgccccccagcccggggtgctgggccagcccccaccacccctgcacacccagctgtacccaggccctgcccaggaccccctgcctgcccacagcggggccctgcccttccccagccctggccccccccagcccccccacccccccctggcctacggccctgcccccagcacccggcccatgggcccccaggccgcccccctgaccatccggggccccagcagcgctggccagagcacccccagcccccacctggtgcccagccctgcccccagccctggccctggccctgtgccccccaggcctcctgctgctgagcccccaccctgcctgcggagaggagctgctgctgctgacctgctgagcagcagccctgagagccagcacggcggcacccagagccctgggggcggccagcccctgctgcagcccaccaaggtggatgctgctgagggccggcggccccaggccctgcggctcatcgagcgggacccctatgagcaccctgagcggctgcggcagctgcagcaggagctggaggccttccggggccagctgggagatgtgggcgccctggacacagtgtggagggagctgcaggatgcccaggagcatgatgcccggggccgcagcatcgccatcgcccgctgctacagcctgaagaacagacaccaggatgtgatgccctatgacagcaacagagtggtgctgcggagcggcaaggatgactacatcaatgccagctgtgtggagggcctgagcccctactgcccccccctggtggccacccaggcccccctgcctggaacagctgctgacttctggctgatggtgcatgagcagaaggtgtctgtgattgtgatgctggtgtctgaggccgagatggagaagcagaaggtggcccgctacttccccacagagcggggccagcccatggtgcatggagccctgagcctggccctgagctctgtgcgcagcacagagacccacgtggagcgggtgctgagcctgcagttccgggaccagagcctgaagaggagcctggtgcacctgcacttccccacctggccagagctgggcctgcctgacagccccagcaacctgctgcgcttcatccaggaggtgcacgcccactacctgcaccagaggcccctgcacacccccatcatcgtgcactgcagcagcggcgtgggccgcactggagcctttgccctgctgtatgctgctgtgcaggaggtggaggccggaaatggcatccctgagctgccccagctggtgcggaggatgaggcagcagaggaagcacatgctgcaggagaagctgcacctgcgcttctgctatgaggccgtggtgcgccacgtggagcaggtgctgcagagacatggagtgcccccaccctgcaagcccctggccagcgccagcatcagccagaagaaccacctgccccaggacagccaggacctggtgctgggcggagatgtgcccatcagcagcatccaggccaccatcgccaagctgagcatccggcccccaggcggcctggagagccctgtggccagcctgcccggccctgctgagcccccaggcctgcccccagccagcctgcctgagagcacccccatccccagcagcagccccccacccctgagcagccccctgcctgaggccccccagcccaaggaggagccccctgtgcctgaggcccccagcagcggcccccccagcagcagcctggagctgctggccagcctgaccccagaggccttcagcctggacagcagcctgcggggcaagcagaggatgagcaagcacaacttcctgcaggcccacaacggccagggcctgcgggccacccggcccagtgatgaccccctgagcctgctggaccccctgtggaccctgaacaagacctag

SEQ ID NO: 166277 - DNA, 2739 bp, Artificial Sequence
  Description of Artificial Sequence: Synthetic coding sequence
atggaggccgtgcccaggatgcccatgatctggctggacctgaaggaggccggggacttccacttccagcctgctgtgaagaagaatgctgtgcgggtgccccgggactttgagggctgcagcgtgctgaggaagtacctgggccagctgcactacctgcagagccgggtgcccatgggcagcggccaggaggccgctgtgcctgtgacctggacagagatcttcagcggcaagtctgtggcccacgaggacatcaagtatgagcaggcctgcatcctgtacaacctgggcgccctgcacagcatgctgggcgccatggacaagagggtgtctgaagaatgtgccgccggggcctttgcctacctgcgggagcacttcccccaggcctacagcgtggacatgagccggcagatcctgaccctgaatgtgaacctgatgctgggccaggcccaggagtgcctgctggagaagtccatgctggacaacaggaagagcttcctggtggcccgcatcagcgcccaggtggtggactactacaaggaggcctgccgggccctggagaacccagacacagccagcctgctgggccgcatccagaaggactggaagaagctggtgcagatgaagatctactactttgctgctgtggcccacctgcacatgggcaagcaggccgaggagcagcagaagtttggagagcgggtggcctacttccagagcgccctggacaagctgaatgaggccatcaagctggccaagggccagcctgacacagtgcaggatgccctgcgcttcaccatggatgtgattggaggcaagtacaacagcgccaagaaggacaatgacttcatctaccacgaggccgtgcctgccctggacaccctgcagcctgtgaagggggcccccctggtgaagcccctgcctgtgaaccccacagatcctgctgtgactggaccagacatctttgccaagctggtgcccatggccgcccacgaggccagcagcctgtacagcgaggagaaggccaagctgctgcgggagatgatggccaagattgaggacaagaatgaggtgctggaccagttcatggacagcatgcagctggaccctgagaccgtggacaacctggatgcctacagccacatccccccccagctgatggagaagtgtgccgccctgtctgtgcggccagacacagtgaggaacctggtgcagagcatgcaggtgctgtctggagtcttcacagatgtggaggccagcctgaaggacatccgggacctgctggaggaggatgagctgctggagcagaagttccaggaggccgtgggccaggccggggccatcagcatcaccagcaaggccgagctggccgaggtgcggcgggagtgggccaagtacatggaggtgcatgagaaggccagcttcaccaacagcgagctgcaccgggccatgaacctgcacgtgggcaacctgcggctgctgagcggccccctggaccaggtgcgggccgccctgcccaccccagccctgagccctgaggacaaggctgtgctgcagaacctgaagaggatcctggccaaggtgcaggagatgagggaccagagggtgtccctggagcagcagctgcgggagctgatccagaaggatgacatcacagccagcctggtgaccacagaccacagcgagatgaagaagctgtttgaggagcagctgaagaagtatgaccagctgaaggtgtacctggagcagaacctggccgcccaggacagagtgctgtgtgccctgacagaggccaacgtgcagtatgctgctgtgcggcgggtgctgagtgacctggaccagaagtggaacagcaccctgcagaccctggtggccagctatgaggcctatgaggacctgatgaagaagagccaggagggccgggacttctatgctgacctggagagcaaggtggccgccctgctggagaggacccagagcacctgccaggcccgggaggccgcccggcagcagctgctggaccgggagctgaagaagaagcccccaccccggcccacagcccccaagcccctgctgccccggcgggaggagagcgaggccgtggaggccggggaccccccagaggagctgcggagcctgcccccagacatggtggccggcccccggctgcctgacaccttcctgggcagcgccacccccctgcacttcccccccagccccttccccagcagcactggacctggcccccactacctgagcggccccctgcccccaggcacctacagcggccccacccagctgatccagccccgggcccctggcccccacgccatgcctgtggcccctggccctgccctgtacccagcccccagcagcgcccccagcttcacctctgtgtgggccagcgcccccacagctgcccccagcaccccagccagcaccagcctgcccaccccaggccccaggacccccacccccaccatccccctgcccctgtgccccagcgcctggggccctggagctgctgccaccccacccacccacccagccctgcccaggagccgcagccggcccagcgccagccccctgcggggcagcgccttcccccagccctgggcccccagcgccagccccagccccaccggcatctggagctgccccttctaccagacccacggccccccaggcagccccagctaccacagccgggccctggtgtgctggcctgtgcacccctag

SEQ ID NO: 166278 - DNA, 1698 bp, Artificial Sequence
  Description of Artificial Sequence: Synthetic coding sequence
atgaactatgaaggagcccggagtgaaagagaaaatcatgctgctgatgacagcgagggcggggccctggacatgtgctgcagcgagcggctgcccggcctgccccagcccatcgtgatggaggccctggatgaggccgagggcctgcaggacagccagcgggagatgcctcctcctcctccacccagcccccccagcgaccctgcccagaagcccccaccaagaggagctggcagccacagcctgactgtgcgcagcagcctgtgcctgtttgctgccagccagttcctgctggcctgtggggtgctgtggttcagcggctacggccacatctggagccagaatgccaccaacctggtgagcagcctgctgaccctgctgaagcagctggagcccacagcctggctggacagcggcacctggggcgtgcccagcctgctgctggtgttcctgtctgtgggcctggtgctggtgaccaccctggtgtggcacctgctgcggaccccacctgagccccccacccccctgcccccagaagatcggcggcagagcgtgtcccggcagcccagcttcacctacagcgagtggatggaggagaagattgaagatgacttcctggacctggaccctgtgcctgagacccctgtgtttgactgtgtgatggacatcaagccagaggccgaccccaccagcctgactgtgaagtccatgggcctgcaggagcggcggggcagcaatgtgtccctgaccctggacatgtgcaccccaggctgcaatgaggagggcttcggctacctgatgagcccccgggaggagagcgcccgggagtacctgctgagcgccagccgggtgctgcaggccgaggagctgcacgagaaggccctggaccccttcctgctgcaggccgagttctttgagatccccatgaactttgtggaccccaaggagtatgacatccctggcctggtgaggaagaaccgctacaagaccatcctgcccaacccccacagccgggtgtgcctgaccagcccagaccctgatgaccccctgagcagctacatcaatgccaactacatccggggctacggcggggaggagaaggtgtacatcgccacccagggccccatcgtgtccacagtggccgacttctggaggatggtgtggcaggagcacacccccatcatcgtgatgatcaccaacatcgaggagatgaatgaaaaatgtacagagtactggccagaggagcaggtggcctatgatggagtggagatcaccgtgcagaaggtgatccacacagaggactaccgcctgcggctcatcagcctgaagagcggcacagaggagcggggcctgaagcactactggttcacctcctggccagaccagaagaccccagaccgggccccacccctgctgcacctggtgcgggaggtggaggaggccgcccagcaggagggcccccactgtgcccccatcatcgtgcactgcagcgctggcatcggccgcacaggctgcttcatcgccaccagcatctgctgccagcagctgcggcaggagggcgtggtggacatcctgaagaccacctgccagctgcggcaggaccggggcggcatgatccagacctgtgagcagtaccagtttgtgcaccacgtgatgagcctgtatgagaagcagctgagccaccagagccctgagtag

SEQ ID NO: 166279 - DNA, 1602 bp, Artificial Sequence
  Description of Artificial Sequence: Synthetic coding sequence
atgaactatgaaggagcccggagtgaaagagaaaatcatgctgctgatgacagcgagggcggggccctggacatgtgctgcagcgagcggctgcccggcctgccccagcccatcgtgatggaggccctggatgaggccgagggcctgcaggacagccagcgggagatgcctcctcctcctccacccagcccccccagcgaccctgcccagaagcccccaccaagaggagctggcagccacagcctgactgtgcgcagcagcctgtgcctgtttgctgccagccagttcctgctggagcccacagcctggctggacagcggcacctggggcgtgcccagcctgctgctggtgttcctgtctgtgggcctggtgctggtgaccaccctggtgtggcacctgctgcggaccccacctgagccccccacccccctgcccccagaagatcggcggcagagcgtgtcccggcagcccagcttcacctacagcgagtggatggaggagaagattgaagatgacttcctggacctggaccctgtgcctgagacccctgtgtttgactgtgtgatggacatcaagccagaggccgaccccaccagcctgactgtgaagtccatgggcctgcaggagcggcggggcagcaatgtgtccctgaccctggacatgtgcaccccaggctgcaatgaggagggcttcggctacctgatgagcccccgggaggagagcgcccgggagtacctgctgagcgccagccgggtgctgcaggccgaggagctgcacgagaaggccctggaccccttcctgctgcaggccgagttctttgagatccccatgaactttgtggaccccaaggagtatgacatccctggcctggtgaggaagaaccgctacaagaccatcctgcccaacccccacagccgggtgtgcctgaccagcccagaccctgatgaccccctgagcagctacatcaatgccaactacatccggggctacggcggggaggagaaggtgtacatcgccacccagggccccatcgtgtccacagtggccgacttctggaggatggtgtggcaggagcacacccccatcatcgtgatgatcaccaacatcgaggagatgaatgaaaaatgtacagagtactggccagaggagcaggtggcctatgatggagtggagatcaccgtgcagaaggtgatccacacagaggactaccgcctgcggctcatcagcctgaagagcggcacagaggagcggggcctgaagcactactggttcacctcctggccagaccagaagaccccagaccgggccccacccctgctgcacctggtgcgggaggtggaggaggccgcccagcaggagggcccccactgtgcccccatcatcgtgcactgcagcgctggcatcggccgcacaggctgcttcatcgccaccagcatctgctgccagcagctgcggcaggagggcgtggtggacatcctgaagaccacctgccagctgcggcaggaccggggcggcatgatccagacctgtgagcagtaccagtttgtgcaccacgtgatgagcctgtatgagaagcagctgagccaccagagccctgagtag

SEQ ID NO: 166280 - DNA, 1698 bp, Artificial Sequence; identical to SEQ ID NO: 166278
  Description of Artificial Sequence: Synthetic coding sequence

SEQ ID NO: 166281 - DNA, 1788 bp, Artificial Sequence
  Description of Artificial Sequence: Synthetic coding sequence
atggtgcgctggttccaccgggacctgagcggcctggatgctgagaccctgctgaagggccggggcgtgcacggcagcttcctggcccggcccagcaggaagaaccagggcgacttcagcctgtctgtgcgggtgggggaccaggtgacccacatccgcatccagaacagcggggacttctatgacctgtatggaggagagaagtttgccaccctgacagagctggtggagtactacacccagcagcagggcgtgctgcaggacagagatggcaccatcatccacctgaagtaccccctgaactgcagcgaccccaccagcgagcgctggtaccacggccacatgtctgggggccaggccgagaccctgctgcaggccaagggggagccctggaccttcctggtgcgggagagcctgagccagcccggggactttgtgctgtctgtgctgagtgaccagcccaaggccggccctggcagccccctgcgggtgacccacatcaaggtgatgtgtgagggcggccgctacacagtgggcggcctggagacctttgacagcctgacagacctggtggagcacttcaagaagacaggaattgaggaggccagcggggcctttgtgtacctgcggcagccctactatgccaccagggtgaatgctgctgacatcgagaacagagtgctggagctgaacaagaagcaggagagcgaggacacagccaaggccggcttctgggaggagtttgagagcctgcagaagcaggaggtgaagaacctgcaccagaggctggagggccagaggccagaaaataaaggcaagaaccgctacaagaacatcctgccctttgaccacagcagggtcatcctgcagggccgggacagcaacatccctggcagtgactacatcaatgccaactacatcaagaaccagctgctgggcccagatgaaaatgccaagacctacatcgccagccagggctgcctggaggccaccgtgaatgacttctggcagatggcctggcaggagaacagccgggtgattgtgatgaccacccgggaggtggagaagggcaggaacaagtgtgtgccctactggccagaggtgggcatgcagagggcctacggcccctacagcgtgaccaactgtggggagcatgacaccacagagtacaagctgcggaccctgcaggtgagccccctggacaacggggacctgatccgggagatctggcactaccagtacctgtcctggccagaccacggcgtgcccagcgagcccggcggcgtgctgtccttcctggaccagatcaaccagaggcaggagagcctgccccacgccggccccatcatcgtgcactgcagcgctggcattggaagaacaggcaccatcatcgtcatcgacatgctgatggagaacatcagcaccaagggcctggactgtgacatcgacatccagaagaccatccagatggtgcgggcccagaggagcggcatggtgcagacagaggcccagtacaagttcatctacgtggccatcgcccagttcatcgagaccaccaagaagaagctggaggtgctgcagagccagaagggccaggagagtgaatatggcaacatcacctaccccccagccatgaagaatgcccacgccaaggccagcaggaccagcagcaagcacaaggaggatgtgtatgagaacctgcacaccaagaacaagcgggaggagaaggtgaagaagcagaggtctgctgacaaggagaagagcaagggcagcctgaagaggaagtag

SEQ ID NO: 166282 - DNA, 1794 bp, Artificial Sequence
  Description of Artificial Sequence: Synthetic coding sequence
atgctgagccggggctggttccaccgggacctgagcggcctggatgctgagaccctgctgaagggccggggcgtgcacggcagcttcctggcccggcccagcaggaagaaccagggcgacttcagcctgtctgtgcgggtgggggaccaggtgacccacatccgcatccagaacagcggggacttctatgacctgtatggaggagagaagtttgccaccctgacagagctggtggagtactacacccagcagcagggcgtgctgcaggacagagatggcaccatcatccacctgaagtaccccctgaactgcagcgaccccaccagcgagcgctggtaccacggccacatgtctgggggccaggccgagaccctgctgcaggccaagggggagccctggaccttcctggtgcgggagagcctgagccagcccggggactttgtgctgtctgtgctgagtgaccagcccaaggccggccctggcagccccctgcgggtgacccacatcaaggtgatgtgtgagggcggccgctacacagtgggcggcctggagacctttgacagcctgacagacctggtggagcacttcaagaagacaggaattgaggaggccagcggggcctttgtgtacctgcggcagccctactatgccaccagggtgaatgctgctgacatcgagaacagagtgctggagctgaacaagaagcaggagagcgaggacacagccaaggccggcttctgggaggagtttgagagcctgcagaagcaggaggtgaagaacctgcaccagaggctggagggccagaggccagaaaataaaggcaagaaccgctacaagaacatcctgccctttgaccacagcagggtcatcctgcagggccgggacagcaacatccctggcagtgactacatcaatgccaactacatcaagaaccagctgctgggcccagatgaaaatgccaagacctacatcgccagccagggctgcctggaggccaccgtgaatgacttctggcagatggcctggcaggagaacagccgggtgattgtgatgaccacccgggaggtggagaagggcaggaacaagtgtgtgccctactggccagaggtgggcatgcagagggcctacggcccctacagcgtgaccaactgtggggagcatgacaccacagagtacaagctgcggaccctgcaggtgagccccctggacaacggggacctgatccgggagatctggcactaccagtacctgtcctggccagaccacggcgtgcccagcgagcccggcggcgtgctgtccttcctggaccagatcaaccagaggcaggagagcctgccccacgccggccccatcatcgtgcactgcagcgctggcattggaagaacaggcaccatcatcgtcatcgacatgctgatggagaacatcagcaccaagggcctggactgtgacatcgacatccagaagaccatccagatggtgcgggcccagaggagcggcatggtgcagacagaggcccagtacaagttcatctacgtggccatcgcccagttcatcgagaccaccaagaagaagctggaggtgctgcagagccagaagggccaggagagtgaatatggcaacatcacctaccccccagccatgaagaatgcccacgccaaggccagcaggaccagcagcaagcacaaggaggatgtgtatgagaacctgcacaccaagaacaagcgggaggagaaggtgaagaagcagaggtctgctgacaaggagaagagcaagggcagcctgaagaggaagtag

SEQ ID NO: 166283 - DNA, 1671 bp, Artificial Sequence
  Description of Artificial Sequence: Synthetic coding sequence
atgctgagcagaggagtgggggaccaggtgacccacatccgcatccagaacagcggggacttctatgacctgtatggaggagagaagtttgccaccctgacagagctggtggagtactacacccagcagcagggcgtgctgcaggacagagatggcaccatcatccacctgaagtaccccctgaactgcagcgaccccaccagcgagcgctggtaccacggccacatgtctgggggccaggccgagaccctgctgcaggccaagggggagccctggaccttcctggtgcgggagagcctgagccagcccggggactttgtgctgtctgtgctgagtgaccagcccaaggccggccctggcagccccctgcgggtgacccacatcaaggtgatgtgtgagggcggccgctacacagtgggcggcctggagacctttgacagcctgacagacctggtggagcacttcaagaagacaggcatcgaggaggccagcggggcctttgtgtacctgcggcagccctactatgccaccagggtgaatgctgctgacattgaaaatagagtgctggagctgaacaagaagcaggagagcgaggacacagccaaggccggcttctgggaggagtttgagagcctgcagaagcaggaggtgaagaacctgcaccagaggctggagggccagaggcctgagaacaagggcaagaaccgctacaagaacatcctgccctttgaccacagcagggtcatcctgcagggccgggacagcaacatccctggcagtgactacatcaatgccaactacatcaagaaccagctgctgggcccagatgaaaatgccaagacctacatcgccagccagggctgcctggaggccaccgtgaatgacttctggcagatggcctggcaggagaacagcagggtcatcgtgatgaccacccgggaggtggagaagggcagaaataaatgtgtgccctactggccagaggtgggcatgcagagggcctacggcccctacagcgtgaccaactgtggggagcatgacaccacagagtacaagctgcggaccctgcaggtgagccccctggacaatggagacctgatccgggagatctggcactaccagtacctgtcctggccagaccatggagtgcccagcgagcctggaggagtgctgtccttcctggaccagatcaaccagaggcaggagagcctgccccatgctggccccatcatcgtgcactgcagcgctggcatcggccgcacaggcaccatcatcgtgattgacatgctgatggagaacatcagcaccaagggcctggactgtgacatcgacatccagaagaccatccagatggtgcgggcccagaggagcggcatggtgcagacagaggcccagtacaagttcatctacgtggccatcgcccagttcatcgagaccaccaagaagaagctggaggtgctgcagagccagaagggccaggagagtgaatatggcaacatcacctaccccccagccatgaagaatgcccacgccaaggccagcaggaccagcagcaagcacaaggaggatgtgtatgagaacctgcacaccaagaacaagcgggaggagaaggtgaagaagcagaggtctgctgacaaggagaagagcaagggcagcctgaagaggaagtag

SEQ ID NO: 166284 - DNA, 1875 bp, Artificial Sequence
  Description of Artificial Sequence: Synthetic coding sequence
atggtgcgctggttccaccgggacctgagcggcctggatgctgagaccctgctgaagggccggggcgtgcacggcagcttcctggcccggcccagcaggaagaaccagggcgacttcagcctgtctgtgcgggtgggggaccaggtgacccacatccgcatccagaacagcggggacttctatgacctgtatggaggagagaagtttgccaccctgacagagctggtggagtactacacccagcagcagggcgtgctgcaggacagagatggcaccatcatccacctgaagtaccccctgaactgcagcgaccccaccagcgagcgctggtaccacggccacatgtctgggggccaggccgagaccctgctgcaggccaagggggagccctggaccttcctggtgcgggagagcctgagccagcccggggactttgtgctgtctgtgctgagtgaccagcccaaggccggccctggcagccccctgcgggtgacccacatcaaggtgatgtgtgagggcggccgctacacagtgggcggcctggagacctttgacagcctgacagacctggtggagcacttcaagaagacaggaattgaggaggccagcggggcctttgtgtacctgcggcagccctactatgccaccagggtgaatgctgctgacatcgagaacagagtgctggagctgaacaagaagcaggagagcgaggacacagccaaggccggcttctgggaggagtttgagagcctgcagaagcaggaggtgaagaacctgcaccagaggctggagggccagaggccagaaaataaaggcaagaaccgctacaagaacatcctgccctttgaccacagcagggtcatcctgcagggccgggacagcaacatccctggcagtgactacatcaatgccaactacatcaagaaccagctgctgggcccagatgaaaatgccaagacctacatcgccagccagggctgcctggaggccaccgtgaatgacttctggcagatggcctggcaggagaacagccgggtgattgtgatgaccacccgggaggtggagaagggcaggaacaagtgtgtgccctactggccagaggtgggcatgcagagggcctacggcccctacagcgtgaccaactgtggggagcatgacaccacagagtacaagctgcggaccctgcaggtgagccccctggacaacggggacctgatccgggagatctggcactaccagtacctgtcctggccagaccacggcgtgcccagcgagcccggcggcgtgctgtccttcctggaccagatcaaccagaggcaggagagcctgccccacgccggccccatcatcgtgcactgcagcgctggcattggaagaacaggcaccatcatcgtcatcgacatgctgatggagaacatcagcaccaagggcctggactgtgacatcgacatccagaagaccatccagatggtgcgggcccagaggagcggcatggtgcagacagaggcccagtacaagttcatctacgtggccatcgcccagttcatcgagaccaccaagaagaagctggaggtgctgcagagccagaagggccaggagagtgaatatggcaacatcacctaccccccagccatgaagaatgcccacgccaaggccagcaggaccagcagcaagagcctggagagcagcgctggcaccgtggccgccagccctgtgagaagaggaggccagaggggcctgcctgtgcccggcccccctgtgctgagcccagacctgcaccagctgcctgtgctggcccccctgcaccctgctgctgacaccaggaggatgtgcatgaggacctgcaccctgcggacccggggccgcaggaagtag

SEQ ID NO: 166285 - DNA, 1083 bp, Artificial Sequence
  Description of Artificial Sequence: Synthetic coding sequence
atggtgcaggcccatggaggccgcagccgggcccagcccctgaccctgagcctgggcgccgccatgacccagcccccacctgagaagaccccagccaagaagcacgtgcggctgcaggagcggcggggcagcaatgtggccctgatgctggatgtgcgcagcctgggcgctgtggagcccatctgcagcgtgaacaccccccgggaggtgaccctgcacttcctgaggacagctggccaccccctgacccgctgggccctgcagaggcagccccccagccccaagcagctggaggaggagttcctgaagatccccagcaactttgtgtccccagaggacctggacatccctggccacgccagcaaggaccgctacaagaccatcctgcccaacccccagagccgggtgtgcctgggccgggcccagagccaggaggatggagactacatcaatgccaactacatccggggctatgatggcaaggagaaggtgtacatcgccacccagggccccatgcccaacacagtgtctgacttctgggagatggtgtggcaggaggaggtgtccctgattgtgatgctgacccagctgcgggagggcaaggagaagtgtgtgcactactggcccacagaggaggagacctacggccccttccagatccgcatccaggacatgaaggaatgtcctgagtacacagtgcggcagctgaccatccagtaccaggaggagcggcgctctgtgaagcacatcctcttcagcgcctggccagaccaccagaccccagagagcgctggccccctgctgcggctggtggccgaggtggaggagagccctgagacagctgcccaccctggccccatcgtggtgcactgcagcgctggcattggaagaacaggctgcttcatcgccacccgcatcggctgccagcagctgaaggcccggggggaggtggacatcctgggcatcgtgtgccagctgcggctggacagaggaggcatgatccagacagctgagcagtaccagttcctgcaccacaccctggccctgtatgccggccagctgcctgaggagcccagcccctag

SEQ ID NO: 166286 - DNA, 1398 bp, Artificial Sequence
  Description of Artificial Sequence: Synthetic coding sequence
atggtgggcaaggcctggcccctgacccacagccagggcaccggcccctgggcccctgagggccacagaagagaggccgctgacccctggtggcagaggcagcaggcccaggagggccgcatgcagctgggctgtgcctgggtggccgccaggagaggaggcggcaggaagctggcctcctggagcctgctgagcccccagaggcagacagaccggcagacagacagctggcaggaggccgcctggggcccccagctgctgcagcagacctcctggctgtctgagccccccctgggccctgccccccacctgtccatggtgcaggcccacggcggccgcagccgggcccagcccctgaccctgagcctgggcgccgccatgacccagcccccacctgagaagaccccagccaagaagcacgtgcggctgcaggagcggcggggcagcaatgtggccctgatgctggatgtgcgcagcctgggcgctgtggagcccatctgcagcgtgaacaccccccgggaggtgaccctgcacttcctgaggacagctggccaccccctgacccgctgggccctgcagaggcagccccccagccccaagcagctggaggaggagttcctgaagatccccagcaactttgtgtccccagaggacctggacatccctggccacgccagcaaggaccgctacaagaccatcctgcccaacccccagagccgggtgtgcctgggccgggcccagagccaggaggatggagactacatcaatgccaactacatccggggctatgatggcaaggagaaggtgtacatcgccacccagggccccatgcccaacacagtgtctgacttctgggagatggtgtggcaggaggaggtgtccctcatcgtgatgctgacccagctgcgggagggcaaggagaagtgtgtgcactactggcccacagaggaggagacctacggccccttccagatccgcatccaggacatgaaggagtgcccagagtacacagtgcggcagctgaccatccagtaccaggaggagaggagatctgtgaagcacatcctcttcagcgcctggccagaccaccagaccccagagagcgctggccccctgctgcggctggtggccgaggtggaggagagccctgagacagctgcccaccctggccccatcgtggtgcactgcagcgctggcatcggccgcacaggctgcttcatcgccaccagaattggctgccagcagctgaaggcccggggggaggtggacatcctgggcatcgtgtgccagctgcggctggaccggggcggcatgatccagacagctgagcagtaccagttcctgcaccacaccctggccctgtatgccggccagctgcctgaggagcccagcccctag

SEQ ID NO: 166287 - DNA, 1200 bp, Artificial Sequence
  Description of Artificial Sequence: Synthetic coding sequence
atgggcgccagcttctggcccatccggcaggcccgggagcagcagaggcgggccctgtccttccggcagacctcctggctgtctgagccccccctgggccctgccccccacctgtccatggtgcaggcccacggcggccgcagccgggcccagcccctgaccctgagcctgggcgccgccatgacccagcccccacctgagaagaccccagccaagaagcacgtgcggctgcaggagcggcggggcagcaatgtggccctgatgctggatgtgcgcagcctgggcgctgtggagcccatctgcagcgtgaacaccccccgggaggtgaccctgcacttcctgaggacagctggccaccccctgacccgctgggccctgcagaggcagccccccagccccaagcagctggaggaggagttcctgaagatccccagcaactttgtgtccccagaggacctggacatccctggccacgccagcaaggaccgctacaagaccatcctgcccaacccccagagccgggtgtgcctgggccgggcccagagccaggaggatggagactacatcaatgccaactacatccggggctatgatggcaaggagaaggtgtacatcgccacccagggccccatgcccaacacagtgtctgacttctgggagatggtgtggcaggaggaggtgtccctcatcgtgatgctgacccagctgcgggagggcaaggagaagtgtgtgcactactggcccacagaggaggagacctacggccccttccagatccgcatccaggacatgaaggagtgcccagagtacacagtgcggcagctgaccatccagtaccaggaggagaggagatctgtgaagcacatcctcttcagcgcctggccagaccaccagaccccagagagcgctggccccctgctgcggctggtggccgaggtggaggagagccctgagacagctgcccaccctggccccatcgtggtgcactgcagcgctggcatcggccgcacaggctgcttcatcgccaccagaattggctgccagcagctgaaggcccggggggaggtggacatcctgggcatcgtgtgccagctgcggctggaccggggcggcatgatccagacagctgagcagtaccagttcctgcaccacaccctggccctgtatgccggccagctgcctgaggagcccagcccctag

SEQ ID NO: 166288 - DNA, 465 bp, Artificial Sequence
  Description of Artificial Sequence: Synthetic coding sequence
atggtgcaggcccatggaggccgcagccgggcccagcccctgaccctgagcctgggcgccgccatgacccagcccccacctgagaagaccccagccaagaagcacgtgcggctgcaggagcggcggggcagcaatgtggccctgatgctggatgtgcgcagcctgggcgctgtggagcccatctgcagcgtgaacaccccccgggaggtgaccctgcacttcctgaggacagctggccaccccctgacccgctgggccctgcagaggcagccccccagccccaagcagctggaggaggagttcctgaagatccccagcaactttgtgtccccagaggacctggacatccctggccacgccagcaaggaccgctacaagaccatcctgcccaacccccagagccgggtgtgcctgggccgggcccagagccaggaggatggagactacatcaatgccaactactag

SEQ ID NO: 166289 - DNA, 1326 bp, Artificial Sequence
  Description of Artificial Sequence: Synthetic coding sequence
aagagaagaagagctgcctccatgaaccggctgggctgctggccagcccggagcctgcccaggagcggccggggcagcggccagaggagcctgggcctgggcggccaccccagcggccccaggcaccctggcaccccagctgccaagaggacctgggagagccctggggtgcgggcccgggactgccccctgagcacctcctggctgtctgagccccccctgggccctgccccccacctgtccatggtgcaggcccacggcggccgcagccgggcccagcccctgaccctgagcctgggcgccgccatgacccagcccccacctgagaagaccccagccaagaagcacgtgcggctgcaggagcggcggggcagcaatgtggccctgatgctggatgtgcgcagcctgggcgctgtggagcccatctgcagcgtgaacaccccccgggaggtgaccctgcacttcctgaggacagctggccaccccctgacccgctgggccctgcagaggcagccccccagccccaagcagctggaggaggagttcctgaagatccccagcaactttgtgtccccagaggacctggacatccctggccacgccagcaaggaccgctacaagaccatcctgcccaacccccagagccgggtgtgcctgggccgggcccagagccaggaggatggagactacatcaatgccaactacatccggggctatgatggcaaggagaaggtgtacatcgccacccagggccccatgcccaacacagtgtctgacttctgggagatggtgtggcaggaggaggtgtccctcatcgtgatgctgacccagctgcgggagggcaaggagaagtgtgtgcactactggcccacagaggaggagacctacggccccttccagatccgcatccaggacatgaaggagtgcccagagtacacagtgcggcagctgaccatccagtaccaggaggagaggagatctgtgaagcacatcctcttcagcgcctggccagaccaccagaccccagagagcgctggccccctgctgcggctggtggccgaggtggaggagagccctgagacagctgcccaccctggccccatcgtggtgcactgcagcgctggcatcggccgcacaggctgcttcatcgccaccagaattggctgccagcagctgaaggcccggggggaggtggacatcctgggcatcgtgtgccagctgcggctggaccggggcggcatgatccagacagctgagcagtaccagttcctgcaccacaccctggccctgtatgccggccagctgcctgaggagcccagcccctag

SEQ ID NO: 166290 - DNA, 423 bp, Artificial Sequence
  Description of Artificial Sequence: Synthetic coding sequence
atggtgcaggcccatggaggccgcagccgggcccagcccctgaccctgagcctgggcgccgccatgacccagcccccacctgagaagaccccagccaagaagcacgtgcggctgcaggagcggcggggcagcaatgtggccctgatgctggatgtgcgcagcctgggcgctgtggagcccatctgcagcgtgaacaccccccgggaggtgaccctgcacttcctgaggacagctggccaccccctgacccgctgggccctgcagaggcagccccccagccccaagcagctggaggaggagttcctgaagatccccagcaactttgtgtccccagaggacctggacatccctggccacgccagcaaggaccgctacaagaccatcctgcccaacccccagagccgggtgtgcctgggccgctag

SEQ ID NO: 166291 - DNA, 1083 bp, Artificial Sequence; identical to SEQ ID NO: 166285
  Description of Artificial Sequence: Synthetic coding sequence

SEQ ID NO: 166292 - DNA, 570 bp, Artificial Sequence
  Description of Artificial Sequence: Synthetic coding sequence
atgcccaacacagtgtctgacttctgggagatggtgtggcaggaggaggtgtccctcatcgtgatgctgacccagctgcgggagggcaaggagaagtgtgtgcactactggcccacagaggaggagacctacggccccttccagatccgcatccaggacatgaaggagtgcccagagtacacagtgcggcagctgaccatccagtaccaggaggagaggagatctgtgaagcacatcctcttcagcgcctggccagaccaccagaccccagagagcgctggccccctgctgcggctggtggccgaggtggaggagagccctgagacagctgcccaccctggccccatcgtggtgcactgcagcgctggcatcggccgcacaggctgcttcatcgccaccagaattggctgccagcagctgaaggcccggggggaggtggacatcctgggcatcgtgtgccagctgcggctggaccggggcggcatgatccagacagctgagcagtaccagttcctgcaccacaccctggccctgtatgccggccagctgcctgaggagcccagcccctag

SEQ ID NO: 166293 - DNA, 411 bp, Artificial Sequence
  Description of Artificial Sequence: Synthetic coding sequence
atgaaggaatgtcctgagtacacagtgcggcagctgaccatccagtaccaggaggagcggcgctctgtgaagcacatcctcttcagcgcctggccagaccaccagaccccagagagcgctggccccctgctgcggctggtggccgaggtggaggagagccctgagacagctgcccaccctggccccatcgtggtgcactgcagcgctggcattggaagaacaggctgcttcatcgccacccgcatcggctgccagcagctgaaggcccggggggaggtggacatcctgggcatcgtgtgccagctgcggctggacagaggaggcatgatccagacagctgagcagtaccagttcctgcaccacaccctggccctgtatgccggccagctgcctgaggagcccagcccctag

SEQ ID NO: 166294 - DNA, 1545 bp, Artificial Sequence
  Description of Artificial Sequence: Synthetic coding sequence
atgagcagccccatcagcaagagccgcagcctggccgccttcctgcagcagctgcggagcccccggcagcccccccggctggtgaccagcacagcctacaccagcccccagccccgggaggtgcctgtgtgccccctgacagctggaggagagacccagaatgctgctgccctgcccggccccacctcctggcccctgctgggcagcctgctgcagatcctgtggaagggcggcctgaagaagcagcacgacaccctggtggagtaccacaagaagtatggcaagatcttcaggatgaagctgggcagctttgagagcgtgcacctgggcagcccctgcctgctggaggccctgtacagaacagaaagtgcctacccccagaggctggagatcaagccctggaaggcctacagagactacaggaaggagggctacggcctgctgatcctggagggggaggactggcagagggtgcgcagcgccttccagaagaagctgatgaagccaggagaggtgatgaagctggacaacaagatcaatgaggtgctggccgacttcatgggcagaattgatgagctgtgtgatgagcggggccacgtggaggacctgtacagcgagctgaacaagtggagctttgagagcatctgcctggtgctgtatgagaagcgcttcggcctgctgcagaagaatgctggagatgaagctgtgaacttcatcatggccatcaagaccatgatgagcacctttggaaggatgatggtgacccctgtggagctgcacaagagcctgaacaccaaggtgtggcaggaccacaccctggcctgggacaccatcttcaagtctgtgaaggcctgcatcgacaaccggctggagaagtacagccagcagcccagcgctgacttcctgtgtgacatctaccaccagaaccggctgagcaagaaggagctgtatgctgctgtgacagagctgcagctggccgctgtggagaccacagccaacagcctgatgtggatcctgtacaacctgagcaggaacccccaggtgcagcagaagctgctgaaggagatccagagcgtgctgcctgagaaccaggtgcccagggctgaggacctgaggaacatgccctacctgaaggcctgcctgaaggagagcatgaggctgacccccagcgtgcccttcaccaccaggaccctggacaaggccaccgtgctgggggagtatgccctgcccaagggcaccgtgctgatgctgaacacccaggtgctgggcagcagcgaggacaactttgaggacagcagccagttccggcctgagcgctggctgcaggagaaggagaagatcaacccctttgcccacctgccctttggagtgggcaagaggatgtgcattggaagaaggctggccgagctgcagctgcacctggccctgtgctggatcgtgaggaaatatgacatccaggccacagacaatgaacctgtggagatgctgcacagcggcaccctggtgcccagccgggagctgcccatcgccttctgccagaggtag

SEQ ID NO: 166295 - DNA, 2382 bp, Artificial Sequence
  Description of Artificial Sequence: Synthetic coding sequence
atggacagctggttcatcctggtgctgctgggcagcggcctcatctgtgtgtctgccaacaatgccaccaccgtggcccccagcgtgggcatcaccaggctcatcaacagcagcacagctgagcctgtgaaggaggaggccaagaccagcaaccccaccagcagcctgaccagcctgtctgtggcccccaccttcagccccaacatcaccctgggccccacctacctgaccaccgtgaacagcagtgacagcgacaatggcaccaccaggacagccagcaccaacagcatcggcatcaccatcagccccaacggcacctggctgcctgacaaccagttcacagatgccaggacagagccctgggagggcaacagcagcacagctgccaccaccccagagaccttccccccatctgatgagacccccatcatcgctgtgatggtggccctgagcagcctgctggtgattgtgttcatcatcatcgtgctgtacatgctgcgcttcaagaagtacaagcaggccggcagccacagcaacagcttccggctgagcaatggaagaacagaagatgtggagccccagagcgtgcccctgctggcccggagccccagcaccaacaggaagtacccacccctgcctgtggacaagctggaggaggagatcaacagaaggatggctgatgacaacaagctgttccgggaggagttcaatgccctgcctgcctgccccatccaggccacctgtgaggccgccagcaaggaggagaacaaggagaagaaccgctacgtgaacatcctgccctatgaccacagccgggtgcacctgacccctgtggagggcgtgcctgacagcgactacatcaatgccagcttcatcaatggctaccaggagaagaacaagttcatcgccgcccagggccccaaggaggagaccgtgaatgacttctggaggatgatctgggagcagaacacagccaccatcgtgatggtgaccaacctgaaggagaggaaggagtgcaagtgtgcccagtactggccagaccagggctgctggacctacggcaacatccgggtgtctgtggaggatgtgacagtgctggtggactacacagtgaggaagttctgcatccagcaggtgggggacatgaccaacaggaagccccagaggctcatcacccagttccacttcacctcctggccagactttggagtgcccttcacccccatcggcatgctgaagttcctgaagaaggtgaaggcctgcaacccccagtatgctggggccatcgtggtgcactgcagcgctggggtgggccgcacaggcacctttgtggtgattgatgccatgctggacatgatgcacacagagaggaaggtggatgtgtatggctttgtgagccgcatccgggcccagcgctgccagatggtgcagacagacatgcagtatgtgttcatctaccaggccctgctggagcactacctgtatggagacacagagctggaggtgaccagcctggagacccacctgcagaagatctacaacaagatccctggcaccagcaacaacggcctggaggaggagttcaagaagctgaccagcatcaagatccagaatgacaagatgaggactggaaacctgcctgccaacatgaagaagaacagagtgctgcagatcatcccctatgagttcaacagagtcatcatccctgtgaagagaggagaagaaaatacagattatgtgaatgccagcttcattgatggctaccggcagaaggacagctacatcgccagccagggccccctgctgcacaccatcgaggacttctggaggatgatctgggagtggaagagctgcagcatcgtgatgctgacagagctggaggagcggggccaggagaagtgtgcccagtactggcccagtgatggcctggtgtcctatggagacatcaccgtggagctgaagaaggaggaggagtgtgagagctacacagtgcgggacctgctggtgaccaacacccgggagaacaagagccggcagatccggcagttccacttccacggctggccagaggtgggcatccccagtgatggcaagggcatgatcagcatcatcgctgctgtgcagaagcagcagcagcagagcggcaaccaccccatcaccgtgcactgcagcgctggagctggccgcacaggcaccttctgtgccctgagcacagtgctggagcgggtgaaggccgagggcatcctggatgtgttccagacagtgaagagcctgcggctgcagaggccccacatggtgcagaccctggagcagtatgagttctgctacaaggtggtgcaggagtacattgatgccttcagtgactatgccaacttcaagtag

SEQ ID NO: 166296 - DNA, 2382 bp, Artificial Sequence; identical to SEQ ID NO: 166295
  Description of Artificial Sequence: Synthetic coding sequence

SEQ ID NO: 166297 - DNA, 1977 bp, Artificial Sequence
  Description of Artificial Sequence: Synthetic coding sequence
atggtggccctgagcagcctgctggtgattgtgttcatcatcatcgtgctgtacatgctgcggcgcttcaggaaggccgagctgatgagcaggaacacagagaagtacaagcaggccggcagccacagcaacagcttccggctgagcaatggccgcacagaagatgtggagccccagagcgtgcccctgctggcccggagccccagcaccaacaggaagtacccacccctgcctgtggacaagctggaggaggagatcaacagaaggatggctgatgacaacaagctgttccgggaggagttcaatgccctgcctgcctgccccatccaggccacctgtgaggccgccagcaaggaggagaacaaggagaagaacagatatgtgaacatcctgccctatgaccacagccgggtgcacctgacccctgtggagggcgtgcctgacagcgactacatcaatgccagcttcatcaatggctaccaggagaagaacaagttcatcgccgcccagggccccaaggaggagaccgtgaatgacttctggaggatgatctgggagcagaacacagccaccatcgtgatggtgaccaacctgaaggagaggaaagaatgtaaatgtgcccagtactggccagaccagggctgctggacctacggcaacatccgggtgtctgtggaggatgtgacagtgctggtggactacacagtgaggaagttctgcatccagcaggtgggggacatgaccaacaggaagccccagaggctcatcacccagttccacttcacctcctggccagactttggagtgcccttcacccccatcggcatgctgaagttcctgaagaaggtgaaggcctgcaacccccagtatgctggggccatcgtggtgcactgcagcgctggggtgggccgcacaggcacctttgtggtgattgatgccatgctggacatgatgcacacagagaggaaggtggatgtgtatggctttgtgagccgcatccgggcccagcgctgccagatggtgcagacagacatgcagtatgtgttcatctaccaggccctgctggagcactacctgtatggagacacagagctggaggtgaccagcctggagacccacctgcagaagatctacaacaagatccctggcaccagcaacaacggcctggaggaggagttcaagaagctgaccagcatcaagatccagaatgacaagatgaggacaggcaacctgcctgccaacatgaagaagaacagagtgctgcagatcatcccctatgagttcaacagagtcatcatccctgtgaagagaggagaggagaacacagattatgtgaatgccagcttcattgatggctaccggcagaaggacagctacatcgccagccagggccccctgctgcacaccatcgaggacttctggaggatgatctgggagtggaagagctgcagcatcgtgatgctgacagagctggaggagcggggccaggagaagtgtgcccagtactggcccagtgatggcctggtgtcctatggagacatcaccgtggagctgaagaaggaggaggagtgtgagagctacacagtgcgggacctgctggtgaccaacacccgggagaacaagagccggcagatccggcagttccacttccacggctggccagaggtgggcatccccagtgatggcaagggcatgatcagcatcatcgctgctgtgcagaagcagcagcagcagagcggcaaccaccccatcaccgtgcactgcagcgctggggccggccgcacaggcaccttctgtgccctgagcacagtgctggagcgggtgaaggccgagggcatcctggatgtgttccagacagtgaagagcctgcggctgcagaggccccacatggtgcagaccctggagcagtatgagttctgctacaaggtggtgcaggagtacattgatgccttcagtgactatgccaacttcaagtag

SEQ ID NO: 166298 - DNA, 2409 bp, Artificial Sequence
  Description of Artificial Sequence: Synthetic coding sequence
atggacagctggttcatcctggtgctgctgggcagcggcctcatctgtgtgtctgccaacaatgccaccaccgtggcccccagcgtgggcatcaccaggctcatcaacagcagcacagctgagcctgtgaaggaggaggccaagaccagcaaccccaccagcagcctgaccagcctgtctgtggcccccaccttcagccccaacatcaccctgggccccacctacctgaccaccgtgaacagcagtgacagcgacaatggcaccaccaggacagccagcaccaacagcatcggcatcaccatcagccccaacggcacctggctgcctgacaaccagttcacagatgccaggacagagccctgggagggcaacagcagcacagctgccaccaccccagagaccttcccccccagcggcaacagcgacagcaaggacagaagagatgagacccccatcatcgctgtgatggtggccctgagcagcctgctggtgattgtgttcatcatcatcgtgctgtacatgctgcgcttcaagaagtacaagcaggccggcagccacagcaacagcttccggctgagcaatggccgcacagaagatgtggagccccagagcgtgcccctgctggcccggagccccagcaccaacaggaagtacccacccctgcctgtggacaagctggaggaggagatcaacagaaggatggctgatgacaacaagctgttccgggaggagttcaatgccctgcctgcctgccccatccaggccacctgtgaggccgccagcaaggaggagaacaaggagaagaacagatatgtgaacatcctgccctatgaccacagccgggtgcacctgacccctgtggagggcgtgcctgacagcgactacatcaatgccagcttcatcaatggctaccaggagaagaacaagttcatcgccgcccagggccccaaggaggagaccgtgaatgacttctggaggatgatctgggagcagaacacagccaccatcgtgatggtgaccaacctgaaggagaggaaagaatgtaaatgtgcccagtactggccagaccagggctgctggacctacggcaacatccgggtgtctgtggaggatgtgacagtgctggtggactacacagtgaggaagttctgcatccagcaggtgggggacatgaccaacaggaagccccagaggctcatcacccagttccacttcacctcctggccagactttggagtgcccttcacccccatcggcatgctgaagttcctgaagaaggtgaaggcctgcaacccccagtatgctggggccatcgtggtgcactgcagcgctggggtgggccgcacaggcacctttgtggtgattgatgccatgctggacatgatgcacacagagaggaaggtggatgtgtatggctttgtgagccgcatccgggcccagcgctgccagatggtgcagacagacatgcagtatgtgttcatctaccaggccctgctggagcactacctgtatggagacacagagctggaggtgaccagcctggagacccacctgcagaagatctacaacaagatccctggcaccagcaacaacggcctggaggaggagttcaagaagctgaccagcatcaagatccagaatgacaagatgaggacaggcaacctgcctgccaacatgaagaagaacagagtgctgcagatcatcccctatgagttcaacagagtcatcatccctgtgaagagaggagaggagaacacagattatgtgaatgccagcttcattgatggctaccggcagaaggacagctacatcgccagccagggccccctgctgcacaccatcgaggacttctggaggatgatctgggagtggaagagctgcagcatcgtgatgctgacagagctggaggagcggggccaggagaagtgtgcccagtactggcccagtgatggcctggtgtcctatggagacatcaccgtggagctgaagaaggaggaggagtgtgagagctacacagtgcgggacctgctggtgaccaacacccgggagaacaagagccggcagatccggcagttccacttccacggctggccagaggtgggcatccccagtgatggcaagggcatgatcagcatcatcgctgctgtgcagaagcagcagcagcagagcggcaaccaccccatcaccgtgcactgcagcgctggggccggccgcacaggcaccttctgtgccctgagcacagtgctggagcgggtgaaggccgagggcatcctggatgtgttccagacagtgaagagcctgcggctgcagaggccccacatggtgcagaccctggagcagtatgagttctgctacaaggtggtgcaggagtacattgatgccttcagtgactatgccaacttcaagtag

SEQ ID NO: 166299 - DNA, 2409 bp, Artificial Sequence; identical to SEQ ID NO: 166298
  Description of Artificial Sequence: Synthetic coding sequence

SEQ ID NO: 166300 - DNA, 603 bp, Artificial Sequence
  Description of Artificial Sequence: Synthetic coding sequence
atggacagctggttcatcctggtgctgctgggcagcggcctcatctgtgtgtctgccaacaatgccaccaccgtggcccccagcgtgggcatcaccaggctcatcaacagcagcacagctgagcctgtgaaggaggaggccaagaccagcaaccccaccagcagcctgaccagcctgtctgtggcccccaccttcagccccaacatcaccctgggccccacctacctgaccaccgtgaacagcagtgacagcgacaatggcaccaccaggacagccagcaccaacagcatcggcatcaccatcagccccaacggcacctggctgcctgacaaccagttcacagatgccaggacagagccctgggagggcaacagcagcacagctgccaccaccccagagaccttcccccccagcggcaacagcgacagcaaggacagaagagatgagacccccatcatcgctgtgatggtggccctgagcagcctgctggtgattgtgttcatcatcatcgtgctgtacatgctgcgcttcaagaagtacaagcaggccggcagccacagcaacagcttccggctgagcaatggccgcacagaagatgtgtag

SEQ ID NO: 166301 - DNA, 2442 bp, Artificial Sequence
  Description of Artificial Sequence: Synthetic coding sequence
atggatgatgctgtgcagatcaccaagatctccatggacagctggttcatcctggtgctgctgggcagcggcctcatctgtgtgtctgccaacaatgccaccaccgtggcccccagcgtgggcatcaccaggctcatcaacagcagcacagctgagcctgtgaaggaggaggccaagaccagcaaccccaccagcagcctgaccagcctgtctgtggcccccaccttcagccccaacatcaccctgggccccacctacctgaccaccgtgaacagcagtgacagcgacaatggcaccaccaggacagccagcaccaacagcatcggcatcaccatcagccccaacggcacctggctgcctgacaaccagttcacagatgccaggacagagccctgggagggcaacagcagcacagctgccaccaccccagagaccttccccccatctggcaacagcgacagcaaggacagaagagatgagacccccatcatcgctgtgatggtggccctgagcagcctgctggtgattgtgttcatcatcatcgtgctgtacatgctgcgcttcaagaagtacaagcaggccggcagccacagcaacagcttccggctgagcaatggaagaacagaagatgtggagccccagagcgtgcccctgctggcccggagccccagcaccaacaggaagtacccacccctgcctgtggacaagctggaggaggagatcaacagaaggatggctgatgacaacaagctgttccgggaggagttcaatgccctgcctgcctgccccatccaggccacctgtgaggccgccagcaaggaggagaacaaggagaagaaccgctacgtgaacatcctgccctatgaccacagccgggtgcacctgacccctgtggagggcgtgcctgacagcgactacatcaatgccagcttcatcaatggctaccaggagaagaacaagttcatcgccgcccagggccccaaggaggagaccgtgaatgacttctggaggatgatctgggagcagaacacagccaccatcgtgatggtgaccaacctgaaggagaggaaggagtgcaagtgtgcccagtactggccagaccagggctgctggacctacggcaacatccgggtgtctgtggaggatgtgacagtgctggtggactacacagtgaggaagttctgcatccagcaggtgggggacatgaccaacaggaagccccagaggctcatcacccagttccacttcacctcctggccagactttggagtgcccttcacccccatcggcatgctgaagttcctgaagaaggtgaaggcctgcaacccccagtatgctggggccatcgtggtgcactgcagcgctggggtgggccgcacaggcacctttgtggtgattgatgccatgctggacatgatgcacacagagaggaaggtggatgtgtatggctttgtgagccgcatccgggcccagcgctgccagatggtgcagacagacatgcagtatgtgttcatctaccaggccctgctggagcactacctgtatggagacacagagctggaggtgaccagcctggagacccacctgcagaagatctacaacaagatccctggcaccagcaacaacggcctggaggaggagttcaagaagctgaccagcatcaagatccagaatgacaagatgaggactggaaacctgcctgccaacatgaagaagaacagagtgctgcagatcatcccctatgagttcaacagagtcatcatccctgtgaagagaggagaagaaaatacagattatgtgaatgccagcttcattgatggctaccggcagaaggacagctacatcgccagccagggccccctgctgcacaccatcgaggacttctggaggatgatctgggagtggaagagctgcagcatcgtgatgctgacagagctggaggagcggggccaggagaagtgtgcccagtactggcccagtgatggcctggtgtcctatggagacatcaccgtggagctgaagaaggaggaggagtgtgagagctacacagtgcgggacctgctggtgaccaacacccgggagaacaagagccggcagatccggcagttccacttccacggctggccagaggtgggcatccccagtgatggcaagggcatgatcagcatcatcgctgctgtgcagaagcagcagcagcagagcggcaaccaccccatcaccgtgcactgcagcgctggagctggccgcacaggcaccttctgtgccctgagcacagtgctggagcgggtgaaggccgagggcatcctggatgtgttccagacagtgaagagcctgcggctgcagaggccccacatggtgcagaccctggagcagtatgagttctgctacaaggtggtgcaggagtacattgatgccttcagtgactatgccaacttcaagtag

SEQ ID NO: 166302 - DNA, 528 bp, Artificial Sequence
  Description of Artificial Sequence: Synthetic coding sequence
atggacagctggttcatcctggtgctgctgggcagcggcctcatctgtgtgtctgccaacaatgccaccaccgtggcccccagcgtgggcatcaccaggctcatcaacagcagcacagctgagcctgtgaaggaggaggccaagaccagcaaccccaccagcagcctgaccagcctgtctgtggcccccaccttcagccccaacatcaccctgggccccacctacctgaccaccgtgaacagcagtgacagcgacaatggcaccaccaggacagccagcaccaacagcatcggcatcaccatcagccccaacggcacctggctgcctgacaaccagttcacagatgccaggacagagccctgggagggcaacagcagcacagctgccaccaccccagagaccttcccccccagcggcaacagcgacagcaaggacagaagagatgagacccccatcatcgctgtgatggtggccctgagcagcctgctggtgattgtgttcatcatcatcgtgctgtacatgctgtag

SEQ ID NO: 166303 - DNA, 417 bp, Artificial Sequence
  Description of Artificial Sequence: Synthetic coding sequence
atggacagctggttcatcctggtgctgctgggcagcggcctcatctgtgtgtctgccaacaatgccaccaccgtggcccccagcgtgggcatcaccaggctcatcaacagcagcacagctgagcctgtgaaggaggaggccaagaccagcaaccccaccagcagcctgaccagcctgtctgtggcccccaccttcagccccaacatcaccctgggccccacctacctgaccaccgtgaacagcagtgacagcgacaatggcaccaccaggacagccagcaccaacagcatcggcatcaccatcagccccaacggcacctggctgcctgacaaccagttcacagatgccaggacagagccctgggagggcaacagcagcacagctgccaccaccccagagaccttcccccccagctag

SEQ ID NO: 166304 - DNA, 762 bp, Artificial Sequence
  Description of Artificial Sequence: Synthetic coding sequence
atggacagctggttcatcctggtgctgctgggcagcggcctcatctgtgtgtctgccaacaatgccaccaccgtggcccccagcgtgggcatcaccaggctcatcaacagcagcacagctgagcctgtgaaggaggaggccaagaccagcaaccccaccagcagcctgaccagcctgtctgtggcccccaccttcagccccaacatcaccctgggccccacctacctgaccaccgtgaacagcagtgacagcgacaatggcaccaccaggacagccagcaccaacagcatcggcatcaccatcagccccaacggcacctggctgcctgacaaccagttcacagatgccaggacagagccctgggagggcaacagcagcacagctgccaccaccccagagaccttccccccatctgatgagacccccatcatcgctgtgatggtggccctgagcagcctgctggtgattgtgttcatcatcatcgtgctgtacatgctgcgcttcaagaagtacaagcaggccggcagccacagcaacagcttccggctgagcaatggaagaacagaagatgtggagccccagagcgtgcccctgctggcccggagccccagcaccaacaggaagtacccacccctgcctgtggacaagctggaggaggagatcaacagaaggatggctgatgacaacaagctgttccgggaggagttcaatgccctgcctgcctgccccatccaggccacctgtgaggccgccagcaagtag

SEQ ID NO: 166305 - DNA, 1239 bp, Artificial Sequence
  Description of Artificial Sequence: Synthetic coding sequence
atgaccaacaggaagccccagaggctcatcacccagttccacttcacctcctggccagactttggagtgcccttcacccccatcggcatgctgaagttcctgaagaaggtgaaggcctgcaacccccagtatgctggggccatcgtggtgcactgcagcgctggggtgggccgcacaggcacctttgtggtgattgatgccatgctggacatgatgcacacagagaggaaggtggatgtgtatggctttgtgagccgcatccgggcccagcgctgccagatggtgcagacagacatgcagtatgtgttcatctaccaggccctgctggagcactacctgtatggagacacagagctggaggtgaccagcctggagacccacctgcagaagatctacaacaagatccctggcaccagcaacaacggcctggaggaggagttcaagaagctgaccagcatcaagatccagaatgacaagatgaggacaggcaacctgcctgccaacatgaagaagaacagagtgctgcagatcatcccctatgagttcaacagagtcatcatccctgtgaagagaggagaggagaacacagattatgtgaatgccagcttcattgatggctaccggcagaaggacagctacatcgccagccagggccccctgctgcacaccatcgaggacttctggaggatgatctgggagtggaagagctgcagcatcgtgatgctgacagagctggaggagcggggccaggagaagtgtgcccagtactggcccagtgatggcctggtgtcctatggagacatcaccgtggagctgaagaaggaggaggagtgtgagagctacacagtgcgggacctgctggtgaccaacacccgggagaacaagagccggcagatccggcagttccacttccacggctggccagaggtgggcatccccagtgatggcaagggcatgatcagcatcatcgctgctgtgcagaagcagcagcagcagagcggcaaccaccccatcaccgtgcactgcagcgctggggccggccgcacaggcaccttctgtgccctgagcacagtgctggagcgggtgaaggccgagggcatcctggatgtgttccagacagtgaagagcctgcggctgcagaggccccacatggtgcagaccctggagcagtatgagttctgctacaaggtggtgcaggagtacattgatgccttcagtgactatgccaacttcaagtag

SEQ ID NO: 166306 - DNA, 5994 bp, Artificial Sequence
  Description of Artificial Sequence: Synthetic coding sequence
atgctgagccacggggccggcctggccctgtggatcaccctgagcctgctgcagacaggcctggccgagcctgagcgctgcaacttcaccctggccgagagcaaggccagcagccacagcgtgtccatccagtggaggatcctgggcagcccctgcaacttcagcctcatctacagcagtgacaccctgggcgccgccctgtgccccaccttcagaattgacaacaccacctacggctgcaacctgcaggacctgcaggccggcaccatctacaacttccgcatcatcagcctggatgaggagaggacagtggtgctgcagacagaccccctgcccccagcccgcttcggcgtgtccaaggagaagaccaccagcaccagcctgcacgtgtggtggacccccagcagcggcaaggtgaccagctatgaggtgcagctgtttgatgagaacaaccagaagatccagggcgtgcagatccaggagagcacctcctggaatgagtacaccttcttcaacctgacagctggcagcaagtacaacatcgccatcacagctgtgtctgggggcaagaggagcttctctgtgtacaccaacggcagcacagtgcccagccctgtgaaggacatcggcatcagcaccaaggccaacagcctgctgatctcctggagccacggcagcggaaatgtggagcgctaccgcctgatgctgatggacaagggcatcctggtgcacggcggcgtggtggacaagcacgccaccagctatgccttccacggcctgaccccaggctacctgtacaacctgactgtgatgacagaggccgccggcctgcagaactaccgctggaagctggtgaggacagcccccatggaggtgagcaacctgaaggtgaccaatgatggcagcctgaccagcctgaaggtgaagtggcagaggcctcctggaaatgtggacagctacaacatcaccctgagccacaagggcaccatcaaggagagccgggtgctggccccctggatcacagagacccacttcaaggagctggtgcccggccgcctgtaccaggtgacagtgtcctgtgtgtctggagagctgagcgcccagaagatggctgtgggccgcaccttcccagacaaggtggccaacctggaggccaacaacaacggccgcatgaggagcctggtggtgtcctggagccccccagctggggactgggagcagtaccgcatcctgctcttcaatgacagcgtggtgctgctgaacatcaccgtgggcaaggaggagacccagtatgtgatggatgacaccggcctggtgcccggccggcagtatgaggtggaggtgattgtggagagcggcaacctgaagaacagcgagcgctgccagggccgcacagtgcccctggccgtgctgcagctgcgggtgaagcacgccaatgagaccagcctgagcatcatgtggcagacccctgtggccgagtgggagaagtacatcatcagcctggccgaccgggacctgctgctgatccacaagagcctgagcaaggatgccaaggagttcaccttcacagacctggtgcccggcaggaagtacatggccaccgtgaccagcatcagcggggacctgaagaacagcagctctgtgaagggccgcacagtgcctgcccaggtgacagacctgcacgtggccaaccagggcatgaccagcagcctcttcaccaactggacccaggcccagggagatgtggagttctaccaggtgctgctgattcatgaaaatgtggtgatcaagaatgaaagcatcagcagcgagaccagccgctacagcttccacagcctgaagagcggcagcctgtacagcgtggtggtgaccaccgtgtctgggggcatcagcagccggcaggtggtggtggagggccgcacagtgcccagctctgtgtctggagtgacagtgaacaacagcggcagaaatgactacctgtctgtgtcctggctgctggcccctggagatgtggacaactatgaggtgaccctgagccatgatggcaaggtggtgcagagcctggtgattgccaagtctgtgcgggagtgcagcttcagcagcctgaccccaggccgcctgtacacagtgaccatcaccaccaggtctgggaagtatgagaaccacagcttcagccaggagaggacagtgcctgacaaggtgcagggcgtgtctgtgagcaacagcgcccggagtgactacctgcgggtgtcctgggtgcacgccaccggggactttgaccactatgaggtgaccatcaagaacaagaacaacttcatccagaccaagagcatccccaagtcagaaaatgaatgtgtgtttgtgcagctggtgcccggccgcctgtacagcgtgacagtgaccaccaagagcggccagtatgaggccaatgagcagggcaatggccgcaccatccctgagcctgtgaaggacctgaccctgaggaacagaagcacagaggacctgcacgtgacctggagcggggccaatggagatgtggaccagtatgagatccagctgctcttcaatgacatgaaggtgttcccccccttccacctggtgaacacagccacagagtaccgcttcaccagcctgaccccaggccggcagtacaagatcctggtgctgaccatctctggagatgtgcagcagagcgccttcatcgagggcttcaccgtgcccagcgctgtgaagaacatccacatcagccccaacggggccacagacagcctgactgtgaactggaccccaggaggaggagatgtggacagctacacagtgtctgccttccgccacagccagaaggtggacagccagaccatccccaagcacgtgtttgagcacaccttccaccggctggaggccggggagcagtaccagatcatgattgcctctgtgtctggcagcctgaagaaccagatcaacgtggtgggccgcacagtgcctgcctctgtgcagggcgtgattgctgacaatgcctacagcagctacagcctgattgtgtcctggcagaaggccgccggcgtggccgagagatatgacatcctgctgctgacagaaaatggcatcctgctgaggaacaccagcgagcccgccaccaccaagcagcacaagtttgaggacctgaccccaggcaagaagtacaagatccagatcctgactgtgtctgggggcctcttcagcaaggaggcccagacagagggccgcacagtgcctgctgctgtgacagacctgcgcatcacagagaacagcaccaggcacctgtccttccgctggacagccagcgagggggagctgtcctggtacaacatcttcctgtacaacccagatggcaacctgcaggagcgggcccaggtggaccccctggtgcagagcttctccttccagaacctgctgcagggccgcatgtacaagatggtgattgtgacccacagcggggagctgagcaatgaaagcttcatcttcggccgcacagtgcctgcctctgtgagccacctgcggggcagcaacagaaacaccacagacagcctgtggttcaactggagccctgccagcggggactttgacttctatgagctgatcctgtacaaccccaacggcaccaagaaggagaactggaaggacaaggacctgacagagtggaggttccagggcctggtgcccggcaggaaatatgtgctgtgggtggtgacccacagcggggacctgagcaacaaggtgacagctgagagcaggacagcccccagcccccccagcctgatgagctttgctgacatcgccaacaccagcctggccatcacctggaagggccccccagactggacagactacaatgactttgagctgcagtggctgcccagagatgccctgaccgtcttcaacccctacaacaacaggaagtctgagggccgcatcgtgtatggcctgcggcccggccgcagctaccagttcaacgtgaagacagtgtctggggacagctggaagacctacagcaagcccatcttcggctctgtgaggaccaagccagacaagatccagaacctgcactgccggccccagaacagcacagccatcgcctgctcctggatccccccagacagcgactttgatggctacagcattgagtgcaggaagatggacacccaggaggtggagttcagcaggaagctggagaaggagaagagcctgctgaacatcatgatgctggtgccccacaagcgctacctggtgtccatcaaggtgcagagcgctggcatgaccagcgaggtggtggaggacagcaccatcaccatgattgaccggcccccacctcctccaccccacatccgggtgaatgagaaggatgtgctgatcagcaagagcagcatcaacttcaccgtgaactgctcctggttcagtgacaccaacggggctgtgaagtacttcaccgtggtggtgcgggaggctgatggcagtgatgagctgaagccagagcagcagcaccccctgcccagctacctggagtaccgccacaatgccagcatccgggtgtaccagaccaactactttgccagcaaatgtgccgagaaccccaacagcaacagcaagagcttcaacatcaagctgggcgctgagatggagagcctgggcggcaaatgtgaccccacccagcagaagttctgtgatggccccctgaagccccacacagcctaccgcatcagcatccgggccttcacccagctgtttgatgaggacctgaaggagttcaccaagcccctgtacagcgacaccttcttcagcctgcccatcaccacagaaagtgagcccctgtttggagccatcgagggcgtgtctgctggcctcttcctgattggcatgctggtggccgtggtggccctgctgatctgccggcagaaggtgagccacggccgggagcggcccagcgcccggctgagcatccggcgggaccggcccctgtctgtgcacctgaacctgggccagaagggcaacaggaagaccagctgccccatcaagatcaaccagtttgagggccacttcatgaagctgcaggccgacagcaactacctgctgagcaaggagtatgaggagctgaaggatgtgggcaggaaccagagctgtgacatcgccctgctgcctgagaacagaggcaagaaccgctacaacaacatcctgccctatgatgccaccagggtgaagctgagcaatgtggatgatgacccctgcagcgactacatcaatgccagctacatccctggcaacaacttcagaagagagtacatcgtgacccagggccccctgcccggcaccaaggatgacttctggaagatggtgtgggagcagaatgtgcacaacatcgtgatggtgacccagtgtgtggagaagggccgggtgaagtgtgaccactactggccagctgaccaggacagcctgtactatggagacctgatcctgcagatgctgtctgagagcgtgctgcctgagtggaccatccgggagttcaagatctgtggggaggagcagctggatgcccacaggctcatccgccacttccactacacagtgtggccagaccatggagtgcctgagaccacccagagcctcatccagtttgtgaggacagtgcgggactacatcaacagaagccctggagctggccccaccgtggtgcactgcagcgctggggtgggccgcacaggcaccttcatcgccctggaccgcatcctgcagcagctggacagcaaggacagcgtggacatctatggagctgtgcatgacctgcggctgcaccgggtgcacatggtgcagacagagtgccagtatgtgtacctgcaccagtgtgtgagagatgtgctgcgggccaggaagctgcggtctgagcaggagaaccccctcttccccatctatgaaaatgtgaaccctgagtaccaccgggaccctgtgtacagccgccactag

SEQ ID NO: 166307 - DNA, 6648 bp, Artificial Sequence
  Description of Artificial Sequence: Synthetic coding sequence
atggaggccgagttctacatggtgatcctgacctgcctgatcttcaggaacagcgagggcttccagatcgtgcacgtgcagaagcagcagtgcctcttcaagaatgagaaggtggtggtgggcagctgcaacagaaccatccagaaccagcagtggatgtggacagaagatgagaagctgctgcacgtgaagagcgccctgtgcctggccatcagcaacagcagccggggccccagccgcagcgccatcctggaccgctgcagccaggccccccgctggacctgctatgaccaggagggcttcctggaggtggagaatgccagcctcttcctgcagaagcagggcagccgggtggtggtgaagaaggccaggaagtacctgcacagctggatgaagattgatgtgaacaaggagggcaagctggtgaatgaaagcctgtgcctgcagaaggccggcctgggcgctgaggtgtctgtgcgcagcaccaggaacacagccccaccccagatcctgaccaccttcaatgctgtgcctgatggcctggtgttcctgatccggaacaccacagaggccttcatcagaaatgctgctgagaactacagccagaacagcagcgagcggcagcaccccaacctgcacatgacaggcatcacagacacctcctgggtgctgagcaccacccagcccttcagcagcaccacagaggagaccggcctggccgagcctgagcgctgcaacttcaccctggccgagagcaaggccagcagccacagcgtgtccatccagtggaggatcctgggcagcccctgcaacttcagcctcatctacagcagtgacaccctgggcgccgccctgtgccccaccttcagaattgacaacaccacctacggctgcaacctgcaggacctgcaggccggcaccatctacaacttccgcatcatcagcctggatgaggagaggacagtggtgctgcagacagaccccctgcccccagcccgcttcggcgtgtccaaggagaagaccaccagcaccagcctgcacgtgtggtggacccccagcagcggcaaggtgaccagctatgaggtgcagctgtttgatgagaacaaccagaagatccagggcgtgcagatccaggagagcacctcctggaatgagtacaccttcttcaacctgacagctggcagcaagtacaacatcgccatcacagctgtgtctgggggcaagaggagcttctctgtgtacaccaacggcagcacagtgcccagccctgtgaaggacatcggcatcagcaccaaggccaacagcctgctgatctcctggagccacggcagcggaaatgtggagcgctaccgcctgatgctgatggacaagggcatcctggtgcacggcggcgtggtggacaagcacgccaccagctatgccttccacggcctgaccccaggctacctgtacaacctgactgtgatgacagaggccgccggcctgcagaactaccgctggaagctggtgaggacagcccccatggaggtgagcaacctgaaggtgaccaatgatggcagcctgaccagcctgaaggtgaagtggcagaggcctcctggaaatgtggacagctacaacatcaccctgagccacaagggcaccatcaaggagagccgggtgctggccccctggatcacagagacccacttcaaggagctggtgcccggccgcctgtaccaggtgacagtgtcctgtgtgtctggagagctgagcgcccagaagatggctgtgggccgcaccttcccagacaaggtggccaacctggaggccaacaacaacggccgcatgaggagcctggtggtgtcctggagccccccagctggggactgggagcagtaccgcatcctgctcttcaatgacagcgtggtgctgctgaacatcaccgtgggcaaggaggagacccagtatgtgatggatgacaccggcctggtgcccggccggcagtatgaggtggaggtgattgtggagagcggcaacctgaagaacagcgagcgctgccagggccgcacagtgcccctggccgtgctgcagctgcgggtgaagcacgccaatgagaccagcctgagcatcatgtggcagacccctgtggccgagtgggagaagtacatcatcagcctggccgaccgggacctgctgctgatccacaagagcctgagcaaggatgccaaggagttcaccttcacagacctggtgcccggcaggaagtacatggccaccgtgaccagcatcagcggggacctgaagaacagcagctctgtgaagggccgcacagtgcctgcccaggtgacagacctgcacgtggccaaccagggcatgaccagcagcctcttcaccaactggacccaggcccagggagatgtggagttctaccaggtgctgctgattcatgaaaatgtggtgatcaagaatgaaagcatcagcagcgagaccagccgctacagcttccacagcctgaagagcggcagcctgtacagcgtggtggtgaccaccgtgtctgggggcatcagcagccggcaggtggtggtggagggccgcacagtgcccagctctgtgtctggagtgacagtgaacaacagcggcagaaatgactacctgtctgtgtcctggctgctggcccctggagatgtggacaactatgaggtgaccctgagccatgatggcaaggtggtgcagagcctggtgattgccaagtctgtgcgggagtgcagcttcagcagcctgaccccaggccgcctgtacacagtgaccatcaccaccaggtctgggaagtatgagaaccacagcttcagccaggagaggacagtgcctgacaaggtgcagggcgtgtctgtgagcaacagcgcccggagtgactacctgcgggtgtcctgggtgcacgccaccggggactttgaccactatgaggtgaccatcaagaacaagaacaacttcatccagaccaagagcatccccaagtcagaaaatgaatgtgtgtttgtgcagctggtgcccggccgcctgtacagcgtgacagtgaccaccaagagcggccagtatgaggccaatgagcagggcaatggccgcaccatccctgagcctgtgaaggacctgaccctgaggaacagaagcacagaggacctgcacgtgacctggagcggggccaatggagatgtggaccagtatgagatccagctgctcttcaatgacatgaaggtgttcccccccttccacctggtgaacacagccacagagtaccgcttcaccagcctgaccccaggccggcagtacaagatcctggtgctgaccatctctggagatgtgcagcagagcgccttcatcgagggcttcaccgtgcccagcgctgtgaagaacatccacatcagccccaacggggccacagacagcctgactgtgaactggaccccaggaggaggagatgtggacagctacacagtgtctgccttccgccacagccagaaggtggacagccagaccatccccaagcacgtgtttgagcacaccttccaccggctggaggccggggagcagtaccagatcatgattgcctctgtgtctggcagcctgaagaaccagatcaacgtggtgggccgcacagtgcctgcctctgtgcagggcgtgattgctgacaatgcctacagcagctacagcctgattgtgtcctggcagaaggccgccggcgtggccgagagatatgacatcctgctgctgacagaaaatggcatcctgctgaggaacaccagcgagcccgccaccaccaagcagcacaagtttgaggacctgaccccaggcaagaagtacaagatccagatcctgactgtgtctgggggcctcttcagcaaggaggcccagacagagggccgcacagtgcctgctgctgtgacagacctgcgcatcacagagaacagcaccaggcacctgtccttccgctggacagccagcgagggggagctgtcctggtacaacatcttcctgtacaacccagatggcaacctgcaggagcgggcccaggtggaccccctggtgcagagcttctccttccagaacctgctgcagggccgcatgtacaagatggtgattgtgacccacagcggggagctgagcaatgaaagcttcatcttcggccgcacagtgcctgcctctgtgagccacctgcggggcagcaacagaaacaccacagacagcctgtggttcaactggagccctgccagcggggactttgacttctatgagctgatcctgtacaaccccaacggcaccaagaaggagaactggaaggacaaggacctgacagagtggaggttccagggcctggtgcccggcaggaaatatgtgctgtgggtggtgacccacagcggggacctgagcaacaaggtgacagctgagagcaggacagcccccagcccccccagcctgatgagctttgctgacatcgccaacaccagcctggccatcacctggaagggccccccagactggacagactacaatgactttgagctgcagtggctgcccagagatgccctgaccgtcttcaacccctacaacaacaggaagtctgagggccgcatcgtgtatggcctgcggcccggccgcagctaccagttcaacgtgaagacagtgtctggggacagctggaagacctacagcaagcccatcttcggctctgtgaggaccaagccagacaagatccagaacctgcactgccggccccagaacagcacagccatcgcctgctcctggatccccccagacagcgactttgatggctacagcattgagtgcaggaagatggacacccaggaggtggagttcagcaggaagctggagaaggagaagagcctgctgaacatcatgatgctggtgccccacaagcgctacctggtgtccatcaaggtgcagagcgctggcatgaccagcgaggtggtggaggacagcaccatcaccatgattgaccggcccccacctcctccaccccacatccgggtgaatgagaaggatgtgctgatcagcaagagcagcatcaacttcaccgtgaactgctcctggttcagtgacaccaacggggctgtgaagtacttcaccgtggtggtgcgggaggctgatggcagtgatgagctgaagccagagcagcagcaccccctgcccagctacctggagtaccgccacaatgccagcatccgggtgtaccagaccaactactttgccagcaaatgtgccgagaaccccaacagcaacagcaagagcttcaacatcaagctgggcgctgagatggagagcctgggcggcaaatgtgaccccacccagcagaagttctgtgatggccccctgaagccccacacagcctaccgcatcagcatccgggccttcacccagctgtttgatgaggacctgaaggagttcaccaagcccctgtacagcgacaccttcttcagcctgcccatcaccacagaaagtgagcccctgtttggagccatcgagggcgtgtctgctggcctcttcctgattggcatgctggtggccgtggtggccctgctgatctgccggcagaaggtgagccacggccgggagcggcccagcgcccggctgagcatccggcgggaccggcccctgtctgtgcacctgaacctgggccagaagggcaacaggaagaccagctgccccatcaagatcaaccagtttgagggccacttcatgaagctgcaggccgacagcaactacctgctgagcaaggagtatgaggagctgaaggatgtgggcaggaaccagagctgtgacatcgccctgctgcctgagaacagaggcaagaaccgctacaacaacatcctgccctatgatgccaccagggtgaagctgagcaatgtggatgatgacccctgcagcgactacatcaatgccagctacatccctggcaacaacttcagaagagagtacatcgtgacccagggccccctgcccggcaccaaggatgacttctggaagatggtgtgggagcagaatgtgcacaacatcgtgatggtgacccagtgtgtggagaagggccgggtgaagtgtgaccactactggccagctgaccaggacagcctgtactatggagacctgatcctgcagatgctgtctgagagcgtgctgcctgagtggaccatccgggagttcaagatctgtggggaggagcagctggatgcccacaggctcatccgccacttccactacacagtgtggccagaccatggagtgcctgagaccacccagagcctcatccagtttgtgaggacagtgcgggactacatcaacagaagccctggagctggccccaccgtggtgcactgcagcgctggggtgggccgcacaggcaccttcatcgccctggaccgcatcctgcagcagctggacagcaaggacagcgtggacatctatggagctgtgcatgacctgcggctgcaccgggtgcacatggtgcagacagagtgccagtatgtgtacctgcaccagtgtgtgagagatgtgctgcgggccaggaagctgcggtctgagcaggagaaccccctcttccccatctatgaaaatgtgaaccctgagtaccaccgggaccctgtgtacagccgccactag

SEQ ID NO: 166308 - DNA, 5724 bp, Artificial Sequence
  Description of Artificial Sequence: Synthetic coding sequence
atgctgagccacggggccggcctggccctgtggatcaccctgagcctgctgcagacaggcctggccgagcctgagcgctgcaacttcaccctggccgagagcaaggccagcagccacagcgtgtccatccagtggaggatcctgggcagcccctgcaacttcagcctcatctacagcagtgacaccctgggcgccgccctgtgccccaccttcagaattgacaacaccacctacggctgcaacctgcaggacctgcaggccggcaccatctacaacttccgcatcatcagcctggatgaggagaggacagtggtgctgcagacagaccccctgcccccagcccgcttcggcgtgtccaaggagaagaccaccagcaccagcctgcacgtgtggtggacccccagcagcggcaaggtgaccagctatgaggtgcagctgtttgatgagaacaaccagaagatccagggcgtgcagatccaggagagcacctcctggaatgagtacaccttcttcaacctgacagctggcagcaagtacaacatcgccatcacagctgtgtctgggggcaagaggagcttctctgtgtacaccaacggcagcacagtgcccagccctgtgaaggacatcggcatcagcaccaaggccaacagcctgctgatctcctggagccacggcagcggaaatgtggagcgctaccgcctgatgctgatggacaagggcatcctggtgcacggcggcgtggtggacaagcacgccaccagctatgccttccacggcctgaccccaggctacctgtacaacctgactgtgatgacagaggccgccggcctgcagaactaccgctggaagctggtgaggacagcccccatggaggtgagcaacctgaaggtgaccaatgatggcagcctgaccagcctgaaggtgaagtggcagaggcctcctggaaatgtggacagctacaacatcaccctgagccacaagggcaccatcaaggagagccgggtgctggccccctggatcacagagacccacttcaaggagctggtgcccggccgcctgtaccaggtgacagtgtcctgtgtgtctggagagctgagcgcccagaagatggctgtgggccgcaccttccccctggccgtgctgcagctgcgggtgaagcacgccaatgagaccagcctgagcatcatgtggcagacccctgtggccgagtgggagaagtacatcatcagcctggccgaccgggacctgctgctgatccacaagagcctgagcaaggatgccaaggagttcaccttcacagacctggtgcccggcaggaagtacatggccaccgtgaccagcatcagcggggacctgaagaacagcagctctgtgaagggccgcacagtgcctgcccaggtgacagacctgcacgtggccaaccagggcatgaccagcagcctcttcaccaactggacccaggcccagggagatgtggagttctaccaggtgctgctgattcatgaaaatgtggtgatcaagaatgaaagcatcagcagcgagaccagccgctacagcttccacagcctgaagagcggcagcctgtacagcgtggtggtgaccaccgtgtctgggggcatcagcagccggcaggtggtggtggagggccgcacagtgcccagctctgtgtctggagtgacagtgaacaacagcggcagaaatgactacctgtctgtgtcctggctgctggcccctggagatgtggacaactatgaggtgaccctgagccatgatggcaaggtggtgcagagcctggtgattgccaagtctgtgcgggagtgcagcttcagcagcctgaccccaggccgcctgtacacagtgaccatcaccaccaggtctgggaagtatgagaaccacagcttcagccaggagaggacagtgcctgacaaggtgcagggcgtgtctgtgagcaacagcgcccggagtgactacctgcgggtgtcctgggtgcacgccaccggggactttgaccactatgaggtgaccatcaagaacaagaacaacttcatccagaccaagagcatccccaagtcagaaaatgaatgtgtgtttgtgcagctggtgcccggccgcctgtacagcgtgacagtgaccaccaagagcggccagtatgaggccaatgagcagggcaatggccgcaccatccctgagcctgtgaaggacctgaccctgaggaacagaagcacagaggacctgcacgtgacctggagcggggccaatggagatgtggaccagtatgagatccagctgctcttcaatgacatgaaggtgttcccccccttccacctggtgaacacagccacagagtaccgcttcaccagcctgaccccaggccggcagtacaagatcctggtgctgaccatctctggagatgtgcagcagagcgccttcatcgagggcttcaccgtgcccagcgctgtgaagaacatccacatcagccccaacggggccacagacagcctgactgtgaactggaccccaggaggaggagatgtggacagctacacagtgtctgccttccgccacagccagaaggtggacagccagaccatccccaagcacgtgtttgagcacaccttccaccggctggaggccggggagcagtaccagatcatgattgcctctgtgtctggcagcctgaagaaccagatcaacgtggtgggccgcacagtgcctgcctctgtgcagggcgtgattgctgacaatgcctacagcagctacagcctgattgtgtcctggcagaaggccgccggcgtggccgagagatatgacatcctgctgctgacagaaaatggcatcctgctgaggaacaccagcgagcccgccaccaccaagcagcacaagtttgaggacctgaccccaggcaagaagtacaagatccagatcctgactgtgtctgggggcctcttcagcaaggaggcccagacagagggccgcacagtgcctgctgctgtgacagacctgcgcatcacagagaacagcaccaggcacctgtccttccgctggacagccagcgagggggagctgtcctggtacaacatcttcctgtacaacccagatggcaacctgcaggagcgggcccaggtggaccccctggtgcagagcttctccttccagaacctgctgcagggccgcatgtacaagatggtgattgtgacccacagcggggagctgagcaatgaaagcttcatcttcggccgcacagtgcctgcctctgtgagccacctgcggggcagcaacagaaacaccacagacagcctgtggttcaactggagccctgccagcggggactttgacttctatgagctgatcctgtacaaccccaacggcaccaagaaggagaactggaaggacaaggacctgacagagtggaggttccagggcctggtgcccggcaggaaatatgtgctgtgggtggtgacccacagcggggacctgagcaacaaggtgacagctgagagcaggacagcccccagcccccccagcctgatgagctttgctgacatcgccaacaccagcctggccatcacctggaagggccccccagactggacagactacaatgactttgagctgcagtggctgcccagagatgccctgaccgtcttcaacccctacaacaacaggaagtctgagggccgcatcgtgtatggcctgcggcccggccgcagctaccagttcaacgtgaagacagtgtctggggacagctggaagacctacagcaagcccatcttcggctctgtgaggaccaagccagacaagatccagaacctgcactgccggccccagaacagcacagccatcgcctgctcctggatccccccagacagcgactttgatggctacagcattgagtgcaggaagatggacacccaggaggtggagttcagcaggaagctggagaaggagaagagcctgctgaacatcatgatgctggtgccccacaagcgctacctggtgtccatcaaggtgcagagcgctggcatgaccagcgaggtggtggaggacagcaccatcaccatgattgaccggcccccacctcctccaccccacatccgggtgaatgagaaggatgtgctgatcagcaagagcagcatcaacttcaccgtgaactgctcctggttcagtgacaccaacggggctgtgaagtacttcaccgtggtggtgcgggaggctgatggaaatgatgagctgaagccagagcagcagcaccccctgcccagctacctggagtaccgccacaatgccagcatccgggtgtaccagaccaactactttgccagcaaatgtgccgagaaccccaacagcaacagcaagagcttcaacatcaagctgggcgctgagatggagagcctgggcggcaaatgtgaccccacccagcagaagttctgtgatggccccctgaagccccacacagcctaccgcatcagcatccgggccttcacccagctgtttgatgaggacctgaaggagttcaccaagcccctgtacagcgacaccttcttcagcctgcccatcaccacagaaagtgagcccctgtttggagccatcgagggcgtgtctgctggcctcttcctgattggcatgctggtggccgtggtggccctgctgatctgccggcagaaggtgagccacggccgggagcggcccagcgcccggctgagcatccggcgggaccggcccctgtctgtgcacctgaacctgggccagaagggcaacaggaagaccagctgccccatcaagatcaaccagtttgagggccacttcatgaagctgcaggccgacagcaactacctgctgagcaaggagtatgaggagctgaaggatgtgggcaggaaccagagctgtgacatcgccctgctgcctgagaacagaggcaagaaccgctacaacaacatcctgccctatgatgccaccagggtgaagctgagcaatgtggatgatgacccctgcagcgactacatcaatgccagctacatccctggcaacaacttcagaagagagtacatcgtgacccagggccccctgcccggcaccaaggatgacttctggaagatggtgtgggagcagaatgtgcacaacatcgtgatggtgacccagtgtgtggagaagggccgggtgaagtgtgaccactactggccagctgaccaggacagcctgtactatggagacctgatcctgcagatgctgtctgagagcgtgctgcctgagtggaccatccgggagttcaagatctgtggggaggagcagctggatgcccacaggctcatccgccacttccactacacagtgtggccagaccatggagtgcctgagaccacccagagcctcatccagtttgtgaggacagtgcgggactacatcaacagaagccctggagctggccccaccgtggtgcactgcagcgctggggtgggccgcacaggcaccttcatcgccctggaccgcatcctgcagcagctggacagcaaggacagcgtggacatctatggagctgtgcatgacctgcggctgcaccgggtgcacatggtgcagacagagtgccagtatgtgtacctgcaccagtgtgtgagagatgtgctgcgggccaggaagctgcggtctgagcaggagaaccccctcttccccatctatgaaaatgtgaaccctgagtaccaccgggaccctgtgtacagccgccactag

SEQ ID NO: 166309 - DNA, 2760 bp, Artificial Sequence
  Description of Artificial Sequence: Synthetic coding sequence
atggaggccgagttctacatggtgatcctgacctgcctgatcttcaggaacagcgagggcttccagatcgtgcacgtgcagaagcagcagtgcctcttcaagaatgagaaggtggtggtgggcagctgcaacagaaccatccagaaccagcagtggatgtggacagaagatgagaagctgctgcacgtgaagagcgccctgtgcctggccatcagcaacagcagccggggccccagccgcagcgccatcctggaccgctgcagccaggccccccgctggacctgctatgaccaggagggcttcctggaggtggagaatgccagcctcttcctgcagaagcagggcagccgggtggtggtgaagaaggccaggaagtacctgcacagctggatgaagattgatgtgaacaaggagggcaagctggtgaatgaaagcctgtgcctgcagaaggccggcctgggcgctgaggtgtctgtgcgcagcaccaggaacacagccccaccccagatcctgaccaccttcaatgctgtgcctgatggcctggtgttcctgatccggaacaccacagaggccttcatcagaaatgctgctgagaactacagccagaacagcagcgagcggcagcaccccaacctgcacatgacaggcatcacagacacctcctgggtgctgagcaccacccagcccttcagcagcaccacagaggagaccggcctggccgagcctgagcgctgcaacttcaccctggccgagagcaaggccagcagccacagcgtgtccatccagtggaggatcctgggcagcccctgcaacttcagcctcatctacagcagtgacaccctgggcgccgccctgtgccccaccttcagaattgacaacaccacctacggctgcaacctgcaggacctgcaggccggcaccatctacaacttccgcatcatcagcctggatgaggagaggacagtggtgctgcagacagaccccctgcccccagcccgcttcggcgtgtccaaggagaagaccaccagcaccagcctgcacgtgtggtggacccccagcagcggcaaggtgaccagctatgaggtgcagctgtttgatgagaacaaccagaagatccagggcgtgcagatccaggagagcacctcctggaatgagtacaccttcttcaacctgacagctggcagcaagtacaacatcgccatcacagctgtgtctgggggcaagaggagcttctctgtgtacaccaacggcagcacagtgcccagccctgtgaaggacatcggcatcagcaccaaggccaacagcctgctgatctcctggagccacggcagcggaaatgtggagcgctaccgcctgatgctgatggacaagggcatcctggtgcacggcggcgtggtggacaagcacgccaccagctatgccttccacggcctgaccccaggctacctgtacaacctgactgtgatgacagaggccgccggcctgcagaactaccgctggaagctggtgaggacagcccccatggaggtgagcaacctgaaggtgaccaatgatggcagcctgaccagcctgaaggtgaagtggcagaggcctcctggaaatgtggacagctacaacatcaccctgagccacaagggcaccatcaaggagagccgggtgctggccccctggatcacagagacccacttcaaggagctggtgcccggccgcctgtaccaggtgacagtgtcctgtgtgtctggagagctgagcgcccagaagatggctgtgggccgcaccttcccagacaaggtggccaacctggaggccaacaacaacggccgcatgaggagcctggtggtgtcctggagccccccagctggggactgggagcagtaccgcatcctgctcttcaatgacagcgtggtgctgctgaacatcaccgtgggcaaggaggagacccagtatgtgatggatgacaccggcctggtgcccggccggcagtatgaggtggaggtgattgtggagagcggcaacctgaagaacagcgagcgctgccagggccgcacagtgcccctggccgtgctgcagctgcgggtgaagcacgccaatgagaccagcctgagcatcatgtggcagacccctgtggccgagtgggagaagtacatcatcagcctggccgaccgggacctgctgctgatccacaagagcctgagcaaggatgccaaggagttcaccttcacagacctggtgcccggcaggaagtacatggccaccgtgaccagcatcagcggggacctgaagaacagcagctctgtgaagggccgcacagtgcctgcccaggtgacagacctgcacgtggccaaccagggcatgaccagcagcctcttcaccaactggacccaggcccagggagatgtggagttctaccaggtgctgctgattcatgaaaatgtggtgatcaagaatgaaagcatcagcagcgagaccagccgctacagcttccacagcctgaagagcggcagcctgtacagcgtggtggtgaccaccgtgtctgggggcatcagcagccggcaggtggtggtggagggccgcacagtgcctgacaaggtgcagggcgtgtctgtgagcaacagcgcccggagtgactacctgcgggtgtcctgggtgcacgccaccggggactttgaccactatgaggtgaccatcaagaacaagaacaacttcatccagaccaaggccttccccagccagaagaccaacgtgtacctgttctcctag

SEQ ID NO: 166310 - DNA, 5724 bp, Artificial Sequence
  Description of Artificial Sequence: Synthetic coding sequence
atgctgagccacggggccggcctggccctgtggatcaccctgagcctgctgcagacaggcctggccgagcctgagcgctgcaacttcaccctggccgagagcaaggccagcagccacagcgtgtccatccagtggaggatcctgggcagcccctgcaacttcagcctcatctacagcagtgacaccctgggcgccgccctgtgccccaccttcagaattgacaacaccacctacggctgcaacctgcaggacctgcaggccggcaccatctacaacttccgcatcatcagcctggatgaggagaggacagtggtgctgcagacagaccccctgcccccagcccgcttcggcgtgtccaaggagaagaccaccagcaccagcctgcacgtgtggtggacccccagcagcggcaaggtgaccagctatgaggtgcagctgtttgatgagaacaaccagaagatccagggcgtgcagatccaggagagcacctcctggaatgagtacaccttcttcaacctgacagctggcagcaagtacaacatcgccatcacagctgtgtctgggggcaagaggagcttctctgtgtacaccaacggcagcacagtgcccagccctgtgaaggacatcggcatcagcaccaaggccaacagcctgctgatctcctggagccacggcagcggaaatgtggagcgctaccgcctgatgctgatggacaagggcatcctggtgcacggcggcgtggtggacaagcacgccaccagctatgccttccacggcctgaccccaggctacctgtacaacctgactgtgatgacagaggccgccggcctgcagaactaccgctggaagctggtgaggacagcccccatggaggtgagcaacctgaaggtgaccaatgatggcagcctgaccagcctgaaggtgaagtggcagaggcctcctggaaatgtggacagctacaacatcaccctgagccacaagggcaccatcaaggagagccgggtgctggccccctggatcacagagacccacttcaaggagctggtgcccggccgcctgtaccaggtgacagtgtcctgtgtgtctggagagctgagcgcccagaagatggctgtgggccgcaccttccccctggccgtgctgcagctgcgggtgaagcacgccaatgagaccagcctgagcatcatgtggcagacccctgtggccgagtgggagaagtacatcatcagcctggccgaccgggacctgctgctgatccacaagagcctgagcaaggatgccaaggagttcaccttcacagacctggtgcccggcaggaagtacatggccaccgtgaccagcatcagcggggacctgaagaacagcagctctgtgaagggccgcacagtgcctgcccaggtgacagacctgcacgtggccaaccagggcatgaccagcagcctcttcaccaactggacccaggcccagggagatgtggagttctaccaggtgctgctgattcatgaaaatgtggtgatcaagaatgaaagcatcagcagcgagaccagccgctacagcttccacagcctgaagagcggcagcctgtacagcgtggtggtgaccaccgtgtctgggggcatcagcagccggcaggtggtggtggagggccgcacagtgcccagctctgtgtctggagtgacagtgaacaacagcggcagaaatgactacctgtctgtgtcctggctgctggcccctggagatgtggacaactatgaggtgaccctgagccatgatggcaaggtggtgcagagcctggtgattgccaagtctgtgcgggagtgcagcttcagcagcctgaccccaggccgcctgtacacagtgaccatcaccaccaggtctgggaagtatgagaaccacagcttcagccaggagaggacagtgcctgacaaggtgcagggcgtgtctgtgagcaacagcgcccggagtgactacctgcgggtgtcctgggtgcacgccaccggggactttgaccactatgaggtgaccatcaagaacaagaacaacttcatccagaccaagagcatccccaagtcagaaaatgaatgtgtgtttgtgcagctggtgcccggccgcctgtacagcgtgacagtgaccaccaagagcggccagtatgaggccaatgagcagggcaatggccgcaccatccctgagcctgtgaaggacctgaccctgaggaacagaagcacagaggacctgcacgtgacctggagcggggccaatggagatgtggaccagtatgagatccagctgctcttcaatgacatgaaggtgttcccccccttccacctggtgaacacagccacagagtaccgcttcaccagcctgaccccaggccggcagtacaagatcctggtgctgaccatctctggagatgtgcagcagagcgccttcatcgagggcttcaccgtgcccagcgctgtgaagaacatccacatcagccccaacggggccacagacagcctgactgtgaactggaccccaggaggaggagatgtggacagctacacagtgtctgccttccgccacagccagaaggtggacagccagaccatccccaagcacgtgtttgagcacaccttccaccggctggaggccggggagcagtaccagatcatgattgcctctgtgtctggcagcctgaagaaccagatcaacgtggtgggccgcacagtgcctgcctctgtgcagggcgtgattgctgacaatgcctacagcagctacagcctgattgtgtcctggcagaaggccgccggcgtggccgagagatatgacatcctgctgctgacagaaaatggcatcctgctgaggaacaccagcgagcccgccaccaccaagcagcacaagtttgaggacctgaccccaggcaagaagtacaagatccagatcctgactgtgtctgggggcctcttcagcaaggaggcccagacagagggccgcacagtgcctgctgctgtgacagacctgcgcatcacagagaacagcaccaggcacctgtccttccgctggacagccagcgagggggagctgtcctggtacaacatcttcctgtacaacccagatggcaacctgcaggagcgggcccaggtggaccccctggtgcagagcttctccttccagaacctgctgcagggccgcatgtacaagatggtgattgtgacccacagcggggagctgagcaatgaaagcttcatcttcggccgcacagtgcctgcctctgtgagccacctgcggggcagcaacagaaacaccacagacagcctgtggttcaactggagccctgccagcggggactttgacttctatgagctgatcctgtacaaccccaacggcaccaagaaggagaactggaaggacaaggacctgacagagtggaggttccagggcctggtgcccggcaggaaatatgtgctgtgggtggtgacccacagcggggacctgagcaacaaggtgacagctgagagcaggacagcccccagcccccccagcctgatgagctttgctgacatcgccaacaccagcctggccatcacctggaagggccccccagactggacagactacaatgactttgagctgcagtggctgcccagagatgccctgaccgtcttcaacccctacaacaacaggaagtctgagggccgcatcgtgtatggcctgcggcccggccgcagctaccagttcaacgtgaagacagtgtctggggacagctggaagacctacagcaagcccatcttcggctctgtgaggaccaagccagacaagatccagaacctgcactgccggccccagaacagcacagccatcgcctgctcctggatccccccagacagcgactttgatggctacagcattgagtgcaggaagatggacacccaggaggtggagttcagcaggaagctggagaaggagaagagcctgctgaacatcatgatgctggtgccccacaagcgctacctggtgtccatcaaggtgcagagcgctggcatgaccagcgaggtggtggaggacagcaccatcaccatgattgaccggcccccacctcctccaccccacatccgggtgaatgagaaggatgtgctgatcagcaagagcagcatcaacttcaccgtgaactgctcctggttcagtgacaccaacggggctgtgaagtacttcaccgtggtggtgcgggaggctgatggcagtgatgagctgaagccagagcagcagcaccccctgcccagctacctggagtaccgccacaatgccagcatccgggtgtaccagaccaactactttgccagcaaatgtgccgagaaccccaacagcaacagcaagagcttcaacatcaagctgggcgctgagatggagagcctgggcggcaaatgtgaccccacccagcagaagttctgtgatggccccctgaagccccacacagcctaccgcatcagcatccgggccttcacccagctgtttgatgaggacctgaaggagttcaccaagcccctgtacagcgacaccttcttcagcctgcccatcaccacagaaagtgagcccctgtttggagccatcgagggcgtgtctgctggcctcttcctgattggcatgctggtggccgtggtggccctgctgatctgccggcagaaggtgagccacggccgggagcggcccagcgcccggctgagcatccggcgggaccggcccctgtctgtgcacctgaacctgggccagaagggcaacaggaagaccagctgccccatcaagatcaaccagtttgagggccacttcatgaagctgcaggccgacagcaactacctgctgagcaaggagtatgaggagctgaaggatgtgggcaggaaccagagctgtgacatcgccctgctgcctgagaacagaggcaagaaccgctacaacaacatcctgccctatgatgccaccagggtgaagctgagcaatgtggatgatgacccctgcagcgactacatcaatgccagctacatccctggcaacaacttcagaagagagtacatcgtgacccagggccccctgcccggcaccaaggatgacttctggaagatggtgtgggagcagaatgtgcacaacatcgtgatggtgacccagtgtgtggagaagggccgggtgaagtgtgaccactactggccagctgaccaggacagcctgtactatggagacctgatcctgcagatgctgtctgagagcgtgctgcctgagtggaccatccgggagttcaagatctgtggggaggagcagctggatgcccacaggctcatccgccacttccactacacagtgtggccagaccatggagtgcctgagaccacccagagcctcatccagtttgtgaggacagtgcgggactacatcaacagaagccctggagctggccccaccgtggtgcactgcagcgctggggtgggccgcacaggcaccttcatcgccctggaccgcatcctgcagcagctggacagcaaggacagcgtggacatctatggagctgtgcatgacctgcggctgcaccgggtgcacatggtgcagacagagtgccagtatgtgtacctgcaccagtgtgtgagagatgtgctgcgggccaggaagctgcggtctgagcaggagaaccccctcttccccatctatgaaaatgtgaaccctgagtaccaccgggaccctgtgtacagccgccactag

SEQ ID NO: 166311 - DNA, 621 bp, Artificial Sequence
  Description of Artificial Sequence: Synthetic coding sequence
atggccctgccctgcaccctgggcctgggcatgctgctggccctgcccggggccctgggcagcggcggcagcgctgaggacagcgtgggcagcagctctgtgacagtggtgctgctgctgctgctgctgctgctgctggccaccggcctggccctggcctggaggcggctgagccgggacagcggcggctactaccacccagcccggctgggcgccgccctgtggggccgcacccggcggctgctgtgggccagccccccaggccgctggctgcaggcccgggcagagctgggcagcacagacaatgacctggagcggcaggaggatgagcaggacacagattatgaccacgtggctgatggcggcctgcaggccgaccctggagagggggagcagcagtgtggggaggccagcagccctgagcaggtgcctgtgcgggcagaggaggcccgggacagcgacacagaaggagacctggtgctgggcagccctggccctgccagcgctgggggcagcgctgaggccctgctgagtgacctgcacgcctttgctggcagcgctgcctgggatgacagcgcccgggccgccggcggccagggcctgcacgtgacagccctgtag

SEQ ID NO: 166312 - DNA, 4152 bp, Artificial Sequence
  Description of Artificial Sequence: Synthetic coding sequence
atggtgcacgtggcccggctgctgctgctgctgctgaccttcttcctgaggacagatgctgagaccccaccccgcttcaccaggacccctgtggaccagacaggagtgtctggaggagtggccagcttcatctgccaggccaccggggacccccggcccaagatcgtgtggaacaagaagggcaagaaggtgagcaaccagagatttgaagtcatcgagtttgatgatggcagcggctctgtgctgcgcatccagcccctgcggaccccaagagatgaggccatctatgaatgtgtggccagcaacaacgtgggggagatctctgtgtccacccggctgactgtgctgcgggaggaccagatcccccggggcttccccaccatcgacatgggcccccagctgaaggtggtggagaggaccaggacagccaccatgctgtgtgccgccagcggcaacccagaccctgagatcacctggttcaaggacttcctgcctgtggacaccagcaacaacaacggccgcatcaagcagctgcggtctgtgtctgtgtgtgccacctaccacactggagccctgcagatcgagcagagcgaggagagtgaccagggcaagtatgaatgtgtggccaccaacagcgctggcacccgctacagcgccccagccaacctgtatgtgcgggtgaacaggaaggtgcggcgggtgcccccacgcttcagcatcccccccaccaaccacgagatcatgcctgggggctctgtgaacatcacctgtgtggccgtgggcagccccatgccctacgtgaagtggatgctgggcgctgaggacctgaccccagaagatgacatgcccatcggcagaaatgtgctggagctgaatgatgtgcggcagagcgccaactacacctgtgtggccatgagcaccctgggcgtgattgaggccatcgcccagatcaccgtgaaggccctgcccaagcccccaggcacccctgtggtgacagagagcacagccaccagcatcaccctgacctgggacagcggcaaccctgagcctgtgtcctactacatcatccagcacaagcccaagaacagcgaggagctgtacaaggagattgatggagtggccaccacccgctacagcgtggccggcctgagcccctacagcgactatgagttccgggtggtggccgtgaacaacatcggccggggccccccatctgagcctgtgctgacccagaccagcgagcaggcccccagcagcgcccccagagatgtgcaggccaggatgctgagcagcaccaccatcctggtgcagtggaaggagcctgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcattggagatggccccctgagcagtgacatccaggtgatcacccagacaggagtgcccggccagcccctgaacttcaaggccgagcctgagagcgagaccagcatcctgctgtcctggaccccacccaggagtgacaccatcgccaactatgagctggtgtacaaggatggagagcacggggaggagcagaggatcaccatcgagcccggcaccagctaccgcctgcagggcctgaagcccaacagcctgtactacttccggctggccgcccggagcccccagggcctgggcgccagcacagctgagatcagcgcccggaccatgcagagcagcaagggctactacatcatcatcgtgcccctgaagaagagccggggcaagttcatcaagccctgggagagcccagatgagatggagctggatgagctgctgaaggagatcagcaggaagaggaggagcatccgctatggccgggaggtggagctgaagccctacatcgccgcccactttgatgtgctgcccacagagttcaccctgggagatgacaagcactacggcggcttcaccaacaagcagctgcagagcggccaggagtatgtgttctttgtgctggccgtgatggagcacgccgagagcaagatgtatgccaccagcccctacagcgaccctgtggtgtccatggacctggacccccagcccatcacagatgaggaggagggcctcatctgggtggtgggccctgtgctggccgtggtgttcatcatctgcatcgtcatcgccatcctgctgtacaagaggaagagagctgagagtgacagcaggaagagcagcatccccaacaacaaggagatccccagccaccaccccacagatcctgtggagctgcggcggctgaacttccagaccccaggcatggccagccacccccccatccccatcctggagctggccgaccacatcgagcggctgaaggccaatgacaacctgaagttcagccaggagtatgagagcattgatcctggccagcagttcacctgggagcacagcaacctggaggtgaacaagcccaagaacagatatgccaacgtgattgcctatgaccacagccgggtgctgctgagcgccatcgagggcatccctggcagtgactatgtgaatgccaactacattgatggctacaggaagcagaatgcctacatcgccacccagggcagcctgcctgagacctttggagacttctggaggatgatctgggagcagaggtctgccaccgtggtgatgatgaccaagctggaggagaggagccgggtgaagtgtgaccagtactggcccagccggggcacagagacccacggcctggtgcaggtgaccctgctggacacagtggagctggccacctactgtgtgaggacctttgccctgtacaagaatggcagcagcgagaagcgggaggtgcggcagttccagttcaccgcctggccagaccatggagtgcctgagcaccccacccccttcctggccttcctgcggcgggtgaagacctgcaaccccccagatgctggccccatggtggtgcactgcagcgctggggtgggccgcacaggctgcttcatcgtgattgatgccatgctggagcgcatcaagcatgagaagacagtggacatctacggccacgtgaccctgatgagggcccagaggaactacatggtgcagacagaggaccagtacatcttcatccatgatgccctgctggaggccgtgacctgtggcaacacagaggtgcctgccaggaacctgtatgcctacatccagaagctgacccagatcgagaccggggagaatgtgacaggcatggagctggagttcaagaggctggccagcagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagcacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagtctggagagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgaaggagtggtggacatcttccagacagtgaagatgctgcggacccagaggcctgccatggtgcagacagaggaccagtaccagttctcctaccgggccgccctggagtacctgggcagctttgaccactacgccacctag

SEQ ID NO: 166313 - DNA, 4521 bp, Artificial Sequence
  Description of Artificial Sequence: Synthetic coding sequence
atggtgcacgtggcccggctgctgctgctgctgctgaccttcttcctgaggacagatgctgagaccccaccccgcttcaccaggacccctgtggaccagacaggagtgtctggaggagtggccagcttcatctgccaggccaccggggacccccggcccaagatcgtgtggaacaagaagggcaagaaggtgagcaaccagagatttgaagtcatcgagtttgatgatggcagcggctctgtgctgcgcatccagcccctgcggaccccaagagatgaggccatctatgaatgtgtggccagcaacaacgtgggggagatctctgtgtccacccggctgactgtgctgcgggaggaccagatcccccggggcttccccaccatcgacatgggcccccagctgaaggtggtggagaggaccaggacagccaccatgctgtgtgccgccagcggcaacccagaccctgagatcacctggttcaaggacttcctgcctgtggacaccagcaacaacaacggccgcatcaagcagctgcggtctgagagcattggaggcacccccatccggggggccctgcagatcgagcagagcgaggagagtgaccagggcaagtatgaatgtgtggccaccaacagcgctggcacccgctacagcgccccagccaacctgtatgtgcgggagctgcgggaggtgcggcgggtgcccccacgcttcagcatcccccccaccaaccacgagatcatgcctgggggctctgtgaacatcacctgtgtggccgtgggcagccccatgccctacgtgaagtggatgctgggcgctgaggacctgaccccagaagatgacatgcccatcggcagaaatgtgctggagctgaatgatgtgcggcagagcgccaactacacctgtgtggccatgagcaccctgggcgtgattgaggccatcgcccagatcaccgtgaaggccctgcccaagcccccaggcacccctgtggtgacagagagcacagccaccagcatcaccctgacctgggacagcggcaaccctgagcctgtgtcctactacatcatccagcacaagcccaagaacagcgaggagctgtacaaggagattgatggagtggccaccacccgctacagcgtggccggcctgagcccctacagcgactatgagttccgggtggtggccgtgaacaacatcggccggggccccccatctgagcctgtgctgacccagaccagcgagcaggcccccagcagcgcccccagagatgtgcaggccaggatgctgagcagcaccaccatcctggtgcagtggaaggagcctgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcattggagatggccccctgagcagtgacatccaggtgatcacccagacaggagtgcccggccagcccctgaacttcaaggccgagcctgagagcgagaccagcatcctgctgtcctggaccccacccaggagtgacaccatcgccaactatgagctggtgtacaaggatggagagcacggggaggagcagaggatcaccatcgagcccggcaccagctaccgcctgcagggcctgaagcccaacagcctgtactacttccggctggccgcccggagcccccagggcctgggcgccagcacagctgagatcagcgcccggaccatgcagagcatgtttgccaagaacttccacgtgaaggctgtgatgaagacctctgtgctgctgtcctgggagatccctgagaactacaacagcgccatgcccttcaagatcctgtatgatgatggcaagatggtggaggaggtggatggccgggccacccagaagctgattgtgaacctgaagccagagaagagctacagctttgtgctgaccaacagaggcaacagcgctgggggcctgcagcaccgggtgacagccaagacagccccagatgtgctgcggaccaagccagccttcatcggcaagaccaacctggatggcatgatcaccgtgcagctgcctgaggtgcctgccaatgaaaacatcaagggctactacatcatcatcgtgcccctgaagaagagccggggcaagttcatcaagccctgggagagcccagatgagatggagctggatgagctgctgaaggagatcagcaggaagaggaggagcatccgctatggccgggaggtggagctgaagccctacatcgccgcccactttgatgtgctgcccacagagttcaccctgggagatgacaagcactacggcggcttcaccaacaagcagctgcagagcggccaggagtatgtgttctttgtgctggccgtgatggagcacgccgagagcaagatgtatgccaccagcccctacagcgaccctgtggtgtccatggacctggacccccagcccatcacagatgaggaggagggcctcatctgggtggtgggccctgtgctggccgtggtgttcatcatctgcatcgtcatcgccatcctgctgtacaagagcagcaagccagacaggaagagagctgagagtgacagcaggaagagcagcatccccaacaacaaggagatccccagccaccaccccacagatcctgtggagctgcggcggctgaacttccagaccccaggcatggccagccacccccccatccccatcctggagctggccgaccacatcgagcggctgaaggccaatgacaacctgaagttcagccaggagtatgagagcattgaccccggccagcagttcacctgggagcacagcaacctggaggtgaacaagcccaagaacagatatgccaacgtcatcgcctatgaccacagccgggtgctgctgagcgccatcgagggcatccctggcagtgactatgtgaatgccaactacattgatggctacaggaagcagaatgcctacatcgccacccagggcagcctgcctgagaccttcggggacttctggaggatgatctgggagcagaggtctgccaccgtggtgatgatgaccaagctggaggagaggagccgggtgaagtgtgaccagtactggcccagccggggcacagagacccacggcctggtgcaggtgaccctgctggacacagtggagctggccacctactgtgtgaggacctttgccctgtacaagaatggcagcagcgagaagcgggaggtgcggcagttccagttcaccgcctggccagaccacggcgtgcctgagcaccccacccccttcctggccttcctgcggcgggtgaagacctgcaaccccccagatgctggccccatggtggtgcactgcagcgctggggtgggccgcacaggctgcttcatcgtgattgatgccatgctggagcgcatcaagcatgagaagacagtggacatctacggccacgtgaccctgatgagggcccagaggaactacatggtgcagacagaggaccagtacatcttcatccatgatgccctgctggaggccgtgacctgtggcaacacagaggtgcctgccaggaacctgtatgcctacatccagaagctgacccagattgaaacaggagaaaatgtgacaggcatggagctggagttcaagaggctggccagcagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagcacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagagcggggagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgagggcgtggtggacatcttccagacagtgaagatgctgcggacccagaggcctgccatggtgcagacagaggaccagtaccagttctcctacagagctgccctggagtacctgggcagctttgaccactacgccacctag

SEQ ID NO: 166314 - DNA, 5739 bp, Artificial Sequence
  Description of Artificial Sequence: Synthetic coding sequence
atggtgcacgtggcccggctgctgctgctgctgctgaccttcttcctgaggacagatgctgagaccccaccccgcttcaccaggacccctgtggaccagacaggagtgtctggaggagtggccagcttcatctgccaggccaccggggacccccggcccaagatcgtgtggaacaagaagggcaagaaggtgagcaaccagagatttgaagtcatcgagtttgatgatggcagcggctctgtgctgcgcatccagcccctgcggaccccaagagatgaggccatctatgaatgtgtggccagcaacaacgtgggggagatctctgtgtccacccggctgactgtgctgcgggaggaccagatcccccggggcttccccaccatcgacatgggcccccagctgaaggtggtggagaggaccaggacagccaccatgctgtgtgccgccagcggcaacccagaccctgagatcacctggttcaaggacttcctgcctgtggacaccagcaacaacaacggccgcatcaagcagctgcggtctgagagcattggaggcacccccatccggggggccctgcagatcgagcagagcgaggagagtgaccagggcaagtatgaatgtgtggccaccaacagcgctggcacccgctacagcgccccagccaacctgtatgtgcgggagctgcgggaggtgcggcgggtgcccccacgcttcagcatcccccccaccaaccacgagatcatgcctgggggctctgtgaacatcacctgtgtggccgtgggcagccccatgccctacgtgaagtggatgctgggcgctgaggacctgaccccagaagatgacatgcccatcggcagaaatgtgctggagctgaatgatgtgcggcagagcgccaactacacctgtgtggccatgagcaccctgggcgtgattgaggccatcgcccagatcaccgtgaaggccctgcccaagcccccaggcacccctgtggtgacagagagcacagccaccagcatcaccctgacctgggacagcggcaaccctgagcctgtgtcctactacatcatccagcacaagcccaagaacagcgaggagctgtacaaggagattgatggagtggccaccacccgctacagcgtggccggcctgagcccctacagcgactatgagttccgggtggtggccgtgaacaacatcggccggggccccccatctgagcctgtgctgacccagaccagcgagcaggcccccagcagcgcccccagagatgtgcaggccaggatgctgagcagcaccaccatcctggtgcagtggaaggagcctgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcattggagatggccccctgagcagtgacatccaggtgatcacccagacaggagtgcccggccagcccctgaacttcaaggccgagcctgagagcgagaccagcatcctgctgtcctggaccccacccaggagtgacaccatcgccaactatgagctggtgtacaaggatggagagcacggggaggagcagaggatcaccatcgagcccggcaccagctaccgcctgcagggcctgaagcccaacagcctgtactacttccggctggccgcccggagcccccagggcctgggcgccagcacagctgagatcagcgcccggaccatgcagagcaagcccagcgccccaccccaggacatcagctgcaccagccccagcagcaccagcatcctggtgtcctggcagcccccacctgtggagaagcagaatggcatcatcacagagtacagcatcaagtacacagctgtggatggagaagatgacaagccccatgagatcctgggcatccccagcgacaccaccaagtacctgctggagcagctggagaagtggacagagtaccgcatcaccgtgacagcccacacagatgtgggccctggccctgagagcctgtctgtgctgatccgcaccaatgaagatgtgcccagcggcccccccaggaaggtggaggtggaggccgtgaacagcacctctgtgaaggtgtcctggaggagccctgtgcccaacaagcagcacggccagatccggggctaccaggtgcactacgtgaggatggagaatggagagcccaagggccagcccatgctgaaggatgtgatgctggctgatgcccagtgggagtttgatgacaccacagaacatgacatgatcatcagcggcctgcagcctgagaccagctacagcctgactgtgacagcctacaccaccaagggagatggagcccggagcaagcccaagctggtgtccaccaccggggctgtgcctgggaagccccggctggtgatcaaccacacccagatgaacacagccctgatccagtggcacccccctgtggacaccttcggccccctgcagggctaccgcctgaagtttggaaggaaggacatggagcccctgaccaccctggagttcagcgagaaggaggaccacttcaccgccacagacatccacaagggggccagctatgtgttccggctgagcgccaggaacaaggtgggctttggagaggagatggtgaaggagatcagcatccctgaggaggtgcccaccggcttcccccagaacctgcacagcgagggcaccaccagcacctctgtgcagctgtcctggcagccccctgtgctggccgagagaaatggcatcatcaccaagtacaccctgctgtacagagacatcaacatccccctgctgcccatggagcagctgattgtgcctgctgacaccaccatgaccctgaccggcctgaagccagacaccacctatgatgtgaaggtgcgggcccacaccagcaagggccctggcccctacagccccagcgtgcagttccgcaccctgcctgtggaccaggtgtttgccaagaacttccacgtgaaggctgtgatgaagacctctgtgctgctgtcctgggagatccctgagaactacaacagcgccatgcccttcaagatcctgtatgatgatggcaagatggtggaggaggtggatggccgggccacccagaagctgattgtgaacctgaagccagagaagagctacagctttgtgctgaccaacagaggcaacagcgctgggggcctgcagcaccgggtgacagccaagacagccccagatgtgctgcggaccaagccagccttcatcggcaagaccaacctggatggcatgatcaccgtgcagctgcctgaggtgcctgccaatgaaaacatcaagggctactacatcatcatcgtgcccctgaagaagagccggggcaagttcatcaagccctgggagagcccagatgagatggagctggatgagctgctgaaggagatcagcaggaagagaagaagcatccgctatggccgggaggtggagctgaagccctacatcgccgcccactttgatgtgctgcccacagagttcaccctgggagatgacaagcactatggaggcttcaccaacaagcagctgcagagcggccaggagtatgtgttctttgtgctggccgtgatggagcacgccgagagcaagatgtatgccaccagcccctacagcgaccctgtggtgtccatggacctggacccccagcccatcacagatgaggaggagggcctcatctgggtggtgggccctgtgctggccgtggtgttcatcatctgcatcgtgattgccatcctgctgtacaagaggaagagagctgagagtgacagcaggaagagcagcatccccaacaacaaggagatccccagccaccaccccacagatcctgtggagctgcggcggctgaacttccagaccccaggcatggccagccacccccccatccccatcctggagctggccgaccacatcgagcggctgaaggccaatgacaacctgaagttcagccaggagtatgagagcattgaccccggccagcagttcacctgggagcacagcaacctggaggtgaacaagcccaagaacagatatgccaacgtcatcgcctatgaccacagccgggtgctgctgagcgccatcgagggcatccctggcagtgactatgtgaatgccaactacattgatggctacaggaagcagaatgcctacatcgccacccagggcagcctgcctgagaccttcggggacttctggaggatgatctgggagcagaggtctgccaccgtggtgatgatgaccaagctggaggagaggagccgggtgaagtgtgaccagtactggcccagccggggcacagagacccacggcctggtgcaggtgaccctgctggacacagtggagctggccacctactgtgtgaggacctttgccctgtacaagaatggcagcagcgagaagcgggaggtgcggcagttccagttcaccgcctggccagaccacggcgtgcctgagcaccccacccccttcctggccttcctgcggcgggtgaagacctgcaaccccccagatgctggccccatggtggtgcactgcagcgctggggtgggccgcacaggctgcttcatcgtgattgatgccatgctggagcgcatcaagcatgagaagacagtggacatctacggccacgtgaccctgatgagggcccagaggaactacatggtgcagacagaggaccagtacatcttcatccatgatgccctgctggaggccgtgacctgtggcaacacagaggtgcctgccaggaacctgtatgcctacatccagaagctgacccagattgaaacaggagaaaatgtgacaggcatggagctggagttcaagaggctggccagcagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagcacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagagcggggagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgagggcgtggtggacatcttccagacagtgaagatgctgcggacccagaggcctgccatggtgcagacagaggaccagtaccagttctcctacagagctgccctggagtacctgggcagctttgaccactacgccacctag

SEQ ID NO: 166315 - DNA, 5673 bp, Artificial Sequence
  Description of Artificial Sequence: Synthetic coding sequence
atggtgcacgtggcccggctgctgctgctgctgctgaccttcttcctgaggacagatgctgagaccccaccccgcttcaccaggacccctgtggaccagacaggagtgtctggaggagtggccagcttcatctgccaggccaccggggacccccggcccaagatcgtgtggaacaagaagggcaagaaggtgagcaaccagagatttgaagtcatcgagtttgatgatggcagcggctctgtgctgcgcatccagcccctgcggaccccaagagatgaggccatctatgaatgtgtggccagcaacaacgtgggggagatctctgtgtccacccggctgactgtgctgcgggaggaccagatcccccggggcttccccaccatcgacatgggcccccagctgaaggtggtggagaggaccaggacagccaccatgctgtgtgccgccagcggcaacccagaccctgagatcacctggttcaaggacttcctgcctgtggacaccagcaacaacaacggccgcatcaagcagctgcggagcggggccctgcagatcgagcagagcgaggagagtgaccagggcaagtatgaatgtgtggccaccaacagcgctggcacccgctacagcgccccagccaacctgtatgtgcgggtgagaagagtgcccccacgcttcagcatcccccccaccaaccacgagatcatgcctgggggctctgtgaacatcacctgtgtggccgtgggcagccccatgccctacgtgaagtggatgctgggcgctgaggacctgaccccagaagatgacatgcccatcggcagaaatgtgctggagctgaatgatgtgcggcagagcgccaactacacctgtgtggccatgagcaccctgggcgtcatcgaggccatcgcccagatcaccgtgaaggccctgcccaagcccccaggcacccctgtggtgacagagagcacagccaccagcatcaccctgacctgggacagcggcaaccctgagcctgtgtcctactacatcatccagcacaagcccaagaacagcgaggagctgtacaaggagattgatggagtggccaccacccgctacagcgtggccggcctgagcccctacagcgactatgagttccgggtggtggccgtgaacaacatcggccggggcccccccagcgagcctgtgctgacccagaccagcgagcaggcccccagcagcgcccccagagatgtgcaggccaggatgctgagcagcaccaccatcctggtgcagtggaaggagcctgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcattggagatggccccctgagcagtgacatccaggtgatcacccagacaggagtgcccggccagcccctgaacttcaaggccgagcctgagagcgagaccagcatcctgctgtcctggaccccacccaggagtgacaccatcgccaactatgagctggtgtacaaggatggagaacatggagaggagcagaggatcaccatcgagcccggcaccagctaccgcctgcagggcctgaagcccaacagcctgtactacttccggctggccgcccggagcccccagggcctgggcgccagcacagctgagatcagcgcccggaccatgcagagcaagcccagcgccccaccccaggacatcagctgcaccagccccagcagcaccagcatcctggtgtcctggcagcccccacctgtggagaagcagaatggcatcatcacagagtacagcatcaagtacacagctgtggatggagaagatgacaagccccatgagatcctgggcatccccagcgacaccaccaagtacctgctggagcagctggagaagtggacagagtaccgcatcaccgtgacagcccacacagatgtgggccctggccctgagagcctgtctgtgctgatccgcaccaatgaagatgtgcccagcggcccccccaggaaggtggaggtggaggccgtgaacagcacctctgtgaaggtgtcctggaggagccctgtgcccaacaagcagcacggccagatccggggctaccaggtgcactacgtgaggatggagaatggagagcccaagggccagcccatgctgaaggatgtgatgctggctgatgcccaggacatgatcatcagcggcctgcagcctgagaccagctacagcctgactgtgacagcctacaccaccaagggagatggagcccggagcaagcccaagctggtgtccaccaccggggctgtgcctgggaagccccggctggtgatcaaccacacccagatgaacacagccctgatccagtggcacccccctgtggacaccttcggccccctgcagggctaccgcctgaagtttggaaggaaggacatggagcccctgaccaccctggagttcagcgagaaggaggaccacttcaccgccacagacatccacaagggggccagctatgtgttccggctgagcgccaggaacaaggtgggctttggagaggagatggtgaaggagatcagcatccctgaggaggtgcccaccggcttcccccagaacctgcacagcgagggcaccaccagcacctctgtgcagctgtcctggcagccccctgtgctggccgagagaaatggcatcatcaccaagtacaccctgctgtacagagacatcaacatccccctgctgcccatggagcagctgattgtgcctgctgacaccaccatgaccctgaccggcctgaagccagacaccacctatgatgtgaaggtgcgggcccacaccagcaagggccctggcccctacagccccagcgtgcagttccgcaccctgcctgtggaccaggtgtttgccaagaacttccacgtgaaggctgtgatgaagacctctgtgctgctgtcctgggagatccctgagaactacaacagcgccatgcccttcaagatcctgtatgatgatggcaagatggtggaggaggtggatggccgggccacccagaagctgattgtgaacctgaagccagagaagagctacagctttgtgctgaccaacagaggcaacagcgctgggggcctgcagcaccgggtgacagccaagacagccccagatgtgctgcggaccaagccagccttcatcggcaagaccaacctggatggcatgatcaccgtgcagctgcctgaggtgcctgccaatgaaaacatcaagggctactacatcatcatcgtgcccctgaagaagagccggggcaagttcatcaagccctgggagagcccagatgagatggagctggatgagctgctgaaggagatcagcaggaagagaagaagcatccgctatggccgggaggtggagctgaagccctacatcgccgcccactttgatgtgctgcccacagagttcaccctgggagatgacaagcactatggaggcttcaccaacaagcagctgcagagcggccaggagtatgtgttctttgtgctggccgtgatggagcacgccgagagcaagatgtatgccaccagcccctacagcgaccctgtggtgtccatggacctggacccccagcccatcacagatgaggaggagggcctcatctgggtggtgggccctgtgctggccgtggtgttcatcatctgcatcgtgattgccatcctgctgtacaagaggaagagagctgagagtgacagcaggaagagcagcatccccaacaacaaggagatccccagccaccaccccacagatcctgtggagctgcggcggctgaacttccagaccccaggcatggccagccacccccccatccccatcctggagctggccgaccacatcgagcggctgaaggccaatgacaacctgaagttcagccaggagtatgagagcattgaccccggccagcagttcacctgggagcacagcaacctggaggtgaacaagcccaagaacagatatgccaacgtcatcgcctatgaccacagccgggtgctgctgagcgccatcgagggcatccctggcagtgactatgtgaatgccaactacattgatggctacaggaagcagaatgcctacatcgccacccagggcagcctgcctgagaccttcggggacttctggaggatgatctgggagcagaggtctgccaccgtggtgatgatgaccaagctggaggagaggagccgggtgaagtgtgaccagtactggcccagccggggcacagagacccacggcctggtgcaggtgaccctgctggacacagtggagctggccacctactgtgtgaggacctttgccctgtacaagaatggcagcagcgagaagcgggaggtgcggcagttccagttcaccgcctggccagaccacggcgtgcctgagcaccccacccccttcctggccttcctgcggcgggtgaagacctgcaaccccccagatgctggccccatggtggtgcactgcagcgctggggtgggccgcacaggctgcttcatcgtgattgatgccatgctggagcgcatcaagcatgagaagacagtggacatctacggccacgtgaccctgatgagggcccagaggaactacatggtgcagacagaggaccagtacatcttcatccatgatgccctgctggaggccgtgacctgtggcaacacagaggtgcctgccaggaacctgtatgcctacatccagaagctgacccagattgaaacaggagaaaatgtgacaggcatggagctggagttcaagaggctggccagcagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagcacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagagcggggagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgagggcgtggtggacatcttccagacagtgaagatgctgcggacccagaggcctgccatggtgcagacagaggaccagtaccagttctcctacagagctgccctggagtacctgggcagctttgaccactacgccacctag

SEQ ID NO: 166316 - DNA, 5700 bp, Artificial Sequence
  Description of Artificial Sequence: Synthetic coding sequence
atggtgcacgtggcccggctgctgctgctgctgctgaccttcttcctgaggacagatgctgagaccccaccccgcttcaccaggacccctgtggaccagacaggagtgtctggaggagtggccagcttcatctgccaggccaccggggacccccggcccaagatcgtgtggaacaagaagggcaagaaggtgagcaaccagagatttgaagtcatcgagtttgatgatggcagcggctctgtgctgcgcatccagcccctgcggaccccaagagatgaggccatctatgaatgtgtggccagcaacaacgtgggggagatctctgtgtccacccggctgactgtgctgcgggaggaccagatcccccggggcttccccaccatcgacatgggcccccagctgaaggtggtggagaggaccaggacagccaccatgctgtgtgccgccagcggcaacccagaccctgagatcacctggttcaaggacttcctgcctgtggacaccagcaacaacaacggccgcatcaagcagctgcggagcggggccctgcagatcgagcagagcgaggagagtgaccagggcaagtatgaatgtgtggccaccaacagcgctggcacccgctacagcgccccagccaacctgtatgtgcgggtgagaagagtgcccccacgcttcagcatcccccccaccaaccacgagatcatgcctgggggctctgtgaacatcacctgtgtggccgtgggcagccccatgccctacgtgaagtggatgctgggcgctgaggacctgaccccagaagatgacatgcccatcggcagaaatgtgctggagctgaatgatgtgcggcagagcgccaactacacctgtgtggccatgagcaccctgggcgtcatcgaggccatcgcccagatcaccgtgaaggccctgcccaagcccccaggcacccctgtggtgacagagagcacagccaccagcatcaccctgacctgggacagcggcaaccctgagcctgtgtcctactacatcatccagcacaagcccaagaacagcgaggagctgtacaaggagattgatggagtggccaccacccgctacagcgtggccggcctgagcccctacagcgactatgagttccgggtggtggccgtgaacaacatcggccggggcccccccagcgagcctgtgctgacccagaccagcgagcaggcccccagcagcgcccccagagatgtgcaggccaggatgctgagcagcaccaccatcctggtgcagtggaaggagcctgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcattggagatggccccctgagcagtgacatccaggtgatcacccagacaggagtgcccggccagcccctgaacttcaaggccgagcctgagagcgagaccagcatcctgctgtcctggaccccacccaggagtgacaccatcgccaactatgagctggtgtacaaggatggagaacatggagaggagcagaggatcaccatcgagcccggcaccagctaccgcctgcagggcctgaagcccaacagcctgtactacttccggctggccgcccggagcccccagggcctgggcgccagcacagctgagatcagcgcccggaccatgcagagcaagcccagcgccccaccccaggacatcagctgcaccagccccagcagcaccagcatcctggtgtcctggcagcccccacctgtggagaagcagaatggcatcatcacagagtacagcatcaagtacacagctgtggatggagaagatgacaagccccatgagatcctgggcatccccagcgacaccaccaagtacctgctggagcagctggagaagtggacagagtaccgcatcaccgtgacagcccacacagatgtgggccctggccctgagagcctgtctgtgctgatccgcaccaatgaagatgtgcccagcggcccccccaggaaggtggaggtggaggccgtgaacagcacctctgtgaaggtgtcctggaggagccctgtgcccaacaagcagcacggccagatccggggctaccaggtgcactacgtgaggatggagaatggagagcccaagggccagcccatgctgaaggatgtgatgctggctgatgcccagtgggagtttgatgacaccacagaacatgacatgatcatcagcggcctgcagcctgagaccagctacagcctgactgtgacagcctacaccaccaagggagatggagcccggagcaagcccaagctggtgtccaccactggagctgtgcctgggaagccccggctggtgatcaaccacacccagatgaacacagccctgatccagtggcacccccctgtggacaccttcggccccctgcagggctaccgcctgaagtttggaaggaaggacatggagcccctgaccaccctggagttcagcgagaaggaggaccacttcaccgccacagacatccacaagggggccagctatgtgttccggctgagcgccaggaacaaggtgggctttggagaggagatggtgaaggagatcagcatccctgaggaggtgcccaccggcttcccccagaacctgcacagcgagggcaccaccagcacctctgtgcagctgtcctggcagccccctgtgctggccgagagaaatggcatcatcaccaagtacaccctgctgtacagagacatcaacatccccctgctgcccatggagcagctgattgtgcctgctgacaccaccatgaccctgaccggcctgaagccagacaccacctatgatgtgaaggtgcgggcccacaccagcaaaggacctggcccctacagccccagcgtgcagttccgcaccctgcctgtggaccaggtgtttgccaagaacttccacgtgaaggctgtgatgaagacctctgtgctgctgtcctgggagatccctgagaactacaacagcgccatgcccttcaagatcctgtatgatgatggcaagatggtggaggaggtggatggccgggccacccagaagctgattgtgaacctgaagccagagaagagctacagctttgtgctgaccaacagaggcaacagcgctgggggcctgcagcaccgggtgacagccaagacagccccagatgtgctgcggaccaagccagccttcatcggcaagaccaacctggatggcatgatcaccgtgcagctgcctgaggtgcctgccaatgaaaacatcaagggctactacatcatcatcgtgcccctgaagaagagccggggcaagttcatcaagccctgggagagcccagatgagatggagctggatgagctgctgaaggagatcagcaggaagaggaggagcatccgctatggccgggaggtggagctgaagccctacatcgccgcccactttgatgtgctgcccacagagttcaccctgggagatgacaagcactacggcggcttcaccaacaagcagctgcagagcggccaggagtatgtgttctttgtgctggccgtgatggagcacgccgagagcaagatgtatgccaccagcccctacagcgaccctgtggtgtccatggacctggacccccagcccatcacagatgaggaggagggcctcatctgggtggtgggccctgtgctggccgtggtgttcatcatctgcatcgtcatcgccatcctgctgtacaagaggaagagagctgagagtgacagcaggaagagcagcatccccaacaacaaggagatccccagccaccaccccacagatcctgtggagctgcggcggctgaacttccagaccccaggcatggccagccacccccccatccccatcctggagctggccgaccacatcgagcggctgaaggccaatgacaacctgaagttcagccaggagtatgagagcattgatcctggccagcagttcacctgggagcacagcaacctggaggtgaacaagcccaagaacagatatgccaacgtgattgcctatgaccacagccgggtgctgctgagcgccatcgagggcatccctggcagtgactatgtgaatgccaactacattgatggctacaggaagcagaatgcctacatcgccacccagggcagcctgcctgagacctttggagacttctggaggatgatctgggagcagaggtctgccaccgtggtgatgatgaccaagctggaggagaggagccgggtgaagtgtgaccagtactggcccagccggggcacagagacccacggcctggtgcaggtgaccctgctggacacagtggagctggccacctactgtgtgaggacctttgccctgtacaagaatggcagcagcgagaagcgggaggtgcggcagttccagttcaccgcctggccagaccatggagtgcctgagcaccccacccccttcctggccttcctgcggcgggtgaagacctgcaaccccccagatgctggccccatggtggtgcactgcagcgctggggtgggccgcacaggctgcttcatcgtgattgatgccatgctggagcgcatcaagcatgagaagacagtggacatctacggccacgtgaccctgatgagggcccagaggaactacatggtgcagacagaggaccagtacatcttcatccatgatgccctgctggaggccgtgacctgtggcaacacagaggtgcctgccaggaacctgtatgcctacatccagaagctgacccagatcgagaccggggagaatgtgacaggcatggagctggagttcaagaggctggccagcagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagcacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagtctggagagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgaaggagtggtggacatcttccagacagtgaagatgctgcggacccagaggcctgccatggtgcagacagaggaccagtaccagttctcctaccgggccgccctggagtacctgggcagctttgaccactacgccacctag

SEQ ID NO: 166317 - DNA, 5739 bp, Artificial Sequence; identical to SEQ ID NO: 166314
  Description of Artificial Sequence: Synthetic coding sequence

SEQ ID NO: 166318 - DNA, 4509 bp, Artificial Sequence
  Description of Artificial Sequence: Synthetic coding sequence
atggtgcacgtggcccggctgctgctgctgctgctgaccttcttcctgaggacagatgctgagaccccaccccgcttcaccaggacccctgtggaccagacaggagtgtctggaggagtggccagcttcatctgccaggccaccggggacccccggcccaagatcgtgtggaacaagaagggcaagaaggtgagcaaccagagatttgaagtcatcgagtttgatgatggcagcggctctgtgctgcgcatccagcccctgcggaccccaagagatgaggccatctatgaatgtgtggccagcaacaacgtgggggagatctctgtgtccacccggctgactgtgctgcgggaggaccagatcccccggggcttccccaccatcgacatgggcccccagctgaaggtggtggagaggaccaggacagccaccatgctgtgtgccgccagcggcaacccagaccctgagatcacctggttcaaggacttcctgcctgtggacaccagcaacaacaacggccgcatcaagcagctgcggagcggcggcacccccatccggggggccctgcagatcgagcagagcgaggagagtgaccagggcaagtatgaatgtgtggccaccaacagcgctggcacccgctacagcgccccagccaacctgtatgtgcgggagctgcgggaggtgagaagagtgcccccacgcttcagcatcccccccaccaaccacgagatcatgcctgggggctctgtgaacatcacctgtgtggccgtgggcagccccatgccctacgtgaagtggatgctgggcgctgaggacctgaccccagaagatgacatgcccatcggcagaaatgtgctggagctgaatgatgtgcggcagagcgccaactacacctgtgtggccatgagcaccctgggcgtcatcgaggccatcgcccagatcaccgtgaaggccctgcccaagcccccaggcacccctgtggtgacagagagcacagccaccagcatcaccctgacctgggacagcggcaaccctgagcctgtgtcctactacatcatccagcacaagcccaagaacagcgaggagctgtacaaggagattgatggagtggccaccacccgctacagcgtggccggcctgagcccctacagcgactatgagttccgggtggtggccgtgaacaacatcggccggggcccccccagcgagcctgtgctgacccagaccagcgagcaggcccccagcagcgcccccagagatgtgcaggccaggatgctgagcagcaccaccatcctggtgcagtggaaggagcctgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcattggagatggccccctgagcagtgacatccaggtgatcacccagacaggagtgcccggccagcccctgaacttcaaggccgagcctgagagcgagaccagcatcctgctgtcctggaccccacccaggagtgacaccatcgccaactatgagctggtgtacaaggatggagaacatggagaggagcagaggatcaccatcgagcccggcaccagctaccgcctgcagggcctgaagcccaacagcctgtactacttccggctggccgcccggagcccccagggcctgggcgccagcacagctgagatcagcgcccggaccatgcagagcatgtttgccaagaacttccacgtgaaggctgtgatgaagacctctgtgctgctgtcctgggagatccctgagaactacaacagcgccatgcccttcaagatcctgtatgatgatggcaagatggtggaggaggtggatggccgggccacccagaagctgattgtgaacctgaagccagagaagagctacagctttgtgctgaccaacagaggcaacagcgctgggggcctgcagcaccgggtgacagccaagacagccccagatgtgctgcggaccaagccagccttcatcggcaagaccaacctggatggcatgatcaccgtgcagctgcctgaggtgcctgccaatgaaaacatcaagggctactacatcatcatcgtgcccctgaagaagagccggggcaagttcatcaagccctgggagagcccagatgagatggagctggatgagctgctgaaggagatcagcaggaagagaagaagcatccgctatggccgggaggtggagctgaagccctacatcgccgcccactttgatgtgctgcccacagagttcaccctgggagatgacaagcactatggaggcttcaccaacaagcagctgcagagcggccaggagtatgtgttctttgtgctggccgtgatggagcacgccgagagcaagatgtatgccaccagcccctacagcgaccctgtggtgtccatggacctggacccccagcccatcacagatgaggaggagggcctcatctgggtggtgggccctgtgctggccgtggtgttcatcatctgcatcgtgattgccatcctgctgtacaagagcaagccagacaggaagagagctgagagtgacagcaggaagagcagcatccccaacaacaaggagatccccagccaccaccccacagatcctgtggagctgcggcggctgaacttccagaccccaggcatggccagccacccccccatccccatcctggagctggccgaccacatcgagcggctgaaggccaatgacaacctgaagttcagccaggagtatgagagcattgaccccggccagcagttcacctgggagcacagcaacctggaggtgaacaagcccaagaacagatatgccaacgtcatcgcctatgaccacagccgggtgctgctgagcgccatcgagggcatccctggcagtgactatgtgaatgccaactacattgatggctacaggaagcagaatgcctacatcgccacccagggcagcctgcctgagaccttcggggacttctggaggatgatctgggagcagaggtctgccaccgtggtgatgatgaccaagctggaggagaggagccgggtgaagtgtgaccagtactggcccagccggggcacagagacccacggcctggtgcaggtgaccctgctggacacagtggagctggccacctactgtgtgaggacctttgccctgtacaagaatggcagcagcgagaagcgggaggtgcggcagttccagttcaccgcctggccagaccacggcgtgcctgagcaccccacccccttcctggccttcctgcggcgggtgaagacctgcaaccccccagatgctggccccatggtggtgcactgcagcgctggggtgggccgcacaggctgcttcatcgtgattgatgccatgctggagcgcatcaagcatgagaagacagtggacatctacggccacgtgaccctgatgagggcccagaggaactacatggtgcagacagaggaccagtacatcttcatccatgatgccctgctggaggccgtgacctgtggcaacacagaggtgcctgccaggaacctgtatgcctacatccagaagctgacccagattgaaacaggagaaaatgtgacaggcatggagctggagttcaagaggctggccagcagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagcacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagagcggggagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgagggcgtggtggacatcttccagacagtgaagatgctgcggacccagaggcctgccatggtgcagacagaggaccagtaccagttctcctacagagctgccctggagtacctgggcagctttgaccactacgccacctag

SEQ ID NO: 166319 - DNA, 4518 bp, Artificial Sequence
  Description of Artificial Sequence: Synthetic coding sequence
atggtgcacgtggcccggctgctgctgctgctgctgaccttcttcctgaggacagatgctgagaccccaccccgcttcaccaggacccctgtggaccagacaggagtgtctggaggagtggccagcttcatctgccaggccaccggggacccccggcccaagatcgtgtggaacaagaagggcaagaaggtgagcaaccagagatttgaagtcatcgagtttgatgatggcagcggctctgtgctgcgcatccagcccctgcggaccccaagagatgaggccatctatgaatgtgtggccagcaacaacgtgggggagatctctgtgtccacccggctgactgtgctgcgggaggaccagatcccccggggcttccccaccatcgacatgggcccccagctgaaggtggtggagaggaccaggacagccaccatgctgtgtgccgccagcggcaacccagaccctgagatcacctggttcaaggacttcctgcctgtggacaccagcaacaacaacggccgcatcaagcagctgcggtctgtgtccattggagccctgcagatcgagcagagcgaggagagtgaccagggcaagtatgaatgtgtggccaccaacagcgctggcacccgctacagcgccccagccaacctgtatgtgcgggtgcggcgggtgcccccacgcttcagcatcccccccaccaaccacgagatcatgcctgggggctctgtgaacatcacctgtgtggccgtgggcagccccatgccctacgtgaagtggatgctgggcgctgaggacctgaccccagaagatgacatgcccatcggcagaaatgtgctggagctgaatgatgtgcggcagagcgccaactacacctgtgtggccatgagcaccctgggcgtgattgaggccatcgcccagatcaccgtgaaggccctgcccaagcccccaggcacccctgtggtgacagagagcacagccaccagcatcaccctgacctgggacagcggcaaccctgagcctgtgtcctactacatcatccagcacaagcccaagaacagcgaggagctgtacaaggagattgatggagtggccaccacccgctacagcgtggccggcctgagcccctacagcgactatgagttccgggtggtggccgtgaacaacatcggccggggccccccatctgagcctgtgctgacccagaccagcgagcaggcccccagcagcgcccccagagatgtgcaggccaggatgctgagcagcaccaccatcctggtgcagtggaaggagcctgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcattggagatggccccctgagcagtgacatccaggtgatcacccagacaggagtgcccggccagcccctgaacttcaaggccgagcctgagagcgagaccagcatcctgctgtcctggaccccacccaggagtgacaccatcgccaactatgagctggtgtacaaggatggagagcacggggaggagcagaggatcaccatcgagcccggcaccagctaccgcctgcagggcctgaagcccaacagcctgtactacttccggctggccgcccggagcccccagggcctgggcgccagcacagctgagatcagcgcccggaccatgcagagcatgtttgccaagaacttccacgtgaaggctgtgatgaagacctctgtgctgctgtcctgggagatccctgagaactacaacagcgccatgcccttcaagatcctgtatgatgatggcaagatggtggaggaggtggatggccgggccacccagaagctgattgtgaacctgaagccagagaagagctacagctttgtgctgaccaacagaggcaacagcgctgggggcctgcagcaccgggtgacagccaagacagccccagatgtgctgcggaccaagccagccttcatcggcaagaccaacctggatggcatgatcaccgtgcagctgcctgaggtgcctgccaatgaaaacatcaagggctactacatcatcatcgtgcccctgaagaagagccggggcaagttcatcaagccctgggagagcccagatgagatggagctggatgagctgctgaaggagatcagcaggaagaggaggagcatccgctatggccgggaggtggagctgaagccctacatcgccgcccactttgatgtgctgcccacagagttcaccctgggagatgacaagcactacggcggcttcaccaacaagcagctgcagagcggccaggagtatgtgttctttgtgctggccgtgatggagcacgccgagagcaagatgtatgccaccagcccctacagcgaccctgtggtgtccatggacctggacccccagcccatcacagatgaggaggagggcctcatctgggtggtgggccctgtgctggccgtggtgttcatcatctgcatcgtcatcgccatcctgctgtacaagaggaagagagctgagagtgacagcaggaagagcagcatccccaacaacaaggagatccccagccaccaccccacagatcctgtggagctgcggcggctgaacttccagaccccaggcagtgatgattctggctacccaggcaacctgcacagcagctccatggccagccacccccccatccccatcctggagctggccgaccacatcgagcggctgaaggccaatgacaacctgaagttcagccaggagtatgagagcattgatcctggccagcagttcacctgggagcacagcaacctggaggtgaacaagcccaagaacagatatgccaacgtgattgcctatgaccacagccgggtgctgctgagcgccatcgagggcatccctggcagtgactatgtgaatgccaactacattgatggctacaggaagcagaatgcctacatcgccacccagggcagcctgcctgagacctttggagacttctggaggatgatctgggagcagaggtctgccaccgtggtgatgatgaccaagctggaggagaggagccgggtgaagtgtgaccagtactggcccagccggggcacagagacccacggcctggtgcaggtgaccctgctggacacagtggagctggccacctactgtgtgaggacctttgccctgtacaagaatggcagcagcgagaagcgggaggtgcggcagttccagttcaccgcctggccagaccatggagtgcctgagcaccccacccccttcctggccttcctgcggcgggtgaagacctgcaaccccccagatgctggccccatggtggtgcactgcagcgctggggtgggccgcacaggctgcttcatcgtgattgatgccatgctggagcgcatcaagcatgagaagacagtggacatctacggccacgtgaccctgatgagggcccagaggaactacatggtgcagacagaggaccagtacatcttcatccatgatgccctgctggaggccgtgacctgtggcaacacagaggtgcctgccaggaacctgtatgcctacatccagaagctgacccagatcgagaccggggagaatgtgacaggcatggagctggagttcaagaggctggccagcagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagcacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagtctggagagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgaaggagtggtggacatcttccagacagtgaagatgctgcggacccagaggcctgccatggtgcagacagaggaccagtaccagttctcctaccgggccgccctggagtacctgggcagctttgaccactacgccacctag

SEQ ID NO: 166320 - DNA, 282 bp, Artificial Sequence
  Description of Artificial Sequence: Synthetic coding sequence
atggtgcacgtggcccggctgctgctgctgctgctgaccttcttcctgaggacagatgctgagaccccaccccgcttcaccaggacccctgtggaccagacaggagtgtctggaggagtggccagcttcatctgccaggccaccggggacccccggcccaagatcgtgtggaacaagaagggcaagaaggtgagcaaccagagatttgaagtcatcgagtttgatgatggcagcggctctgtgctgcgcatccagcccctgcggaccccaagagatgaatag

SEQ ID NO: 166321 - DNA, 4518 bp, Artificial Sequence
  Description of Artificial Sequence: Synthetic coding sequence
atggtgcacgtggcccggctgctgctgctgctgctgaccttcttcctgaggacagatgctgagaccccaccccgcttcaccaggacccctgtggaccagacaggagtgtctggaggagtggccagcttcatctgccaggccaccggggacccccggcccaagatcgtgtggaacaagaagggcaagaaggtgagcaaccagagatttgaagtcatcgagtttgatgatggcagcggctctgtgctgcgcatccagcccctgcggaccccaagagatgaggccatctatgaatgtgtggccagcaacaacgtgggggagatctctgtgtccacccggctgactgtgctgcgggaggaccagatcccccggggcttccccaccatcgacatgggcccccagctgaaggtggtggagaggaccaggacagccaccatgctgtgtgccgccagcggcaacccagaccctgagatcacctggttcaaggacttcctgcctgtggacaccagcaacaacaacggccgcatcaagcagctgcggtctgagagcattggaggcacccccatccggggggccctgcagatcgagcagagcgaggagagtgaccagggcaagtatgaatgtgtggccaccaacagcgctggcacccgctacagcgccccagccaacctgtatgtgcgggagctgcgggaggtgcggcgggtgcccccacgcttcagcatcccccccaccaaccacgagatcatgcctgggggctctgtgaacatcacctgtgtggccgtgggcagccccatgccctacgtgaagtggatgctgggcgctgaggacctgaccccagaagatgacatgcccatcggcagaaatgtgctggagctgaatgatgtgcggcagagcgccaactacacctgtgtggccatgagcaccctgggcgtgattgaggccatcgcccagatcaccgtgaaggccctgcccaagcccccaggcacccctgtggtgacagagagcacagccaccagcatcaccctgacctgggacagcggcaaccctgagcctgtgtcctactacatcatccagcacaagcccaagaacagcgaggagctgtacaaggagattgatggagtggccaccacccgctacagcgtggccggcctgagcccctacagcgactatgagttccgggtggtggccgtgaacaacatcggccggggccccccatctgagcctgtgctgacccagaccagcgagcaggcccccagcagcgcccccagagatgtgcaggccaggatgctgagcagcaccaccatcctggtgcagtggaaggagcctgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcattggagatggccccctgagcagtgacatccaggtgatcacccagacaggagtgcccggccagcccctgaacttcaaggccgagcctgagagcgagaccagcatcctgctgtcctggaccccacccaggagtgacaccatcgccaactatgagctggtgtacaaggatggagagcacggggaggagcagaggatcaccatcgagcccggcaccagctaccgcctgcagggcctgaagcccaacagcctgtactacttccggctggccgcccggagcccccagggcctgggcgccagcacagctgagatcagcgcccggaccatgcagagcatgtttgccaagaacttccacgtgaaggctgtgatgaagacctctgtgctgctgtcctgggagatccctgagaactacaacagcgccatgcccttcaagatcctgtatgatgatggcaagatggtggaggaggtggatggccgggccacccagaagctgattgtgaacctgaagccagagaagagctacagctttgtgctgaccaacagaggcaacagcgctgggggcctgcagcaccgggtgacagccaagacagccccagatgtgctgcggaccaagccagccttcatcggcaagaccaacctggatggcatgatcaccgtgcagctgcctgaggtgcctgccaatgaaaacatcaagggctactacatcatcatcgtgcccctgaagaagagccggggcaagttcatcaagccctgggagagcccagatgagatggagctggatgagctgctgaaggagatcagcaggaagaggaggagcatccgctatggccgggaggtggagctgaagccctacatcgccgcccactttgatgtgctgcccacagagttcaccctgggagatgacaagcactacggcggcttcaccaacaagcagctgcagagcggccaggagtatgtgttctttgtgctggccgtgatggagcacgccgagagcaagatgtatgccaccagcccctacagcgaccctgtggtgtccatggacctggacccccagcccatcacagatgaggaggagggcctcatctgggtggtgggccctgtgctggccgtggtgttcatcatctgcatcgtcatcgccatcctgctgtacaagagcaagccagacaggaagagagctgagagtgacagcaggaagagcagcatccccaacaacaaggagatccccagccaccaccccacagatcctgtggagctgcggcggctgaacttccagaccccaggcatggccagccacccccccatccccatcctggagctggccgaccacatcgagcggctgaaggccaatgacaacctgaagttcagccaggagtatgagagcattgatcctggccagcagttcacctgggagcacagcaacctggaggtgaacaagcccaagaacagatatgccaacgtgattgcctatgaccacagccgggtgctgctgagcgccatcgagggcatccctggcagtgactatgtgaatgccaactacattgatggctacaggaagcagaatgcctacatcgccacccagggcagcctgcctgagacctttggagacttctggaggatgatctgggagcagaggtctgccaccgtggtgatgatgaccaagctggaggagaggagccgggtgaagtgtgaccagtactggcccagccggggcacagagacccacggcctggtgcaggtgaccctgctggacacagtggagctggccacctactgtgtgaggacctttgccctgtacaagaatggcagcagcgagaagcgggaggtgcggcagttccagttcaccgcctggccagaccatggagtgcctgagcaccccacccccttcctggccttcctgcggcgggtgaagacctgcaaccccccagatgctggccccatggtggtgcactgcagcgctggggtgggccgcacaggctgcttcatcgtgattgatgccatgctggagcgcatcaagcatgagaagacagtggacatctacggccacgtgaccctgatgagggcccagaggaactacatggtgcagacagaggaccagtacatcttcatccatgatgccctgctggaggccgtgacctgtggcaacacagaggtgcctgccaggaacctgtatgcctacatccagaagctgacccagatcgagaccggggagaatgtgacaggcatggagctggagttcaagaggctggccagcagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagcacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagtctggagagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgaaggagtggtggacatcttccagacagtgaagatgctgcggacccagaggcctgccatggtgcagacagaggaccagtaccagttctcctaccgggccgccctggagtacctgggcagctttgaccactacgccacctag

SEQ ID NO: 166322 - DNA, 4509 bp, Artificial Sequence
  Description of Artificial Sequence: Synthetic coding sequence
atggtgcacgtggcccggctgctgctgctgctgctgaccttcttcctgaggacagatgctgagaccccaccccgcttcaccaggacccctgtggaccagacaggagtgtctggaggagtggccagcttcatctgccaggccaccggggacccccggcccaagatcgtgtggaacaagaagggcaagaaggtgagcaaccagagatttgaagtcatcgagtttgatgatggcagcggctctgtgctgcgcatccagcccctgcggaccccaagagatgaggccatctatgaatgtgtggccagcaacaacgtgggggagatctctgtgtccacccggctgactgtgctgcgggaggaccagatcccccggggcttccccaccatcgacatgggcccccagctgaaggtggtggagaggaccaggacagccaccatgctgtgtgccgccagcggcaacccagaccctgagatcacctggttcaaggacttcctgcctgtggacaccagcaacaacaacggccgcatcaagcagctgcggagcggccgggtcttccacactggagccctgcagatcgagcagagcgaggagagtgaccagggcaagtatgaatgtgtggccaccaacagcgctggcacccgctacagcgccccagccaacctgtatgtgcgggtgaacaggaaggtgagaagagtgcccccacgcttcagcatcccccccaccaaccacgagatcatgcctgggggctctgtgaacatcacctgtgtggccgtgggcagccccatgccctacgtgaagtggatgctgggcgctgaggacctgaccccagaagatgacatgcccatcggcagaaatgtgctggagctgaatgatgtgcggcagagcgccaactacacctgtgtggccatgagcaccctgggcgtcatcgaggccatcgcccagatcaccgtgaaggccctgcccaagcccccaggcacccctgtggtgacagagagcacagccaccagcatcaccctgacctgggacagcggcaaccctgagcctgtgtcctactacatcatccagcacaagcccaagaacagcgaggagctgtacaaggagattgatggagtggccaccacccgctacagcgtggccggcctgagcccctacagcgactatgagttccgggtggtggccgtgaacaacatcggccggggcccccccagcgagcctgtgctgacccagaccagcgagcaggcccccagcagcgcccccagagatgtgcaggccaggatgctgagcagcaccaccatcctggtgcagtggaaggagcctgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcattggagatggccccctgagcagtgacatccaggtgatcacccagacaggagtgcccggccagcccctgaacttcaaggccgagcctgagagcgagaccagcatcctgctgtcctggaccccacccaggagtgacaccatcgccaactatgagctggtgtacaaggatggagaacatggagaggagcagaggatcaccatcgagcccggcaccagctaccgcctgcagggcctgaagcccaacagcctgtactacttccggctggccgcccggagcccccagggcctgggcgccagcacagctgagatcagcgcccggaccatgcagagcatgtttgccaagaacttccacgtgaaggctgtgatgaagacctctgtgctgctgtcctgggagatccctgagaactacaacagcgccatgcccttcaagatcctgtatgatgatggcaagatggtggaggaggtggatggccgggccacccagaagctgattgtgaacctgaagccagagaagagctacagctttgtgctgaccaacagaggcaacagcgctgggggcctgcagcaccgggtgacagccaagacagccccagatgtgctgcggaccaagccagccttcatcggcaagaccaacctggatggcatgatcaccgtgcagctgcctgaggtgcctgccaatgaaaacatcaagggctactacatcatcatcgtgcccctgaagaagagccggggcaagttcatcaagccctgggagagcccagatgagatggagctggatgagctgctgaaggagatcagcaggaagagaagaagcatccgctatggccgggaggtggagctgaagccctacatcgccgcccactttgatgtgctgcccacagagttcaccctgggagatgacaagcactatggaggcttcaccaacaagcagctgcagagcggccaggagtatgtgttctttgtgctggccgtgatggagcacgccgagagcaagatgtatgccaccagcccctacagcgaccctgtggtgtccatggacctggacccccagcccatcacagatgaggaggagggcctcatctgggtggtgggccctgtgctggccgtggtgttcatcatctgcatcgtgattgccatcctgctgtacaagaggaagccctacaggaagagagctgagagtgacagcaggaagagcagcatccccaacaacaaggagatccccagccaccaccccacagatcctgtggagctgcggcggctgaacttccagaccccaggcatggccagccacccccccatccccatcctggagctggccgaccacatcgagcggctgaaggccaatgacaacctgaagttcagccaggagtatgagagcattgaccccggccagcagttcacctgggagcacagcaacctggaggtgaacaagcccaagaacagatatgccaacgtcatcgcctatgaccacagccgggtgctgctgagcgccatcgagggcatccctggcagtgactatgtgaatgccaactacattgatggctacaggaagcagaatgcctacatcgccacccagggcagcctgcctgagaccttcggggacttctggaggatgatctgggagcagaggtctgccaccgtggtgatgatgaccaagctggaggagaggagccgggtgaagtgtgaccagtactggcccagccggggcacagagacccacggcctggtgcaggtgaccctgctggacacagtggagctggccacctactgtgtgaggacctttgccctgtacaagaatggcagcagcgagaagcgggaggtgcggcagttccagttcaccgcctggccagaccacggcgtgcctgagcaccccacccccttcctggccttcctgcggcgggtgaagacctgcaaccccccagatgctggccccatggtggtgcactgcagcgctggggtgggccgcacaggctgcttcatcgtgattgatgccatgctggagcgcatcaagcatgagaagacagtggacatctacggccacgtgaccctgatgagggcccagaggaactacatggtgcagacagaggaccagtacatcttcatccatgatgccctgctggaggccgtgacctgtggcaacacagaggtgcctgccaggaacctgtatgcctacatccagaagctgacccagattgaaacaggagaaaatgtgacaggcatggagctggagttcaagaggctggccagcagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagcacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagagcggggagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgagggcgtggtggacatcttccagacagtgaagatgctgcggacccagaggcctgccatggtgcagacagaggaccagtaccagttctcctacagagctgccctggagtacctgggcagctttgaccactacgccacctag

SEQ ID NO: 166323 - DNA, 5739 bp, Artificial Sequence; identical to SEQ ID NO: 166314
  Description of Artificial Sequence: Synthetic coding sequence

SEQ ID NO: 166324 - DNA, 2103 bp, Artificial Sequence
  Description of Artificial Sequence: Synthetic coding sequence
atggagcccctgtgccccctgctgctggtgggcttcagcctgcccctggcccgggccctgcggggaaatgagaccacagctgacagcaatgagaccaccaccaccagcggccccccagaccccggggccagccagcccctgctggcctggctgctgctgcccctgctgctgctgctgctggtgctgctgctggccgcctacttcttccgcttcaggaagcagaggaaggctgtggtgtccaccagtgacaagaagatgcccaacggcatcctggaggagcaggagcagcagagggtgatgctgctgagccgcagccccagcggccccaagaagtacttccccatccctgtggagcacctggaggaggagatccgcatccgctctgcagatgactgcaagcagttccgggaggagttcaacagcctgcccagcggccacatccagggcacctttgagctggccaacaaggaggagaaccgggagaagaaccgctaccccaacatcctgcccaatgaccacagcagggtcatcctgagccagctggatggcatcccctgcagcgactacatcaatgccagctacattgatggctacaaggagaagaacaagttcatcgccgcccagggccccaagcaggagaccgtgaatgacttctggaggatggtgtgggagcagaagagcgccaccatcgtgatgctgaccaacctgaaggagaggaaggaggagaagtgccaccagtactggccagaccagggctgctggacctacggcaacatccgggtgtgtgtggaggactgtgtggtgctggtggactacaccatcaggaagttctgcatccagccccagctgcctgatggctgcaaggccccccggctggtgtcccagctgcacttcacctcctggccagactttggagtgcccttcacccccatcggcatgctgaagttcctgaagaaggtgaagaccctgaaccctgtgcacgccggccccatcgtggtgcactgcagcgctggggtgggccgcacaggcaccttcatcgtgattgatgccatgatggccatgatgcatgctgagcagaaggtggatgtgtttgaatttgtgagccgcatccggaaccagaggccccagatggtgcagacagacatgcagtacaccttcatctaccaggccctgctggagtactacctgtatggagacacagagctggatgtgagcagcctggagaagcacctgcagaccatgcacggcaccaccacccactttgacaagattggcctggaggaggagttcaggaagctgaccaacgtgcgcatcatgaaggagaacatgaggactggaaacctgcctgccaacatgaagaaggcccgggtcatccagatcatcccctatgacttcaacagagtcatcctgtccatgaagaggggccaggagtacacagactacatcaatgccagcttcattgatggctaccggcagaaggactacttcatcgccacccagggccccctggcccacacagtggaggacttctggaggatgatctgggagtggaagagccacaccatcgtgatgctgacagaggtgcaggagcgggagcaggacaagtgctaccagtactggcccacagagggctctgtgacccacggggagatcaccatcgagatcaagaatgacaccctgtctgaggccatcagcatccgggacttcctggtgaccctgaaccagccccaggcccggcaggaggagcaggtgcgggtggtgcggcagttccacttccacggctggccagagatcggcatcccagctgagggcaagggcatgattgacctgattgctgctgtgcagaagcagcagcagcagacaggcaaccaccccatcaccgtgcactgcagcgctggggccggccgcacaggcaccttcatcgccctgagcaacatcctggagcgggtgaaggccgagggcctgctggatgtgttccaggccgtgaagagcctgcggctgcagaggccccacatggtgcagaccctggagcagtatgagttctgctacaaggtggtgcaggacttcatcgacatcttcagtgactatgccaacttcaagtag

SEQ ID NO: 166325 - DNA, 1929 bp, Artificial Sequence
  Description of Artificial Sequence: Synthetic coding sequence
atgagcaacagaagcagcttcagccggctgacctggttcaggaagcagaggaaggctgtggtgtccaccagtgacaagaagatgcccaacggcatcctggaggagcaggagcagcagagggtgatgctgctgagccgcagccccagcggccccaagaagtacttccccatccctgtggagcacctggaggaggagatccgcatccgctctgcagatgactgcaagcagttccgggaggagttcaacagcctgcccagcggccacatccagggcacctttgagctggccaacaaggaggagaaccgggagaagaaccgctaccccaacatcctgcccaatgaccacagcagggtcatcctgagccagctggatggcatcccctgcagcgactacatcaatgccagctacattgatggctacaaggagaagaacaagttcatcgccgcccagggccccaagcaggagaccgtgaatgacttctggaggatggtgtgggagcagaagagcgccaccatcgtgatgctgaccaacctgaaggagaggaaggaggagaagtgccaccagtactggccagaccagggctgctggacctacggcaacatccgggtgtgtgtggaggactgtgtggtgctggtggactacaccatcaggaagttctgcatccagccccagctgcctgatggctgcaaggccccccggctggtgtcccagctgcacttcacctcctggccagactttggagtgcccttcacccccatcggcatgctgaagttcctgaagaaggtgaagaccctgaaccctgtgcacgccggccccatcgtggtgcactgcagcgctggggtgggccgcacaggcaccttcatcgtgattgatgccatgatggccatgatgcatgctgagcagaaggtggatgtgtttgaatttgtgagccgcatccggaaccagaggccccagatggtgcagacagacatgcagtacaccttcatctaccaggccctgctggagtactacctgtatggagacacagagctggatgtgagcagcctggagaagcacctgcagaccatgcacggcaccaccacccactttgacaagattggcctggaggaggagttcaggaagctgaccaacgtgcgcatcatgaaggagaacatgaggactggaaacctgcctgccaacatgaagaaggcccgggtcatccagatcatcccctatgacttcaacagagtcatcctgtccatgaagaggggccaggagtacacagactacatcaatgccagcttcattgatggctaccggcagaaggactacttcatcgccacccagggccccctggcccacacagtggaggacttctggaggatgatctgggagtggaagagccacaccatcgtgatgctgacagaggtgcaggagcgggagcaggacaagtgctaccagtactggcccacagagggctctgtgacccacggggagatcaccatcgagatcaagaatgacaccctgtctgaggccatcagcatccgggacttcctggtgaccctgaaccagccccaggcccggcaggaggagcaggtgcgggtggtgcggcagttccacttccacggctggccagagatcggcatcccagctgagggcaagggcatgattgacctgattgctgctgtgcagaagcagcagcagcagacaggcaaccaccccatcaccgtgcactgcagcgctggggccggccgcacaggcaccttcatcgccctgagcaacatcctggagcgggtgaaggccgagggcctgctggatgtgttccaggccgtgaagagcctgcggctgcagaggccccacatggtgcagaccctggagcagtatgagttctgctacaaggtggtgcaggacttcatcgacatcttcagtgactatgccaacttcaagtag

SEQ ID NO: 166326 - DNA, 2103 bp, Artificial Sequence; identical to SEQ ID NO: 166324
  Description of Artificial Sequence: Synthetic coding sequence

SEQ ID NO: 166327 - DNA, 438 bp, Artificial Sequence
  Description of Artificial Sequence: Synthetic coding sequence
atggagcccctgtgccccctgctgctggtgggcttcagcctgcccctggcccgggccctgcggggaaatgagaccacagctgacagcaatgagaccaccaccaccagcggccccccagaccccggggccagccagcccctgctggcctggctgctgctgcccctgctgctgctgctgctggtgctgctgctggccgcctacttcttccgcttcaggaagcagaggaaggctgtggtgtccaccagtgacaagaagatgcccaacggcatcctggaggagcaggagcagcagagggtgatgctgctgagccgcagccccagcggccccaagaagtacttccccatccctgtggagcacctggaggaggagatccgcatccgctctgcagatgactgcaagcagttccgggaggagttcaacatgaccatcctgggctag

SEQ ID NO: 166328 - DNA, 2010 bp, Artificial Sequence
  Description of Artificial Sequence: Synthetic coding sequence
atggtgtcccagaggctgcccaggaagacccggggccccccctggagcccctgtgtgcacagctgctggtgggtgctggcctgccgcagccctggcctgagcggggccacccggcccctgcccacagccacccggcagccccggccccaggccctgcggacccgggccccacccagccgctgctggccaggctgctactgccgctgctgcagcagcagcagctgcagcttcagcccccccaccagcagcggcagcggccccaagaagtacttccccatccctgtggagcacctggaggaggagatccgcatccgctctgcagatgactgcaagcagttccgggaggagttcaacagcctgcccagcggccacatccagggcacctttgagctggccaacaaggaggagaaccgggagaagaaccgctaccccaacatcctgcccaatgaccacagcagggtcatcctgagccagctggatggcatcccctgcagcgactacatcaatgccagctacattgatggctacaaggagaagaacaagttcatcgccgcccagggccccaagcaggagaccgtgaatgacttctggaggatggtgtgggagcagaagagcgccaccatcgtgatgctgaccaacctgaaggagaggaaggaggagaagtgccaccagtactggccagaccagggctgctggacctacggcaacatccgggtgtgtgtggaggactgtgtggtgctggtggactacaccatcaggaagttctgcatccagccccagctgcctgatggctgcaaggccccccggctggtgtcccagctgcacttcacctcctggccagactttggagtgcccttcacccccatcggcatgctgaagttcctgaagaaggtgaagaccctgaaccctgtgcacgccggccccatcgtggtgcactgcagcgctggggtgggccgcacaggcaccttcatcgtgattgatgccatgatggccatgatgcatgctgagcagaaggtggatgtgtttgaatttgtgagccgcatccggaaccagaggccccagatggtgcagacagacatgcagtacaccttcatctaccaggccctgctggagtactacctgtatggagacacagagctggatgtgagcagcctggagaagcacctgcagaccatgcacggcaccaccacccactttgacaagattggcctggaggaggagttcaggaagctgaccaacgtgcgcatcatgaaggagaacatgaggactggaaacctgcctgccaacatgaagaaggcccgggtcatccagatcatcccctatgacttcaacagagtcatcctgtccatgaagaggggccaggagtacacagactacatcaatgccagcttcattgatggctaccggcagaaggactacttcatcgccacccagggccccctggcccacacagtggaggacttctggaggatgatctgggagtggaagagccacaccatcgtgatgctgacagaggtgcaggagcgggagcaggacaagtgctaccagtactggcccacagagggctctgtgacccacggggagatcaccatcgagatcaagaatgacaccctgtctgaggccatcagcatccgggacttcctggtgaccctgaaccagccccaggcccggcaggaggagcaggtgcgggtggtgcggcagttccacttccacggctggccagagatcggcatcccagctgagggcaagggcatgattgacctgattgctgctgtgcagaagcagcagcagcagacaggcaaccaccccatcaccgtgcactgcagaaattccatgaacagcgccaccaagtggtacaagatcctgctgatctacttcctgatcatgctgatcagcaatgaagacagctgcctgaagatcttcttcaacctgatggagcagaggaggagccacttcccccaggatgcccggctgagcccccccctgtctggaacagcctttgccctgtag

SEQ ID NO: 166329 - DNA, 423 bp, Artificial Sequence
  Description of Artificial Sequence: Synthetic coding sequence
atggagcccctgtgccccctgctgctggtgggcttcagcctgcccctggcccgggccctgcggggaaatgagaccacagctgacagcaatgagaccaccaccaccagcggccccccagaccccggggccagccagcccctgctggcctggctgctgctgcccctgctgctgctgctgctggtgctgctgctggccgcctacttcttccgcttcaggaagcagaggaaggctgtggtgtccaccagtgacaagaagatgcccaacggcatcctggaggagcaggagcagcagagggtgatgctgctgagccgcagccccagcggccccaagaagtacttccccatccctgtggagcacctggaggaggagatccgcatccgctctgcagatgactgcaagcagttccgggaggagttcaactag

SEQ ID NO: 166330 - DNA, 465 bp, Artificial Sequence
  Description of Artificial Sequence: Synthetic coding sequence
atggagcccctgtgccccctgctgctggtgggcttcagcctgcccctggcccgggccctgcggggaaatgagaccacagctgacagcaatgagaccaccaccaccagcggccccccagaccccggggccagccagcccctgctggcctggctgctgctgcccctgctgctgctgctgctggtgctgctgctggccgcctacttcttccgcttcaggaagcagaggaaggctgtggtgtccaccagtgacaagaagatgcccaacggcatcctggaggagcaggagcagcagagggtgatgctgctgagccgcagccccagcggccccaagaagtacttccccatccctgtggagcacctggaggaggagatccgcatccgctctgcagatgactgcaagcagttccgggaggagttcaacagcctgcccagcggccacatccagggcacctttgagctggcctag

SEQ ID NO: 166331 - DNA, 5724 bp, Artificial Sequence
  Description of Artificial Sequence: Synthetic coding sequence
atggcccctgagcccgcccctggccgcaccatggtgcccctggtgcctgccctggtgatgctgggcctggtggccggggcccacggggacagcaagcctgtgttcatcaaggtgcctgaggaccagacaggcctgagcggcggcgtggccagctttgtgtgccaggccactggagagcccaagccccgcatcacctggatgaagaagggcaagaaggtgagcagccagagatttgaggtgattgaatttgatgatggagctggctctgtgctgcgcatccagcccctgcgggtgcagagagatgaggccatctatgagtgcacagccaccaacagcctgggggagatcaacaccagcgccaagctgtctgtgctggaggaggagcagctgcccccaggcttccccagcattgacatgggcccccagctgaaggtggtggagaaggccaggacagccaccatgctgtgtgccgccggcggcaacccagaccctgagatctcctggttcaaggacttcctgcctgtggaccctgccaccagcaatggccgcatcaagcagctgcggagcggggccctgcagatcgagagcagcgaggagagtgaccagggcaagtatgaatgtgtggccaccaacagcgctggcacccgctacagcgccccagccaacctgtatgtgcgggtgcggcgggtggccccccgcttcagcatcccccccagcagccaggaggtgatgcctgggggctctgtgaacctgacctgtgtggccgtgggcgcccccatgccctacgtgaagtggatgatgggcgctgaggagctgaccaaggaggatgagatgcctgtgggcagaaatgtgctggagctgagcaatgtggtgcgcagcgccaactacacctgtgtggccatcagcagcctgggcatgattgaggccacagcccaggtgacagtgaaggccctgcccaagccacccatcgacctggtggtgacagagaccacagccacctctgtgaccctgacctgggacagcggcaacagcgagcctgtgacctactacggcatccagtacagagctgctggaacagagggccccttccaggaggtggatggagtggccaccacccgctacagcatcggcggcctgagccccttctctgaatatgccttccgggtgctggccgtgaacagcatcggccggggccccccatctgaggccgtgcgggccaggactggagagcaggcccccagcagccccccccggcgggtgcaggccaggatgctgagcgccagcaccatgctggtgcagtgggagcccccagaggagcccaacggcctggtgcggggctacagagtgtactacaccccagacagccggcggcccccaaatgcctggcacaagcacaacacagatgctggcctgctgaccaccgtgggcagcctgctgcccggcatcacctacagcctgcgggtgctggccttcaccgctgtgggagatggcccccccagccccaccatccaggtgaagacccagcagggcgtgcctgcccagcctgctgacttccaggccgaggtggagagtgacacccgcatccagctgtcctggctgctgcccccccaggagcgcatcatcatgtatgagctggtgtactgggccgcagaagatgaggaccagcagcacaaggtgacctttgaccccaccagcagctacaccctggaggacctgaagccagacaccctgtaccgcttccagctggccgcccggagtgacatgggcgtgggcgtcttcacccccaccatcgaggccaggacagcccagagcaccccatctgccccaccccagaaggtgatgtgtgtgtccatgggcagcaccaccgtgcgggtgtcctgggtgcccccacctgctgacagcagaaatggagtcatcacccagtacagcgtggcctatgaggccgtggatggagaggaccggggcagacatgtggtggatggcatcagccgggagcacagctcctgggacctggtgggcctggagaagtggacagagtacagagtgtgggtgcgggcccacacagatgtgggccctggccctgagagcagccctgtgctggtgaggacagatgaagatgtgcccagcggcccccccaggaaggtggaggtggagcccctgaacagcacagctgtgcacgtgtactggaagctgcctgtgcccagcaagcagcacggccagatccggggctaccaggtgacctacgtgcggctggagaatggagagccccggggcctgcccatcatccaggatgtgatgctggccgaggcccagtggaggcctgaggagagcgaggactatgagaccaccatcagcggcctgaccccagagaccacctacagcgtgacagtggccgcctacaccaccaagggagatggagcccggagcaagcccaagatcgtgaccaccactggagctgtgcccggccggcccaccatgatgatcagcaccacagccatgaacacagccctgctgcagtggcacccccccaaggagctgcctggagagctgctgggctaccgcctgcagtactgcagagcagatgaggcccggcccaacaccatcgactttgggaaggatgaccagcacttcaccgtgacaggcctgcacaagggcaccacctacatcttccggctggccgccaagaacagagctggcctgggggaggagtttgagaaggagatccgcaccccagaggacctgcccagcggcttcccccagaacctgcacgtgacaggcctgaccaccagcaccacagagctggcctgggacccccctgtgctggccgagagaaatggccgcatcatctcctacacagtggtgttccgggacatcaacagccagcaggagctgcagaacatcaccacagacacccgcttcaccctgaccggcctgaagccagacaccacctatgacatcaaggtgcgggcctggaccagcaagggcagcggccccctgagccccagcatccagagcaggaccatgcctgtggagcaggtgtttgccaagaacttccgggtggccgccgccatgaagacctctgtgctgctgtcctgggaggtgcctgacagctacaagtctgctgtgcccttcaagatcctgtacaacggccagagcgtggaggtggatggccacagcatgaggaagctgattgctgacctgcagcccaacacagagtacagctttgtgctgatgaacagaggcagcagcgctgggggcctgcagcacctggtgtccatcagaacagccccagacctgctgccccacaagcccctgcctgccagcgcctacattgaagatggccgctttgacctgtccatgccccacgtgcaggaccccagcctggtgcgctggttctacatcgtggtggtgcccatcgacagagtgggcggctccatgctgaccccccgctggagcaccccagaggagctggagctggatgagctgctggaggccatcgagcagggcggggaggagcagaggagaagaagacggcaggccgagcggctgaagccctacgtggccgcccagctggatgtgctgcctgagaccttcaccctgggggacaagaagaactaccggggcttctacaaccggcccctgagcccagacctgagctaccagtgctttgtgctggccagcctgaaggagcccatggaccagaagagatatgccagcagcccctacagtgatgagatcgtggtgcaggtgaccccagcccagcagcaggaggagcctgagatgctgtgggtgactggacctgtgctggccgtcatcctgatcatcctgattgtgattgccatcctgctcttcaagaggaagaggacccacagccccagcagcaaggatgagcagagcatcggcctgaaggacagcctgctggcccacagcagtgaccctgtggagatgaggcggctgaactaccagaccccaggcatgagggaccacccccccatccccatcacagacctggccgacaacatcgagcggctgaaggccaatgatggcctgaagttcagccaggagtatgagagcattgatcctggccagcagttcacctgggagaacagcaacctggaggtgaacaagcccaagaacagatatgccaacgtgattgcctatgaccacagcagggtcatcctgaccagcattgatggagtgcccggcagtgactacatcaatgccaactacattgatggctacaggaagcagaatgcctacatcgccacccagggccccctgcctgagaccatgggagacttctggaggatggtgtgggagcagaggacagccaccgtggtgatgatgacccggctggaggagaagagccgggtgaagtgtgaccagtactggccagcccggggcacagagacctgtggcctcatccaggtgaccctgctggacacagtggagctggccacctacacagtgaggacctttgccctgcacaagagcggcagcagcgagaagcgggagctgcggcagttccagttcatggcctggccagaccatggagtgcctgagtaccccacccccatcctggccttcctgcggcgggtgaaggcctgcaaccccctggatgctggccccatggtggtgcactgcagcgctggggtgggccgcacaggctgcttcatcgtgattgatgccatgctggagaggatgaagcatgagaagacagtggacatctacggccacgtgacctgcatgaggagccagaggaactacatggtgcagacagaggaccagtatgtgttcatccacgaggccctgctggaggccgccacctgtggccacacagaggtgcctgccaggaacctgtatgcccacatccagaagctgggccaggtgcccccaggagagagcgtgacagccatggagctggagttcaagctgctggccagcagcaaggcccacaccagccgcttcatcagcgccaacctgccctgcaacaagttcaagaaccggctggtgaacatcatgccctatgagctgaccagggtgtgcctgcagcccatccggggcgtggagggcagtgactacatcaatgccagcttcctggatggctaccggcagcagaaggcctacatcgccacccagggccccctggccgagagcacagaggacttctggaggatgctgtgggagcacaacagcaccatcatcgtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggaccatccggcagttccagttcacagactggccagagcagggcgtgcccaagacaggagagggcttcatcgacttcatcggccaggtgcacaagaccaaggagcagtttggccaggacggccccatcaccgtgcactgcagcgctggggtgggccgcactggagtcttcatcaccctgagcatcgtgctggagaggatgagatatgaaggagtggtggacatgttccagacagtgaagaccctgcggacccagaggcctgccatggtgcagacagaggaccagtaccagctgtgctaccgggccgccctggagtacctgggcagctttgaccactacgccacctag

SEQ ID NO: 166332 - DNA, 5697 bp, Artificial Sequence
  Description of Artificial Sequence: Synthetic coding sequence
atggcccctgagcccgcccctggccgcaccatggtgcccctggtgcctgccctggtgatgctgggcctggtggccggggcccacggggacagcaagcctgtgttcatcaaggtgcctgaggaccagacaggcctgagcggcggcgtggccagctttgtgtgccaggccactggagagcccaagccccgcatcacctggatgaagaagggcaagaaggtgagcagccagagatttgaggtgattgaatttgatgatggagctggctctgtgctgcgcatccagcccctgcgggtgcagagagatgaggccatctatgagtgcacagccaccaacagcctgggggagatcaacaccagcgccaagctgtctgtgctggaggaggagcagctgcccccaggcttccccagcattgacatgggcccccagctgaaggtggtggagaaggccaggacagccaccatgctgtgtgccgccggcggcaacccagaccctgagatctcctggttcaaggacttcctgcctgtggaccctgccaccagcaatggccgcatcaagcagctgcggagcggggccctgcagatcgagagcagcgaggagagtgaccagggcaagtatgaatgtgtggccaccaacagcgctggcacccgctacagcgccccagccaacctgtatgtgcgggtgcggcgggtggccccccgcttcagcatcccccccagcagccaggaggtgatgcctgggggctctgtgaacctgacctgtgtggccgtgggcgcccccatgccctacgtgaagtggatgatgggcgctgaggagctgaccaaggaggatgagatgcctgtgggcagaaatgtgctggagctgagcaatgtggtgcgcagcgccaactacacctgtgtggccatcagcagcctgggcatgattgaggccacagcccaggtgacagtgaaggccctgcccaagccacccatcgacctggtggtgacagagaccacagccacctctgtgaccctgacctgggacagcggcaacagcgagcctgtgacctactacggcatccagtacagagctgctggaacagagggccccttccaggaggtggatggagtggccaccacccgctacagcatcggcggcctgagccccttctctgaatatgccttccgggtgctggccgtgaacagcatcggccggggccccccatctgaggccgtgcgggccaggactggagagcaggcccccagcagccccccccggcgggtgcaggccaggatgctgagcgccagcaccatgctggtgcagtgggagcccccagaggagcccaacggcctggtgcggggctacagagtgtactacaccccagacagccggcggcccccaaatgcctggcacaagcacaacacagatgctggcctgctgaccaccgtgggcagcctgctgcccggcatcacctacagcctgcgggtgctggccttcaccgctgtgggagatggcccccccagccccaccatccaggtgaagacccagcagggcgtgcctgcccagcctgctgacttccaggccgaggtggagagtgacacccgcatccagctgtcctggctgctgcccccccaggagcgcatcatcatgtatgagctggtgtactgggccgcagaagatgaggaccagcagcacaaggtgacctttgaccccaccagcagctacaccctggaggacctgaagccagacaccctgtaccgcttccagctggccgcccggagtgacatgggcgtgggcgtcttcacccccaccatcgaggccaggacagcccagagcaccccatctgccccaccccagaaggtgatgtgtgtgtccatgggcagcaccaccgtgcgggtgtcctgggtgcccccacctgctgacagcagaaatggagtcatcacccagtacagcgtggcctatgaggccgtggatggagaggaccggggcagacatgtggtggatggcatcagccgggagcacagctcctgggacctggtgggcctggagaagtggacagagtacagagtgtgggtgcgggcccacacagatgtgggccctggccctgagagcagccctgtgctggtgaggacagatgaagatgtgcccagcggcccccccaggaaggtggaggtggagcccctgaacagcacagctgtgcacgtgtactggaagctgcctgtgcccagcaagcagcacggccagatccggggctaccaggtgacctacgtgcggctggagaatggagagccccggggcctgcccatcatccaggatgtgatgctggccgaggcccaggagaccaccatcagcggcctgaccccagagaccacctacagcgtgacagtggccgcctacaccaccaagggagatggagcccggagcaagcccaagatcgtgaccaccaccggggctgtgcccggccggcccaccatgatgatcagcaccacagccatgaacacagccctgctgcagtggcacccccccaaggagctgcccggggagctgctgggctaccgcctgcagtactgcagagcagatgaggcccggcccaacaccatcgactttgggaaggatgaccagcacttcaccgtgacaggcctgcacaagggcaccacctacatcttccggctggccgccaagaacagagctggcctgggggaggagtttgagaaggagatccgcaccccagaggacctgcccagcggcttcccccagaacctgcacgtgacaggcctgaccaccagcaccacagagctggcctgggacccccctgtgctggccgagagaaatggccgcatcatctcctacacagtggtgttccgggacatcaacagccagcaggagctgcagaacatcaccacagacacccgcttcaccctgaccggcctgaagccagacaccacctatgacatcaaggtgcgggcctggaccagcaaaggaagtggccccctgagccccagcatccagagcaggaccatgcctgtggagcaggtgtttgccaagaacttccgggtggccgccgccatgaagacctctgtgctgctgtcctgggaggtgcctgacagctacaagtctgctgtgcccttcaagatcctgtacaacggccagagcgtggaggtggatggccacagcatgaggaagctgattgctgacctgcagcccaacacagagtacagctttgtgctgatgaacagaggcagcagcgctgggggcctgcagcacctggtgtccatcagaacagccccagacctgctgccccacaagcccctgcctgccagcgcctacattgaagatggccgctttgacctgtccatgcctcatgtgcaggaccccagcctggtgcgctggttctacatcgtggtggtgcccatcgacagagtgggcggctccatgctgaccccccgctggagcaccccagaggagctggagctggatgagctgctggaggccatcgagcagggcggggaggagcagaggagaagaagacggcaggccgagcggctgaagccctacgtggccgcccagctggatgtgctgcctgagaccttcaccctgggggacaagaagaactaccggggcttctacaaccggcccctgagcccagacctgagctaccagtgctttgtgctggccagcctgaaggagcccatggaccagaagagatatgccagcagcccctacagtgatgaaattgtggtgcaggtgaccccagcccagcagcaggaggagcctgagatgctgtgggtgacaggccctgtgctggccgtcatcctgatcatcctgattgtcatcgccatcctgctcttcaagaggaagaggacccacagccccagcagcaaggatgagcagagcatcggcctgaaggacagcctgctggcccacagcagtgaccctgtggagatgaggcggctgaactaccagaccccaggcatgagggaccacccccccatccccatcacagacctggccgacaacatcgagcggctgaaggccaatgatggcctgaagttcagccaggagtatgagagcattgaccccggccagcagttcacctgggagaacagcaacctggaggtgaacaagcccaagaacagatatgccaacgtcatcgcctatgaccacagcagggtcatcctgaccagcattgatggagtgcccggcagtgactacatcaatgccaactacattgatggctacaggaagcagaatgcctacatcgccacccagggccccctgcctgagaccatgggagacttctggaggatggtgtgggagcagaggacagccaccgtggtgatgatgacccggctggaggagaagagccgggtgaagtgtgaccagtactggccagcccggggcacagagacctgtggcctcatccaggtgaccctgctggacacagtggagctggccacctacacagtgaggacctttgccctgcacaagagcggcagcagcgagaagcgggagctgcggcagttccagttcatggcctggccagaccacggcgtgcctgagtaccccacccccatcctggccttcctgcggcgggtgaaggcctgcaaccccctggatgctggccccatggtggtgcactgcagcgctggggtgggccgcacaggctgcttcatcgtgattgatgccatgctggagaggatgaagcatgagaagacagtggacatctacggccacgtgacctgcatgaggagccagaggaactacatggtgcagacagaggaccagtatgtgttcatccacgaggccctgctggaggccgccacctgtggccacacagaggtgcctgccaggaacctgtatgcccacatccagaagctgggccaggtgcccccaggagagagcgtgacagccatggagctggagttcaagctgctggccagcagcaaggcccacaccagccgcttcatcagcgccaacctgccctgcaacaagttcaagaaccggctggtgaacatcatgccctatgagctgaccagggtgtgcctgcagcccatccggggcgtggagggcagtgactacatcaatgccagcttcctggatggctaccggcagcagaaggcctacatcgccacccagggccccctggccgagagcacagaggacttctggaggatgctgtgggagcacaacagcaccatcatcgtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggaccatccggcagttccagttcacagactggccagagcagggcgtgcccaagacaggagagggcttcatcgacttcatcggccaggtgcacaagaccaaggagcagtttggccaggacggccccatcaccgtgcactgcagcgctggggtgggccgcactggagtcttcatcaccctgagcatcgtgctggagaggatgagatatgagggcgtggtggacatgttccagacagtgaagaccctgcggacccagaggcctgccatggtgcagacagaggaccagtaccagctgtgctacagagctgccctggagtacctgggcagctttgaccactacgccacctag

SEQ ID NO: 166333 - DNA, 5724 bp, Artificial Sequence; identical to SEQ ID NO: 166331
  Description of Artificial Sequence: Synthetic coding sequence

SEQ ID NO: 166334 - DNA, 3801 bp, Artificial Sequence
  Description of Artificial Sequence: Synthetic coding sequence
atgtatgagctggtgtactgggccgcagaagatgaggaccagcagcacaaggtgacctttgaccccaccagcagctacaccctggaggacctgaagccagacaccctgtaccgcttccagctggccgcccggagtgacatgggcgtgggcgtcttcacccccaccatcgaggccaggacagcccagagcatgcccagcggcccccccaggaaggtggaggtggagcccctgaacagcacagctgtgcacgtgtactggaagctgcctgtgcccagcaagcagcacggccagatccggggctaccaggtgacctacgtgcggctggagaatggagagccccggggcctgcccatcatccaggatgtgatgctggccgaggcccaggagaccaccatcagcggcctgaccccagagaccacctacagcgtgacagtggccgcctacaccaccaagggagatggagcccggagcaagcccaagatcgtgaccaccactggagctgtgcccggccggcccaccatgatgatcagcaccacagccatgaacacagccctgctgcagtggcacccccccaaggagctgcctggagagctgctgggctaccgcctgcagtactgcagagcagatgaggcccggcccaacaccatcgactttgggaaggatgaccagcacttcaccgtgacaggcctgcacaagggcaccacctacatcttccggctggccgccaagaacagagctggcctgggggaggagtttgagaaggagatccgcaccccagaggacctgcccagcggcttcccccagaacctgcacgtgacaggcctgaccaccagcaccacagagctggcctgggacccccctgtgctggccgagagaaatggccgcatcatctcctacacagtggtgttccgggacatcaacagccagcaggagctgcagaacatcaccacagacacccgcttcaccctgaccggcctgaagccagacaccacctatgacatcaaggtgcgggcctggaccagcaagggcagcggccccctgagccccagcatccagagcaggaccatgcctgtggagcaggtgtttgccaagaacttccgggtggccgccgccatgaagacctctgtgctgctgtcctgggaggtgcctgacagctacaagtctgctgtgcccttcaagatcctgtacaacggccagagcgtggaggtggatggccacagcatgaggaagctgattgctgacctgcagcccaacacagagtacagctttgtgctgatgaacagaggcagcagcgctgggggcctgcagcacctggtgtccatcagaacagccccagacctgctgccccacaagcccctgcctgccagcgcctacattgaagatggccgctttgacctgtccatgccccacgtgcaggaccccagcctggtgcgctggttctacatcgtggtggtgcccatcgacagagtgggcggctccatgctgaccccccgctggagcaccccagaggagctggagctggatgagctgctggaggccatcgagcagggcggggaggagcagaggagaagaagacggcaggccgagcggctgaagccctacgtggccgcccagctggatgtgctgcctgagaccttcaccctgggggacaagaagaactaccggggcttctacaaccggcccctgagcccagacctgagctaccagtgctttgtgctggccagcctgaaggagcccatggaccagaagagatatgccagcagcccctacagtgatgagatcgtggtgcaggtgaccccagcccagcagcaggaggagcctgagatgctgtgggtgactggacctgtgctggccgtcatcctgatcatcctgattgtgattgccatcctgctcttcaagaggaagaggacccacagccccagcagcaaggatgagcagagcatcggcctgaaggacagcctgctggcccacagcagtgaccctgtggagatgaggcggctgaactaccagaccccaggcagctctgtgcccagctgccccaacaccagctccatgagggaccacccccccatccccatcacagacctggccgacaacatcgagcggctgaaggccaatgatggcctgaagttcagccaggagtatgagagcattgaccccggccagcagttcacctgggagaacagcaacctggaggtgaacaagcccaagaacagatatgccaacgtcatcgcctatgaccacagcagggtcatcctgaccagcattgatggagtgcccggcagtgactacatcaatgccaactacattgatggctacaggaagcagaatgcctacatcgccacccagggccccctgcctgagaccatgggagacttctggaggatggtgtgggagcagaggacagccaccgtggtgatgatgacccggctggaggagaagagccgggtgaagtgtgaccagtactggccagcccggggcacagagacctgtggcctcatccaggtgaccctgctggacacagtggagctggccacctacacagtgaggacctttgccctgcacaagagcggcagcagcgagaagcgggagctgcggcagttccagttcatggcctggccagaccacggcgtgcctgagtaccccacccccatcctggccttcctgcggcgggtgaaggcctgcaaccccctggatgctggccccatggtggtgcactgcagcgctggggtgggccgcacaggctgcttcatcgtgattgatgccatgctggagaggatgaagcatgagaagacagtggacatctacggccacgtgacctgcatgaggagccagaggaactacatggtgcagacagaggaccagtatgtgttcatccacgaggccctgctggaggccgccacctgtggccacacagaggtgcctgccaggaacctgtatgcccacatccagaagctgggccaggtgcccccaggagagagcgtgacagccatggagctggagttcaagctgctggccagcagcaaggcccacaccagccgcttcatcagcgccaacctgccctgcaacaagttcaagaaccggctggtgaacatcatgccctatgagctgaccagggtgtgcctgcagcccatccggggcgtggagggcagtgactacatcaatgccagcttcctggatggctaccggcagcagaaggcctacatcgccacccagggccccctggccgagagcacagaggacttctggaggatgctgtgggagcacaacagcaccatcatcgtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggaccatccggcagttccagttcacagactggccagagcagggcgtgcccaagacaggagagggcttcatcgacttcatcggccaggtgcacaagaccaaggagcagtttggccaggacggccccatcaccgtgcactgcagcgctggggtgggccgcactggagtcttcatcaccctgagcatcgtgctggagaggatgagatatgagggcgtggtggacatgttccagacagtgaagaccctgcggacccagaggcctgccatggtgcagacagaggaccagtaccagctgtgctacagagctgccctggagtacctgggcagctttgaccactacgccacctag

SEQ ID NO: 166335 - DNA, 5697 bp, Artificial Sequence; identical to SEQ ID NO: 166332
  Description of Artificial Sequence: Synthetic coding sequence

SEQ ID NO: 166336 - DNA, 3609 bp, Artificial Sequence
  Description of Artificial Sequence: Synthetic coding sequence
atgatgtgtgaggtgatgcccaccatcagcgaggccgagggccccccaggcggcggcggcggccacggcagcggcagccccagccagccagatgctgacagccactttgagcagctgatggtgtccatgctggaggagcgggaccggctgctggacaccctgcgggagacccaggagaccctggccctgacccagggcaagctgcacgaggtgggccacgagcgggacagcctgcagaggcagctgaacacagccctgccccaggagtttgctgccctgaccaaggagctgaatgtgtgccgggagcagctgctggagcgggaggaggagattgctgagctgaaggccgagaggaacaacacccggctgctgctggagcacctggagtgcctggtgtccagacatgagaggagcctgaggatgacagtggtgaagaggcaggcccagagccctgctggggtgagcagcgaggtggaggtgctgaaggccctgaagagcctgtttgagcaccacaaggccctggatgagaaggtgcgggagcggctgcgggtggccctggagcgctgcagcctgctggaggaggagctgggcgccacccacaaggagctgatgatcctgaaggagcagaacaaccagaagaagaccctgacagatggagtgctggacatcaaccacgagcaggagaacacccccagcaccagcggcaagaggagcagtgatggcagcctgagccatgaggaggacctggccaaggtgattgagctgcaggagatcatcagcaagcagagccgggagcagagccagatgaaggagcggctggccagcctgagcagccacgtgacagagctggaggaggacctggacacagccaggaaggacctgatcaagtctgaggagatgaacaccaagctgcagagagatgtgcgggaggccatggcccagaaggaggacatggaggagcgcatcaccaccctggagaagcgctacctggccgcccagcgggaggccacctctgtgcatgacctgaatgacaagctggagaatgagatcgccaacaaggacagcatgcaccggcagacagaggacaagaaccggcagctgcaggagcggctggagctggccgagcagaagctgcagcagaccctgaggaaggccgagaccctgcctgaggtggaggccgagctggcccagagggtggccgccctgagcaaggccgaggagagacatggcaacatcgaggagcggctgcggcagatggaggcccagctggaggagaagaaccaggagctgcagagggcccggcagcgggagaagatgaatgaggagcacaacaagaggctgagtgacacagtggacaagctgctgtctgagagcaatgaaaggctgcagctgcacctgaaggagaggatggccgccctggaggacaagaacagcctgctgcgggaggtggagagcgccaagaagcagctggaggagacccagcacgacaaggaccagctggtgctgaacatcgaggccctgcgggcagagctggaccacatgaggctgcggggggccagcctgcaccacggccggccccacctgggctctgtgcctgacttccgcttccccatggctgatggccacacagacagctacagcaccagcgctgtgctgcggcggccccagaagggccgcctggccgccctgagagatgagcccagcaaggtgcagaccctgaatgagcaggactgggagcgggcccagcaggcctctgtgctggccaacgtggcccaggcctttgaaagtgatgctgatgtgtctgatggagaagatgaccgggacaccctgctgagctctgtggacctgctgagccccagcggccaggctgatgcccacaccctggccatgatgctgcaggagcagctggatgccatcaacaaggagatccgcctcatccaggaggagaaggaaaatacagagcagagagctgaggagattgagagccgggtgggcagcggcagcctggacaacctgggccgcttccgctccatgagcagcatccccccctacccagccagcagcctggccagcagcagccccccaggcagcggccgcagcaccccccggcgcatcccccacagccctgcccgggaggtggaccggctgggcgtgatgaccctgctgccccccagccgggaggaggtgagagatgacaagaccaccatcaagtgtgagaccagcccccccagcagcccccgggccctgcggctggaccggctgcacaagggggccctgcacacagtgtcccatgaggacatccgggacatccggaacagcacaggcagccaggacggccctgtgagcaaccccagcagcagcaacagcagccaggacagcctgcacaaggcccccaagaagaagggcatcaagagcagcatcggccgcctgtttgggaagaaggagaagggccggcccggccagacaggcaaggaggccctgggccaggccggcgtgtctgaaacagacaacagcagccaggatgccctgggcctgagcaagctgggcggccaggccgagaagaacaggaagctgcagaagaagcatgagctgctggaggaggcccggcggcagggcctgccctttgcccagtgggatggccccaccgtggtggtgtggctggagctgtgggtgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatcatgagcctgaccagccccagcgccccacccaccagcaggaccaccctggcctatggagacatgaaccacgagtggattggaaatgagtggctgcccagcctgggcctgccccagtaccgcagctacttcatggagtgcctggtggatgccaggatgctggaccacctgaccaagaaggacctgcggggccagctgaagatggtggacagcttccacaggaacagcttccagtgtggcatcatgtgcctgcggcggctgaactatgacaggaaggagctggagaggaagcgggaggagagccagagcgagatcaaggatgtgctggtgtggagcaatgacagagtcatccgctggatcctgagcatcggcctgaaggagtatgccaacaacctgattgaaagtggagtgcacggggccctgctggccctggatgagacctttgacttcagcgccctggccctgctgctgcagatccccacccagaacacccaggcccgggctgtgctggagcgggagttcaacaacctgctggtgatgggcacagacagaagatttgatgaagatgatgacaagagcttcagaagagcccccagctggaggaagaagttccggcccaaggacatccggggcctggccgccggcagcgctgagaccctgcctgccaacttccgggtgaccagctccatgagcagccccagcatgcagcccaagaagatgcagatggatggaaatgtgtctggcacccagaggctggacagcgccaccgtgaggacctacagctgctag

SEQ ID NO: 166337 - DNA, 3558 bp, Artificial Sequence
  Description of Artificial Sequence: Synthetic coding sequence
atgatgtgtgaggtgatgcccaccatcagcgaggccgagggccccccaggcggcggcggcggccacggcagcggcagccccagccagccagatgctgacagccactttgagcagctgatggtgtccatgctggaggagcgggaccggctgctggacaccctgcgggagacccaggagaccctggccctgacccagggcaagctgcacgaggtgggccacgagcgggacagcctgcagaggcagctgaacacagccctgccccaggagtttgctgccctgaccaaggagctgaatgtgtgccgggagcagctgctggagcgggaggaggagattgctgagctgaaggccgagaggaacaacacccggctgctgctggagcacctggagtgcctggtgtccagacatgagaggagcctgaggatgacagtggtgaagaggcaggcccagagccctgctggggtgagcagcgaggtggaggtgctgaaggccctgaagagcctgtttgagcaccacaaggccctggatgagaaggtgcgggagcggctgcgggtggccctggagcgctgcagcctgctggaggaggagctgggcgccacccacaaggagctgatgatcctgaaggagcagaacaaccagaagaagaccctgacagatggagtgctggacatcaaccacgagcaggagaacacccccagcaccagcggcaagaggagcagtgatggcagcctgagccatgaggaggacctggccaaggtgattgagctgcaggagatcatcagcaagcagagccgggagcagagccagatgaaggagcggctggccagcctgagcagccacgtgacagagctggaggaggacctggacacagccaggaaggacctgatcaagtctgaggagatgaacaccaagctgcagagagatgtgcgggaggccatggcccagaaggaggacatggaggagcgcatcaccaccctggagaagcgctacctggccgcccagcgggaggccacctctgtgcatgacctgaatgacaagctggagaatgagatcgccaacaaggacagcatgcaccggcagacagaggacaagaaccggcagctgcaggagcggctggagctggccgagcagaagctgcagcagaccctgaggaaggccgagaccctgcctgaggtggaggccgagctggcccagagggtggccgccctgagcaaggccgaggagagacatggcaacatcgaggagcggctgcggcagatggaggcccagctggaggagaagaaccaggagctgcagagggcccggcagcgggagaagatgaatgaggagcacaacaagaggctgagtgacacagtggacaagctgctgtctgagagcaatgaaaggctgcagctgcacctgaaggagaggatggccgccctggaggacaagaacagcctgctgcgggaggtggagagcgccaagaagcagctggaggagacccagcacgacaaggaccagctggtgctgaacatcgaggccctgcgggcagagctggaccacatgaggctgcggggggccagcctgcaccacggccggccccacctgggctctgtgcctgacttccgcttccccatggctgatggccacacagacagctacagcaccagcgctgtgctgcggcggccccagaagggccgcctggccgccctgagagatgagcccagcaaggtgcagaccctgaatgagcaggactgggagcgggcccagcaggcctctgtgctggccaacgtggcccaggcctttgaaagtgatgctgatgtgtctgatggagaagatgaccgggacaccctgctgagctctgtggacctgctgagccccagcggccaggctgatgcccacaccctggccatgatgctgcaggagcagctggatgccatcaacaaggagatccgcctcatccaggaggagaaggaaaatacagagcagagagctgaggagattgagagccgggtgggcagcggcagcctggacaacctgggccgcttccgctccatgagcagcatccccccctacccagccagcagcctggccagcagcagccccccaggcagcggccgcagcaccccccggcgcatcccccacagccctgcccgggaggtggaccggctgggcgtgatgaccctgctgccccccagccgggaggaggtgagagatgacaagaccaccatcaagtgtgagaccagcccccccagcagcccccgggccctgcggctggaccggctgcacaagggggccctgcacacagtgtcccatgaggacatccgggacatccggaacagcacaggcagccaggacggccctgtgagcaaccccagcagcagcaacagcagccaggacagcctgcacaaggcccccaagaagaagggcatcaagagcagcatcggccgcctgtttgggaagaaggagaagggccggcccggccagacaggcaaggaggccctgggccaggccggcgtgtctgaaacagacaacagcagccaggatgccctgggcctgagcaagctgggcggccaggccgagaagaacaggaagctgcagaagaagcatgagctgctggaggaggcccggcggcagggcctgccctttgcccagtgggatggccccaccgtggtggtgtggctggagctgtgggtgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatcatgagcctgaccagccccagcgccccacccaccagcaggaccaccctggcctatggagacatgaaccacgagtggattggaaatgagtggctgcccagcctgggcctgccccagtaccgcagctacttcatggagtgcctggtggatgccaggatgctggaccacctgaccaagaaggacctgcggggccagctgaagatggtggacagcttccacaggaacagcttccagtgtggcatcatgtgcctgcggcggctgaactatgacaggaaggagctggagaggaagcgggaggagagccagagcgagatcaaggatgtgctggtgtggagcaatgacagagtcatccgctggatcctgagcatcggcctgaaggagtatgccaacaacctgattgaaagtggagtgcacggggccctgctggccctggatgagacctttgacttcagcgccctggccctgctgctgcagatccccacccagaacacccaggcccgggctgtgctggagcgggagttcaacaacctgctggtgatgggcacagacagaagatttgatgaagatgatgacaagagcttcagaagagcccccagctggaggaagaagttccggcccaaggacatccggggcctggccgccggcagcgctgagaccctgcctgccaacttccgggtgaccagctccatgagcagccccagcatgcagcccaagaagatgcagatggatggcatgtag

SEQ ID NO: 166338 - DNA, 477 bp, Artificial Sequence
  Description of Artificial Sequence: Synthetic coding sequence
atgatgtgtgaggtgatgcccaccatcagcgaggccgagggccccccaggcggcggcggcggccacggcagcggcagccccagccagccagatgctgacagccactttgagcagctgatggtgtccatgctggaggagcgggaccggctgctggacaccctgcgggagacccaggagaccctggccctgacccagggcaagctgcacgaggtgggccacgagcgggacagcctgcagaggcagctgaacacagccctgccccaggagtttgctgccctgaccaaggagctgaatgtgtgccgggagcagctgctggagcgggaggaggagattgctgagctgaaggccgagaggaacaacacccggctgctgctggagcacctggagtgcctggtgtccagacatgagaggagcctgaggatgacagtggtgaagaggcaggcccagagccctgctggggtgagcagcgaggtgtag

SEQ ID NO: 166339 - DNA, 300 bp, Artificial Sequence
  Description of Artificial Sequence: Synthetic coding sequence
atgatgtgtgaggtgatgcccaccatcagcgaggccgagggccccccaggcggcggcggcggccacggcagcggcagccccagccagccagatgctgacagccactttgagcagctgatggtgtccatgctggaggagcgggaccggctgctggacaccctgcgggagacccaggagaccctggccctgacccagggcaagctgcacgaggtgggccacgagcgggacagcctgcagaggcagctgaacacagccctgccccaggagtttgctgccctgaccaaggagctgaatgtgtag

SEQ ID NO: 166340 - DNA, 2100 bp, Artificial Sequence
  Description of Artificial Sequence: Synthetic coding sequence
atgaggctgcggggggccagcctgcaccacggccggccccacctgggctctgtgcctgacttccgcttccccatggctgatggccacacagacagctacagcaccagcgctgtgctgcggcggccccagaagggccgcctggccgccctgagagatgagcccagcaaggtgcagaccctgaatgagcaggactgggagcgggcccagcaggcctctgtgctggccaacgtggcccaggcctttgaaagtgatgctgatgtgtctgatggagaagatgaccgggacaccctgctgagctctgtggacctgctgagccccagcggccaggctgatgcccacaccctggccatgatgctgcaggagcagctggatgccatcaacaaggagatccgcctcatccaggaggagaaggagaacacagagcagagagctgaggagattgagagccgggtgggcagcggcagcctggacaacctgggccgcttccgctccatgagcagcatccccccctacccagccagcagcctggccagcagcagccccccaggcagcggccgcagcaccccccggcgcatcccccacagccctgcccgggaggtggaccggctgggcgtgatgaccctgcccagcgacctgaggaagcacaggaggaagctgccccccagccgggaggaggtgagagatgacaagaccaccatcaagtgtgagaccagcccccccagcagcccccgggccctgcggctggaccggctgcacaagggggccctgcacacagtgtcccatgaggacatccgggacatccggaacagcacaggcagccaggacggccctgtgagcaaccccagcagcagcaacagcagccaggacagcctgcacaaggcccccaagaagaagggcatcaagagcagcatcggccgcctgtttgggaagaaggagaagggccggcccggccagacaggcaaggaggccctgggccaggccggcgtgtctgaaacagacaacagcagccaggatgccctgggcctgagcaagctgggcggccaggccgagaagaacaggaagctgcagaagaagcatgagctgctggaggaggcccggcggcagggcctgccctttgcccagtgggatggccccaccgtggtggtgtggctggagctgtgggtgggcatgcctgcctggtacgtggccgcctgccgggccaacgtgaagagcggggccatcatgtctgccctgagtgacacagagatccagcgggagatcggcatcagcaaccccctgcaccggctgaagctgcggctggccatccaggagatcatgagcctgaccagccccagcgccccacccaccagcaggaccaccctggcctacggggacatgaaccacgagtggattggaaatgagtggctgcccagcctgggcctgccccagtaccgcagctacttcatggagtgcctggtggatgccaggatgctggaccacctgaccaagaaggacctgcggggccagctgaagatggtggacagcttccacagaaattccttccagtgtggcatcatgtgcctgcggcggctgaactatgacaggaaggagctggagaggaagcgggaggagagccagagcgagatcaaggatgtgctggtgtggagcaatgacagagtcatccgctggatcctgagcatcggcctgaaggagtatgccaacaacctgattgagagcggcgtgcatggagccctgctggccctggatgagacctttgacttcagcgccctggccctgctgctgcagatccccacccagaacacccaggcccgggctgtgctggagcgggagttcaacaacctgctggtgatgggcacagacagaagatttgatgaagatgatgacaagagcttccggcgggcccccagctggaggaagaagttccggcccaaggacatccggggcctggccgccggcagcgctgagaccctgcctgccaacttccgggtgaccagctccatgagcagccccagcatgcagcccaagaagatgcagatggatggaaatgtgtctggcacccagaggctggacagcgccaccgtgaggacctacagctgctag

SEQ ID NO: 166341 - DNA, 3585 bp, Artificial Sequence
  Description of Artificial Sequence: Synthetic coding sequence
atgatgtgtgaggtgatgcccaccatcagtgaagatggccggcggggcagcgccctgggcccagatgaggccggcggggagctggagcggctgatggtgaccatgctgacagagcgggagcggctgctggagaccctgcgggaggcccaggacggcctggccacagcccagctgcggctgcgggagctgggccacgagaaggacagcctgcagaggcagctgagcatcgccctgccccaggagtttgctgccctgaccaaggagctgaacctgtgccgggagcagctgctggagcgggaggaggagattgctgagctgaaggccgagaggaacaacacccggctgctgctggagcacctggagtgcctggtgtccagacatgagaggagcctgaggatgacagtggtgaagaggcaggcccagagccctggaggagtgagcagcgaggtggaggtgctgaaggccctgaagagcctgtttgagcaccacaaggccctggatgagaaggtgcgggagcggctgaggatggccctggagcgggtggccgtgctggaggaggagctggagctgagcaaccaggagaccctgaacctgcgggagcagctgagcagaagaagaagtggcctggaggagcccgggaaggatggagatggccagaccctggccaacggcctgggccctggaggagacagcaacagaagaacagctgagctggaggaggccctggagcggcagagagctgaggtgtgccagctgcgggagcggctggccgtgctgtgccggcagatgagccagctggaggaggagctgggcacagcccaccgggagctgggcaaggccgaggaggccaacagcaagctgcagagggacctgaaggaggccctggcccagcgggaggacatggaggagcgcatcaccaccctggagaagcgctacctgagcgcccagcgggaggccaccagcctgcatgatgccaatgacaagctggagaatgagctggccagcaaggagagcctgtaccggcagagcgaggagaagagccggcagctggccgagtggctggatgatgccaagcagaagctgcagcagaccctgcagaaggccgagaccctgcctgagattgaggcccagctggcccagagggtggccgccctgaacaaggccgaggagcggcacggcaactttgaggagcggctgcggcagctggaggcccagctggaggagaagaaccaggagctgcagagggcccggcagcgggagaagatgaatgatgaccacaacaagaggctgtctgaaacagtggacaagctgctgtctgagagcaatgaaaggctgcagctgcacctgaaggagaggatgggcgccctggaggagaagaacagcctgtctgaggagatcgccaacatgaagaagctgcaggatgagctgctgctgaacaaggagcagctgctggccgagatggagaggatgcagatggagattgaccagctgcggggccggccccccagcagctacagccgcagcctgcccggcagcgccctggagctgcgctacagccaggcccccaccctgcccagcggggcccacctggacccctacgtggccggcagcggccgggccggcaagaggggccgctggagcggcgtgaaggaggagcccagcaaggactgggagaggtctgccccagctggcagcatccccccacccttccctggagagctggatggcagtgatgaggaggaggccgagggcatgtttggagctgagctgctgagccccagcggccaggctgatgtgcagaccctggccatcatgctgcaggagcagctggaggccatcaacaaggagatcaagctgatccaggaggagaaggagaccacagagcagagagctgaggagctggagagccgggtgagcagcagcggcctggacagcctgggccgctaccgcagcagctgcagcctgccccccagcctgaccaccagcaccctggccagccccagcccccccagcagcggccacagcaccccccggctggccccacccagccctgcccgggagggcacagacaaggccaaccacgtgcccaaggaggaggccggggcccccagaggagagggccctgccatccctggggacaccccaccacccacccccaggtctgcccggctggagaggatgacccaggccctggccctgcaggccggcagcctggaggatggcggccccccccggggcagcgagggcaccccagacagcctgcacaaggcccccaagaagaagagcatcaagagcagcatcggccgcctgtttgggaagaaggagaagggccgcatgggccccccaggccgggacagcagcagcctggccggcacccccagtgatgagaccctggccacagaccccctgggcctggccaagctgactggacctggggacaaggacagaagaaacaagaggaagcatgagctgctggaggaggcctgccggcagggcctgccctttgctgcctgggatggccccaccgtggtgtcctggctggagctgtgggtgggcatgcctgcctggtacgtggccgcctgccgggccaacgtgaagagcggggccatcatggccaacctgagtgacacagagatccagcgggagatcggcatcagcaaccccctgcaccggctgaagctgcggctggccatccaggagatggtgtccctgaccagccccagcgccccagccagcagcaggaccagcactggaaatgtgtggatgacccatgaggagatggagagcctgacagccaccaccaagccagagaccaaggagatctcctgggagcagatcctggcctatggagacatgaaccacgagtgggtgggcaatgactggctgcccagcctgggcctgccccagtaccgcagctacttcatggagagcctggtggatgccaggatgctggaccacctgaacaagaaggagctgcggggccagctgaagatggtggacagcttccaccgggtgtccctgcactacggcatcatgtgcctgaagaggctgaactatgacaggaaggacctggagaggagaagagaggagagccagacccagatcagagatgtgatggtgtggagcaatgaaagagtgatgggctgggtgtctggcctgggcctgaaggagtttgccaccaacctgacagaaagtggagtgcacggggccctgctggccctggatgagacctttgactacagcgacctggccctgctgctgcagatccccacccagaatgcccaggcccggcagctgctggagaaggagttcagcaacctgatcagcctgggcacagaccggcggctggatgaggacagcgccaagagcttcagccgcagccccagctggaggaagatgttccgggagaaggacctgcggggcgtgaccccagacagcgctgagatgctgccccccaacttccgctctgctgctgctggggccctgggcagccctggcctgcccctgaggaagctgcagcctgagggccagaccagcggcagcagcagagcagatggagtgtctgtgaggacctacagctgctag

SEQ ID NO: 166342 - DNA, 1731 bp, Artificial Sequence
  Description of Artificial Sequence: Synthetic coding sequence
atgagcggccaggagtttgctgccctgaccaaggagctgaacctgtgccgggagcagctgctggagcgggaggaggagattgctgagctgaaggccgagaggaacaacacccggctgctgctggagcacctggagtgcctggtgtccagacatgagaggagcctgaggatgacagtggtgaagaggcaggcccagagccctggaggagtgagcagcgaggtggaggtgctgaaggccctgaagagcctgtttgagcaccacaaggccctggatgagaaggtgcgggagcggctgaggatggccctggagcgggtggccgtgctggaggaggagctggagctgagcaaccaggagaccctgaacctgcgggagcagctgagcagaagaagaagtggcctggaggagcccgggaaggatggagatggccagaccctggccaacggcctgggccctggaggagacagcaacagaagaacagctgagctggaggaggccctggagcggcagagagctgaggtgtgccagctgcgggagcggctggccgtgctgtgccggcagatgagccagctggaggaggagctgggcacagcccaccgggagctgggcaaggccgaggaggccaacagcaagctgcagagggacctgaaggaggccctggcccagcgggaggacatggaggagcgcatcaccaccctggagaagcgctacctgagcgcccagcgggaggccaccagcctgcatgatgccaatgacaagctggagaatgagctggccagcaaggagagcctgtaccggcagagcgaggagaagagccggcagctggccgagtggctggatgatgccaagcagaagctgcagcagaccctgcagaaggccgagaccctgcctgagattgaggcccagctggcccagagggtggccgccctgaacaaggccgaggagcggcacggcaactttgaggagcggctgcggcagctggaggcccagctggaggagaagaaccaggagctgcagagggcccggcagcgggagaagatgaatgatgaccacaacaagaggctgtctgaaacagtggacaagctgctgtctgagagcaatgaaaggctgcagctgcacctgaaggagaggatgggcgccctggaggagaagaacagcctgtctgaggagatcgccaacatgaagaagctgcaggatgagctgctgctgaacaaggagcagctgctggccgagatggagaggatgcagatggagattgaccagctgcggggccggccccccagcagctacagccgcagcctgcccggcagcgccctggagctgcgctacagccaggcccccaccctgcccagcggggcccacctggacccctacgtggccggcagcggccgggccggcaagaggggccgctggagcggcgtgaaggaggagcccagcaaggactgggagaggtctgccccagctggcagcatccccccacccttccctggagagctggatggcagtgatgaggaggaggccgagggcatgtttggagctgagctgctgagccccagcggccaggctgatgtgcagaccctggccatcatgctgcaggagcagctggaggccatcaacaaggagatcaagatcatgagcctgcggaggaagctggagctgcacgagggccggggccggcccagccaggagaccccccaccaccccctgcctgccctgcctgtgctgcgggagtag

SEQ ID NO: 166343 - DNA, 4338 bp, Artificial Sequence
  Description of Artificial Sequence: Synthetic coding sequence
atgaggcggctgctggagccctgctggtggatcctcttcctgaagatcaccagctctgtgctgcactacgtggtgtgcttccctgccctgacagagggctacgtgggcgccctgcacgagaacagacatggcagcgctgtgcagatcagaagaaggaaggccagcggggacccctactgggcctacagcggggcctacggccctgagcactgggtgaccagctctgtgtcctgtggcggccgccaccagagccccatcgacatcctggaccagtatgcccgggtgggggaggagtaccaggagctgcagctggatggctttgacaatgaaagcagcaacaagacctggatgaagaacacaggcaagacagtggccatcctgctgaaggatgactactttgtgtctggagctggcctgcccggccgcttcaaggccgagaaggtggagttccactggggccacagcaatggcagcgctggcagcgagcacagcatcaatggccgccgcttccctgtggagatgcagatcttcttctacaacccagatgactttgacagcttccagacagccatcagtgaaaatcgcatcattggagccatggccatcttcttccaggtgagcccccgggacaacagcgccctggaccccatcatccacggcctgaagggcgtggtgcaccacgagaaggagaccttcctggacccctttgtgctgcgggacctgctgcctgccagcctgggcagctactaccgctacacaggcagcctgaccaccccaccctgcagcgagatcgtggagtggatcgtgttcagaagacctgtgcccatctcctaccaccagctggaggccttctacagcatcttcaccacagagcagcaggaccacgtgaagtctgtggagtacctgaggaacaacttccggccccagcagaggctgcatgacagagtggtgtccaagtctgctgtgcgggacagctggaaccacgacatgacagacttcctggagaaccccctgggcacagaggccagcaaggtgtgcagcagcccccccatccacatgaaggtgcagcccctgaaccagacagccctgcaggtgtcctggagccagcctgagaccatctaccacccccccatcatgaactacatgatctcctacagctggaccaagaatgaagatgagaaggagaagaccttcaccaaggacagcgacaaggacctgaaggccaccatcagccacgtgtccccagacagcctgtacctgttccgggtgcaggccgtgtgcagaaatgacatgagaagtgacttcagccagaccatgctgttccaggccaacaccacccgcatcttccagggcacccgcatcgtgaagacaggagtgcccacagccagccctgccagcagcgctgacatggcccccatcagcagcggcagcagcacctggaccagcagcggcatccccttctcctttgtgtccatggccaccggcatgggccccagcagcagcggcagccaggccaccgtggcctctgtggtgaccagcaccctgctggccggcctgggctttggaggcggcggcatcagcagcttccccagcacagtgtggcccacccggctgcccacagctgccagcgccagcaagcaggccgcccggcctgtgctggccaccacagaggccctggccagccctggcccagatggagacagcagccccaccaaggatggagagggcacagaggagggggagaaggatgagaagtctgagagtgaagatggagagcgggagcatgaagaagatggagagaaggacagcgagaagaaggagaagtctggagtgacccacgccgctgaggagaggaaccagacagagcccagccccacccccagcagccccaacagaacagctgagggcggccaccagaccatccctggccacgagcaggaccacacagctgtgcccacagaccagacaggaggaagaagagatgctggccctggcctggaccctgacatggtgaccagcacccaggtgcccccaacagccacagaggagcagtatgccggcagtgaccccaagaggcctgagatgcccagcaagaagcccatgagcagaggagaccgcttcagcgaggacagccgcttcatcaccgtgaacccagctgagaagaacaccagcggcatgatcagcaggcctgcccctggccgcatggagtggatcatccccctcatcgtggtgtctgccctgacctttgtgtgcctgatcctgctgattgctgtgctggtgtactggaggggctgcaacaagatcaagagcaagggcttcccccggcgcttccgggaggtgcccagcagtggagagcggggggagaagggcagcaggaagtgcttccagacagcccacttctacgtggaggacagcagcagcccccgggtggtgcccaatgaaagcatccccatcatccccatcccagatgacatggaggccatccctgtgaagcagtttgtgaagcacatcggggagctgtacagcaacaaccagcacggcttcagcgaggactttgaggaggtgcagcgctgcacagctgacatgaacatcacagctgagcacagcaaccaccctgagaacaagcacaagaaccgctacatcaacatcctggcctatgaccacagccgggtgaagctgcggcccctgcccgggaaggacagcaagcacagcgactacatcaatgccaactacgtggatggctacaacaaggccaaggcctacatcgccacccagggccccctgaagagcacctttgaggacttctggaggatgatctgggagcagaacacaggcatcatcgtgatgatcaccaacctggtggagaagggccgcaggaaatgtgaccagtactggcccacagagaacagcgaggagtatggcaacatcatcgtgaccctgaagagcaccaagatccacgcctgctacacagtgcggcgcttcagcatccggaacaccaaggtgaagaagggccagaagggcaaccccaagggccggcagaatgaaagagtggtgatccagtaccactacacccagtggccagacatgggcgtgcctgaatatgccctgcctgtgctgacctttgtgagaagaagcagcgctgccaggatgcctgagactggacctgtgctggtgcactgcagcgctggggtgggccgcacaggcacctacatcgtgattgacagcatgctgcagcagatcaaggacaagagcacagtgaatgtgctgggcttcctgaagcacatccgcacccagaggaactacctggtgcagacagaggagcagtacatcttcatccatgatgccctgctggaggccatcctgggcaaggagacagaggtgagcagcaaccagctgcacagctatgtgaacagcatcctgatccctggggtgggcggcaagacccggctggagaagcagttcaagctggtgacccagtgcaatgccaagtatgtggagtgcttcagcgcccagaaggagtgcaacaaggagaagaacagaaacagctctgtggtgcccagcgagcgggcccgggtgggcctggcccccctgcccggcatgaagggcacagactacatcaatgccagctacatcatgggctactaccgcagcaatgagttcatcatcacccagcaccccctgccccacaccaccaaggacttctggaggatgatctgggaccacaatgcccagatcatcgtgatgctgcctgacaaccagagcctggctgaagatgaatttgtgtactggcccagccgggaggagagcatgaactgtgaggccttcaccgtgaccctcatcagcaaggaccggctgtgcctgagcaatgaggagcagatcatcatccatgacttcatcctggaggccacccaggatgattatgtgctggaggtgcgccacttccagtgccccaagtggcccaacccagatgcccccatcagcagcacctttgagctgatcaacgtcatcaaggaggaggccctgaccagagatggccccaccatcgtgcatgatgaatatggagctgtgtctgctggcatgctgtgtgccctgaccaccctgagccagcagctggagaatgaaaatgctgtggatgtgttccaggtggccaagatgatcaacctgatgaggcctggggtcttcacagacatcgagcagtaccagttcatctacaaggccatgctgagcctggtgtccaccaaggaaaatggaaatggccccatgacagtggacaagaatggagctgtgctgattgctgatgaaagtgaccctgctgagagcatggagagcctggtgtag

SEQ ID NO: 166344 - DNA, 309 bp, Artificial Sequence
  Description of Artificial Sequence: Synthetic coding sequence
atgaggcggctgctggagccctgctggtggatcctcttcctgaagatcaccagctctgtgctgcactacgtggtgtgcttccctgccctgacagagggctacgtgggcgccctgcacgagaacagacatggcagcgctgtgcagatcagaagaaggaaggccagcggggacccctactgggcctacagcggcaagagcagctgcagcaatggagaccacacaggccagctgaccagccacagcacccacctgaaggcccactttgagagcctgctgtgcctgagctctgtgtgcagcaacctgtcctag

SEQ ID NO: 166345 - DNA, 2814 bp, Artificial Sequence
  Description of Artificial Sequence: Synthetic coding sequence
atggccggggccggcggcggcctgggcgtgtggggcaacctggtgctgctgggcctgtgctcctggacaggagcccgggccccagcccccaaccctggcaggaacctgactgtggagacccagaccaccagcagcatcagcctgtcctgggaggtgcctgatggcctggacagccagaacagcaactactgggtgcagtgcacaggagatggcggcaccacagagaccaggaacaccacagccaccaacgtgacagtggatggcctgggccctggcagcctgtacacctgcagcgtgtgggtggagaaggatggagtgaacagctctgtgggcaccgtgaccacagccacagcccccaaccctgtgaggaacctgactgtggaggcccagaccaacagcagcatcgccctgacctgggaggtgcctgatggccctgacccccagaacagcacctacggcgtggagtacacaggagatggcggccgggccggcaccaggagcacagcccacaccaacatcaccgtggaccggctggagcccggctgcctgtatgtgttttctgtgtgggtgggcaagaatggcatcaacagcagccgggagaccagaaatgccaccacagcccccaaccctgtgaggaacctgcacatggagacccagaccaacagcagcatcgccctgtgctgggaggtgcctgatggcccctacccccaggactacacctactgggtggagtacacaggagatggcggcggcacagagaccaggaacaccaccaacacctctgtgacagctgagcggctggagcccggcaccctgtacaccttctctgtgtgggccgagaagaatggagcccggggcagccggcagaatgtgtccatcagcacagtgcccaatgctgtgaccagcctgagcaagcaggactggaccaacagcaccatcgccctgcgctggacagccccccagggccctggccagagcagctacagctactgggtgtcctgggtgcgggagggcatgacagaccccaggacccagagcaccagcggcacagacatcaccctgaaggagctggaggccggcagcctgtaccacctgactgtgtgggccgagagaaatgaggtgcggggctacaacagcaccctgacagctgccacagccccaaatgaggtgacagacctgcagaatgagacccagaccaagaacagcgtgatgctgtggtggaaggcccctggggacccccacagccagctgtatgtgtactgggtgcagtgggccagcaagggccacccccggcggggccaggacccccaggccaactgggtgaaccagaccagcaggaccaatgagacctggtacaaggtggaggccctggagcccggcaccctgtacaacttcaccgtgtgggccgagagaaatgatgtggccagcagcacccagagcctgtgtgccagcacctacccagacacagtgaccatcaccagctgtgtgtccaccagcgctggctacggcgtgaacctgatctggagctgcccccagggcggctatgaggcctttgagctggaggtgggcggccagaggggcagccaggacaggagcagctgtggggaggccgtgtctgtgctgggcctgggccctgcccggagctacccagccaccatcaccaccatctgggatggcatgaaggtggtgagccacagcgtggtgtgccacacagaatctgctggggtgattgctggggcctttgtgggcatcctgctcttcctgatcctggtgggcctgctgatcttcttcctgaagagaagaaacaagaagaagcagcagaagccagagctgcgggacctggtgttcagcagccctggggacatcccagcagaagattttgctgaccacgtgaggaagaatgaaagagacagcaactgtggctttgctgacaagtaccagcagctgagcctggtgggccacagccagagccagatggtggccagcgcctctgaaaataatgccaagaaccgctacagaaatgtgctgccctatgactggagccgggtgcccctgaagcccatccacgaggagcccggcagtgactacatcaatgccagcttcatgcctggcctgtggagcccccaggagttcatcgccacccagggccccctgccccagacagtgggggacttctggaggctggtgtgggagcagcagagccacaccctggtgatgctgaccaactgcatggaggccggccgggtgaagtgtgagcactactggcccctggacagccagccctgcacccacggccacctgcgggtgaccctggtgggggaggaggtgatggagaactggacagtgcgggagctgctgctgctgcaggtggaggagcagaagaccctgtctgtgcggcagttccactaccaggcctggccagaccatggagtgcccagcagcccagacaccctgctggccttctggaggatgctgcggcagtggctggaccagaccatggagggcggcccccccatcgtgcactgcagcgctggggtgggccgcacaggcaccctgattgccctggatgtgctgctgcggcagctgcagagcgagggcctgctgggccccttctcctttgtgaggaagatgagggagagccggcccctgatggtgcagacagaggcccagtatgtgttcctgcaccagtgcatcctgcgcttcctgcagcagagcgcccaggccccagctgagaaggaggtgccctatgaagatgtggagaacctgatctatgaaaatgtggccgccatccaggcccacaagctggaggtgtag

SEQ ID NO: 166346 - DNA, 3348 bp, Artificial Sequence
  Description of Artificial Sequence: Synthetic coding sequence
atggccggggccggcggcggcctgggcgtgtggggcaacctggtgctgctgggcctgtgctcctggacaggagcccgggccccagcccccaaccctggcaggaacctgactgtggagacccagaccaccagcagcatcagcctgtcctgggaggtgcctgatggcctggacagccagaacagcaactactgggtgcagtgcacaggagatggcggcaccacagagaccaggaacaccacagccaccaacgtgacagtggatggcctgggccctggcagcctgtacacctgcagcgtgtgggtggagaaggatggagtgaacagctctgtgggcaccgtgaccacagccacagcccccaaccctgtgaggaacctgcgggtggaggcccagaccaacagcagcatcgccctgacctgggaggtgcctgatggccctgacccccagaacagcacctacggcgtggagtacacaggagatggcggccgggccggcaccaggagcacagcccacaccaacatcaccgtggatggcctggagcccggctgcctgtatgccttctccatgtgggtgggcaagaatggcatcaacagcagccgggagaccagaaatgccaccacagcccacaaccctgtgaggaacctgcgggtggaggcccagaccaccagcagcatcagcctgtcctgggaggtgcctgatggaacagacccccagaacagcacctactgtgtgcagtgcacaggagatggcggccgcacagagaccaggaacaccacagacaccagggtgacagtggatggcctgggccctggcagcctgtacacctgcagcgtgtgggtggagaaggatggagtgaacagctctgtggagatcgtgaccagcgccacagcccccaaccctgtgaggaacctgactgtggaggcccagaccaacagcagcatcgccctgacctgggaggtgcctgatggccctgacccccagaacagcacctacggcgtggagtacacaggagatggcggccgggccggcaccaggagcacagcccacaccaacatcaccgtggaccggctggagcccggctgcctgtatgtgttttctgtgtgggtgggcaagaatggcatcaacagcagccgggagaccagaaatgccaccacagcccccaaccctgtgaggaacctgcacatggagacccagaccaacagcagcatcgccctgtgctgggaggtgcctgatggcccctacccccaggactacacctactgggtggagtacacaggagatggcggcggcacagagaccaggaacaccaccaacacctctgtgacagctgagcggctggagcccggcaccctgtacaccttctctgtgtgggccgagaagaatggagcccggggcagccggcagaatgtgtccatcagcacagtgcccaatgctgtgaccagcctgagcaagcaggactggaccaacagcaccatcgccctgcgctggacagccccccagggccctggccagagcagctacagctactgggtgtcctgggtgcgggagggcatgacagaccccaggacccagagcaccagcggcacagacatcaccctgaaggagctggaggccggcagcctgtaccacctgactgtgtgggccgagagaaatgaggtgcggggctacaacagcaccctgacagctgccacagccccaaatgaggtgacagacctgcagaatgagacccagaccaagaacagcgtgatgctgtggtggaaggcccctggggacccccacagccagctgtatgtgtactgggtgcagtgggccagcaagggccacccccggcggggccaggacccccaggccaactgggtgaaccagaccagcaggaccaatgagacctggtacaaggtggaggccctggagcccggcaccctgtacaacttcaccgtgtgggccgagagaaatgatgtggccagcagcacccagagcctgtgtgccagcacctacccagacacagtgaccatcaccagctgtgtgtccaccagcgctggctacggcgtgaacctgatctggagctgcccccagggcggctatgaggcctttgagctggaggtgggcggccagaggggcagccaggacaggagcagctgtggggaggccgtgtctgtgctgggcctgggccctgcccggagctacccagccaccatcaccaccatctgggatggcatgaaggtggtgagccacagcgtggtgtgccacacagaatctgctggggtgattgctggggcctttgtgggcatcctgctcttcctgatcctggtgggcctgctgatcttcttcctgaagagaagaaacaagaagaagcagcagaagccagagctgcgggacctggtgttcagcagccctggggacatcccagcagaagattttgctgaccacgtgaggaagaatgaaagagacagcaactgtggctttgctgacaagtaccagcagctgagcctggtgggccacagccagagccagatggtggccagcgcctctgaaaataatgccaagaaccgctacagaaatgtgctgccctatgactggagccgggtgcccctgaagcccatccacgaggagcccggcagtgactacatcaatgccagcttcatgcctggcctgtggagcccccaggagttcatcgccacccagggccccctgccccagacagtgggggacttctggaggctggtgtgggagcagcagagccacaccctggtgatgctgaccaactgcatggaggccggccgggtgaagtgtgagcactactggcccctggacagccagccctgcacccacggccacctgcgggtgaccctggtgggggaggaggtgatggagaactggacagtgcgggagctgctgctgctgcaggtggaggagcagaagaccctgtctgtgcggcagttccactaccaggcctggccagaccatggagtgcccagcagcccagacaccctgctggccttctggaggatgctgcggcagtggctggaccagaccatggagggcggcccccccatcgtgcactgcagcgctggggtgggccgcacaggcaccctgattgccctggatgtgctgctgcggcagctgcagagcgagggcctgctgggccccttctcctttgtgaggaagatgagggagagccggcccctgatggtgcagacagaggcccagtatgtgttcctgcaccagtgcatcctgcgcttcctgcagcagagcgcccaggccccagctgagaaggaggtgccctatgaagatgtggagaacctgatctatgaaaatgtggccgccatccaggcccacaagctggaggtgtag

SEQ ID NO: 166347 - DNA, 1278 bp, Artificial Sequence
  Description of Artificial Sequence: Synthetic coding sequence
atgaagccagctgcccgggaggcccggctgcccccaagaagccctggcctgcgctgggccctgcccctgctgctgctgctgctgcggctgggccagatcctgtgtgccggcggcacccccagccccatcccagaccccagcgtggccaccgtggccactggagaaaatggcatcacccagatcagcagcacagctgagagcttccacaagcagaatggcaccggcaccccccaggtggagaccaacaccagtgaagatggagagagcagcggggccaatgacagcctgcggaccccagagcagggcagcaatggaacagatggagccagccagaagacccccagcagcacaggccccagccctgtgtttgacatcaaggctgtgtccatcagccccaccaacgtcatcctgacctggaagagcaatgacacagctgccagcgagtacaagtatgtggtgaagcacaagatggagaatgagaagaccatcaccgtggtgcaccagccctggtgcaacatcaccggcctgcggcctgccaccagctatgtgttcagcatcaccccaggcattggaaatgagacctggggagaccccagggtcatcaaggtgatcacagagcccatccctgtgtctgacctgcgggtggccctgactggagtgaggaaggccgccctgtcctggagcaatggaaatggaacagccagctgccgggtgctgctggagagcatcggcagccatgaggagctgacccaggacagccggctgcaggtgaacatcagcggcctgaagccaggagtgcagtacaacatcaacccctacctgctgcagagcaacaagaccaagggggaccccctgggcacagaaggaggcctggatgccagcaacacagagaggagcagagctggcagccccacagcccctgtgcatgatgagagcctggtgggccctgtggaccccagcagcggccagcagagccgggacacagaggtgctgctggtgggcctggagcccggcacccgctacaatgccaccgtgtacagccaggccgccaatggaacagagggccagccccaggccatcgagttccgcaccaatgccatccaggtgtttgatgtgacagctgtgaacatcagcgccaccagcctgaccctcatctggaaggtgtctgacaatgaaagcagcagcaactacacctacaagatccacgtggccggggagacagacagcagcaacctgaatgtgtctgagcccagggctgtgattcctggcctgaggtag

SEQ ID NO: 166348 - DNA, 4014 bp, Artificial Sequence
  Description of Artificial Sequence: Synthetic coding sequence
atgaagccagctgcccgggaggcccggctgcccccaagaagccctggcctgcgctgggccctgcccctgctgctgctgctgctgcggctgggccagatcctgtgtgccggcggcacccccagccccatcccagaccccagcgtggccaccgtggccactggagaaaatggcatcacccagatcagcagcacagctgagagcttccacaagcagaatggcaccggcaccccccaggtggagaccaacaccagtgaagatggagagagcagcggggccaatgacagcctgcggaccccagagcagggcagcaatggaacagatggagccagccagaagacccccagcagcacaggccccagccctgtgtttgacatcaaggctgtgtccatcagccccaccaacgtcatcctgacctggaagagcaatgacacagctgccagcgagtacaagtatgtggtgaagcacaagatggagaatgagaagaccatcaccgtggtgcaccagccctggtgcaacatcaccggcctgcggcctgccaccagctatgtgttcagcatcaccccaggcattggaaatgagacctggggagaccccagggtcatcaaggtgatcacagagcccatccctgtgtctgacctgcgggtggccctgactggagtgaggaaggccgccctgtcctggagcaatggaaatggaacagccagctgccgggtgctgctggagagcatcggcagccatgaggagctgacccaggacagccggctgcaggtgaacatcagcggcctgaagccaggagtgcagtacaacatcaacccctacctgctgcagagcaacaagaccaagggggaccccctgggcacagaaggaggcctggatgccagcaacacagagaggagcagagctggcagccccacagcccctgtgcatgatgagagcctggtgggccctgtggaccccagcagcggccagcagagccgggacacagaggtgctgctggtgggcctggagcccggcacccgctacaatgccaccgtgtacagccaggccgccaatggaacagagggccagccccaggccatcgagttccgcaccaatgccatccaggtgtttgatgtgacagctgtgaacatcagcgccaccagcctgaccctcatctggaaggtgtctgacaatgaaagcagcagcaactacacctacaagatccacgtggccggggagacagacagcagcaacctgaatgtgtctgagcccagggctgtgattcctggcctgcggagcagcaccttctacaacatcaccgtgtgccctgtgctgggggacatcgagggcaccccaggcttcctgcaggtgcacaccccacctgtgcctgtgtctgacttccgggtgacagtggtgtccaccacagagatcggcctggcctggagcagccatgatgctgagagcttccagatgcacatcacccaggagggcgccggcaacagccgggtggagatcaccaccaaccagagcatcatcatcggcggcctcttccctggcaccaagtactgctttgaaattgtgcccaagggccccaatggaacagaaggagccagcaggacagtgtgcaacagaacagtgcccagcgctgtgtttgacatccacgtggtgtatgtgaccaccacagagatgtggctggactggaagagcccagatggagcctctgaatatgtgtaccacctggtgattgagagcaagcacggcagcaaccacaccagcacctatgacaaggccatcaccctgcagggcctcatccctggcaccctgtacaacatcaccatcagccctgaggtggaccacgtgtggggagaccccaacagcacagcccagtacacccggcccagcaatgtgagcaacattgatgtgtccaccaacaccacagctgccaccctgtcctggcagaactttgatgatgccagccccacctacagctactgcctgctgattgagaaggccggcaacagcagcaatgccacccaggtggtgacagacatcggcatcacagatgccaccgtgacagagctgatccctggcagcagctacacagtggagatctttgcccaggtgggagatggcatcaagagcctggagcccggcaggaagagcttctgcacagatcctgcctccatggccagctttgactgtgaggtggtgcccaaggagcccgccctggtgctgaagtggacctgccccccaggggccaatgccggctttgagctggaggtgagcagcggggcctggaacaatgccacccacctggagagctgcagcagtgaaaatggaacagagtacagaacagaggtgacctacctgaacttcagcaccagctacaacatcagcatcaccaccgtgtcctgtgggaagatggccgcccccaccaggaacacctgcaccaccggcatcacagaccccccacctccagatggcagccccaacatcacctctgtgagccacaacagcgtgaaggtgaagttcagcggctttgaggccagccacggccccatcaaggcctatgctgtgatcctgaccaccggggaggccggccaccccagcgcagatgtgctgaagtacacctatgaggacttcaagaagggggccagtgacacctacgtgacctacctgatcagaacagaggagaagggccgcagccagagcctgtctgaggtgctgaagtatgaaattgatgtgggcaatgaaagcaccaccctgggctactacaacgggaagctggagcccctgggcagctaccgggcctgtgtggccggcttcaccaacatcaccttccacccccagaacaagggcctgattgatggagctgagagctatgtgtccttcagccgctacagtgatgctgtgtccctgccccaggaccccggggtcatctgtggggctgtgtttggctgcatctttggagccctggtgattgtgacagtgggcggcttcatcttctggaggaagaagaggaaggatgccaagaacaatgaggtgtccttcagccagatcaagcccaagaagagcaagctgatccgggtggagaactttgaggcctacttcaagaagcagcaggccgacagcaactgtggctttgctgaggagtatgaggacctgaagctggtgggcatcagccagcccaagtatgctgctgagctggccgagaacagaggcaagaaccgctacaacaacgtgctgccctatgacatcagccgggtgaagctgtctgtgcagacccacagcacagatgactacatcaatgccaactacatgcctggctaccacagcaagaaggacttcatcgccacccagggccccctgcccaacaccctgaaggacttctggaggatggtgtgggagaagaatgtgtatgccatcatcatgctgaccaagtgtgtggagcagggccgcaccaagtgtgaggagtactggcccagcaagcaggcccaggactatggagacatcaccgtggccatgaccagcgagatcgtgctgcctgagtggaccatccgggacttcaccgtgaagaacatccagaccagcgagagccaccccctgcggcagttccacttcacctcctggccagaccacggcgtgcctgacaccacagacctgctgatcaacttccgctacctggtgcgggactacatgaagcagagccccccagagagccccatcctggtgcactgcagcgctggggtgggccgcacaggcaccttcatcgccatcgacaggctcatctaccagattgaaaatgaaaatacagtggatgtgtatggcatcgtgtatgacctgaggatgcaccggcccctgatggtgcagacagaggaccagtatgtgttcctgaaccagtgtgtgctggacatcgtgcgcagccagaaggacagcaaggtggacctgatctaccagaacaccacagccatgaccatctatgagaacctggcccctgtgaccaccttcggcaagaccaacggctacatcgcctag

SEQ ID NO: 166349 - DNA, 1620 bp, Artificial Sequence
  Description of Artificial Sequence: Synthetic coding sequence
atgaagccagctgcccgggaggcccggctgcccccaagaagccctggcctgcgctgggccctgcccctgctgctgctgctgctgcggctgggccagatcctgtgtgccggcggcacccccagccccatcccagaccccagcgtggccaccgtggccactggagaaaatggcatcacccagatcagcagcacagctgagagcttccacaagcagaatggcaccggcaccccccaggtggagaccaacaccagtgaagatggagagagcagcggggccaatgacagcctgcggaccccagagcagggcagcaatggaacagatggagccagccagaagacccccagcagcacaggccccagccctgtgtttgacatcaaggctgtgtccatcagccccaccaacgtcatcctgacctggaagagcaatgacacagctgccagcgagtacaagtatgtggtgaagcacaagatggagaatgagaagaccatcaccgtggtgcaccagccctggtgcaacatcaccggcctgcggcctgccaccagctatgtgttcagcatcaccccaggcattggaaatgagacctggggagaccccagggtcatcaaggtgatcacagagcccatccctgtgtctgacctgcgggtggccctgactggagtgaggaaggccgccctgtcctggagcaatggaaatggaacagccagctgccgggtgctgctggagagcatcggcagccatgaggagctgacccaggacagccggctgcaggtgaacatcagcggcctgaagccaggagtgcagtacaacatcaacccctacctgctgcagagcaacaagaccaagggggaccccctgggcacagaaggaggcctggatgccagcaacacagagaggagcagagctggcagccccacagcccctgtgcatgatgagagcctggtgggccctgtggaccccagcagcggccagcagagccgggacacagaggtgctgctggtgggcctggagcccggcacccgctacaatgccaccgtgtacagccaggccgccaatggaacagagggccagccccaggccatcgagttccgcaccaatgccatccaggtgtttgatgtgacagctgtgaacatcagcgccaccagcctgaccctcatctggaaggtgtctgacaatgaaagcagcagcaactacacctacaagatccacgtggccggggagacagacagcagcaacctgaatgtgtctgagcccagggctgtgattcctggcctgcggagcagcaccttctacaacatcaccgtgtgccctgtgctgggggacatcgagggcaccccaggcttcctgcaggtgcacaccccacctgtgcctgtgtctgacttccgggtgacagtggtgtccaccacagagatcggcctggcctggagcagccatgatgctgagagcttccagatgcacatcacccaggagggcgccggcaacagccgggtggagatcaccaccaaccagagcatcatcatcggcggcctcttccctggcaccaagtactgctttgaaattgtgcccaagggccccaatggaacagaaggagccagcaggacagtgtgcaacagaactggatag

SEQ ID NO: 166350 - DNA, 4419 bp, Artificial Sequence
  Description of Artificial Sequence: Synthetic coding sequence
atggacaccacagctgctgctgccctgcctgcctttgtggccctgctgctgctgagcccctggcccctgctgggcagcgcccagggccagttctctgctgggggctgcacctttgatgatggccctggggcctgtgactaccaccaggacctgtatgatgactttgagtgggtgcacgtgtctgcccaggagccccactacctgcccccagagatgccccagggcagctacatgattgtggacagcagtgaccatgaccctggagagaaggcccggctgcagctgcccaccatgaaggaaaatgacacccactgcatcgacttctcctacctgctgtacagccagaagggcctgaaccctggcaccctgaacatcctggtgcgggtgaacaagggccccctggccaaccccatctggaatgtgacaggcttcaccggccgggactggctgcgggcagagctggccgtgtccaccttctggcccaatgagtaccaggtgatctttgaggccgaggtgtctgggggccgcagcggctacatcgccattgatgacatccaggtgctgagctacccctgtgacaagagcccccacttcctgcggctgggagatgtggaggtgaatgccggccagaatgccaccttccagtgcatcgccaccggcagagatgctgtgcacaacaagctgtggctgcagaggagaaatggagaggacatccctgtggcccagaccaagaacatcaaccacagaagatttgctgccagcttccggctgcaggaggtgaccaagacagaccaggacctgtaccgctgtgtgacccagagcgagcggggcagcggcgtgagcaactttgcccagctgattgtgcgggagcccccccggcccatcgccccaccccagctgctgggcgtgggccccacctacctgctgatccagctgaatgccaacagcatcattggagatggccccatcatcctgaaggaggtggagtacaggatgaccagcggctcctggacagagacccatgctgtgaatgcccccacctacaagctgtggcacctggaccctgacacagaatatgagatccgggtgctgctgaccaggcctggagagggcggcaccggcctgcccggccccccactcatcaccaggaccaagtgtgccgagcccatgaggacccccaagaccctgaagattgctgagatccaggccaggagaattgctgtggactgggagagcctgggctacaacatcacccgctgccacaccttcaacgtgaccatctgctaccactacttccggggccacaatgaaagcaaggctgactgcctggacatggaccccaaggccccccagcacgtggtgaaccacctgcccccctacaccaacgtgtccctgaagatgatcctgaccaaccctgagggcaggaaggagagcgaggagaccatcatccagacagatgaagatgtgcccggccctgtgcctgtgaagagcctgcagggcaccagctttgagaacaagatcttcctgaactggaaggagcccctggaccccaacggcatcatcacccagtatgagatctcctacagcagcatccgcagctttgatcctgctgtgcctgtggccggccccccccagacagtgagcaacctgtggaacagcacccaccacgtgttcatgcacctgcaccctggcaccacctaccagttcttcatccgggccagcacagtgaagggctttggacctgccacagccatcaacgtgaccaccaacatcagcgcccccaccctgcctgactatgaaggagtggatgccagcctgaatgaaacagccaccaccatcaccgtgctgctgcggcctgcccaggccaagggggcccccatcagcgcctaccagatcgtggtggaggagctgcacccccacaggaccaagcgggaggccggggccatggagtgctaccaggtgcctgtgacctaccagaatgccatgtctggaggagccccctactactttgctgctgagctgcccccaggcaacctgcctgagcccgcccccttcaccgtgggggacaacagaacctaccagggcttctggaacccccccctggcccccaggaagggctacaacatctacttccaggccatgagctctgtggagaaggagaccaagacccagtgtgtgcgcatcgccaccaaggctgctgccacagaggagcctgaggtgatcccagaccctgccaagcagacagacagagtggtgaagattgctggcatctctgctggcatcctggtgttcatcctgctgctgctggtggtgatcctgattgtgaagaagaggaggagctactacagctacagctactacctgaagctggccaagaagaggaaggatgccatgggcaacacccggcaggagatgacccacatggtgaatgccatggacaggagctatgctgaccagagcaccctgcacgccgaggaccccctgagcatcaccttcatggaccagcacaacttcagcccccggctgcccaatgaccccctggtgcccacagctgtgctggtgcccatcacagatgagaaccacagcgccacagctgagagcagccggctgctggatgtgccccgctacctgtgtgagggcacagagagcccctaccagacaggccagctgcacccagccatccgggtggccgacctgctgcagcacatcaacctgatgaagaccagtgacagctatggcttcaaggaggagtatgagagcttctttgagggccagagcgcctcctgggatgtggccaagaaggaccagaacagagccaagaacagatatggcaacatcatcgcctatgaccacagcagggtcatcctgcagcctgtggaggatgaccccagcagtgactacatcaatgccaactacatcgacatctggctgtacagagatggctaccagaggcccagccactacatcgccacccagggccctgtgcatgagaccgtgtatgacttctggaggatgatctggcaggagcagagcgcctgcatcgtgatggtgaccaacctggtggaggtgggccgggtgaagtgctacaagtactggccagatgacacagaggtgtatggagacttcaaggtgacctgtgtggagatggagcccctggccgagtatgtggtgaggaccttcaccctggagcggcggggctacaatgagatccgggaggtgaagcagttccacttcaccggctggccagaccacggcgtgccctaccacgccaccggcctgctgtccttcatccggcgggtgaagctgagcaaccccccatctgctggccccatcgtggtgcactgcagcgctggagctggccgcacaggctgctacatcgtcatcgacatcatgctggacatggccgagcgggagggcgtggtggacatctacaactgtgtgaaggccctgcggagccgccgcatcaacatggtgcagacagaggagcagtacatcttcatccatgatgccatcctggaggcctgcctgtgtggggagacagccatccctgtgtgtgagttcaaggccgcctactttgacatgatcagaattgacagccagaccaacagcagccacctgaaggatgagttccagaccctgaacagcgtgaccccccggctgcaggccgaggactgcagcatcgcctgcctgcccaggaaccacgacaagaaccgcttcatggacatgctgcccccagaccgctgcctgcccttcctgatcaccattgatggagagagcagcaactacatcaatgctgccctgatggacagctaccggcagcctgctgccttcatcgtgacccagtaccccctgcccaacacagtgaaggacttctggaggctggtgtatgactatggctgcaccagcatcgtgatgctgaatgaggtggacctgagccagggctgcccccagtactggccagaggagggcatgctgcgctatggccccatccaggtggagtgcatgagctgcagcatggactgtgatgtgatcaaccgcatcttccgcatctgcaacctgacccggccccaggagggctacctgatggtgcagcagttccagtacctgggctgggccagccaccgggaggtgcccggcagcaagaggagcttcctgaagctgatcctgcaggtggagaagtggcaggaggagtgtgaggagggggagggccgcaccatcatccactgcctgaatggaggcggccgcagcggcatgttctgtgccatcggcatcgtggtggagatggtgaagaggcagaatgtggtggatgtgttccacgctgtgaagaccctgaggaacagcaagcccaacatggtggaggcccctgagcagtaccgcttctgctatgatgtggccctggagtacctggagagcagctag

SEQ ID NO: 166351 - DNA, 4377 bp, Artificial Sequence
  Description of Artificial Sequence: Synthetic coding sequence
atggacaccacagctgctgctgccctgcctgcctttgtggccctgctgctgctgagcccctggcccctgctgggcagcgcccagggccagttctctgctgggggctgcacctttgatgatggccctggggcctgtgactaccaccaggacctgtatgatgactttgagtgggtgcacgtgtctgcccaggagccccactacctgcccccagagatgccccagggcagctacatgattgtggacagcagtgaccatgaccctggagagaaggcccggctgcagctgcccaccatgaaggaaaatgacacccactgcatcgacttctcctacctgctgtacagccagaagggcctgaaccctggcaccctgaacatcctggtgcgggtgaacaagggccccctggccaaccccatctggaatgtgacaggcttcaccggccgggactggctgcgggcagagctggccgtgtccaccttctggcccaatgagtaccaggtgatctttgaggccgaggtgtctgggggccgcagcggctacatcgccattgatgacatccaggtgctgagctacccctgtgacaagagcccccacttcctgcggctgggagatgtggaggtgaatgccggccagaatgccaccttccagtgcatcgccaccggcagagatgctgtgcacaacaagctgtggctgcagaggagaaatggagaggacatccctgtggcccagaccaagaacatcaaccacagaagatttgctgccagcttccggctgcaggaggtgaccaagacagaccaggacctgtaccgctgtgtgacccagagcgagcggggcagcggcgtgagcaactttgcccagctgattgtgcgggagcccccccggcccatcgccccaccccagctgctgggcgtgggccccacctacctgctgatccagctgaatgccaacagcatcattggagatggccccatcatcctgaaggaggtggagtacaggatgaccagcggctcctggacagagacccatgctgtgaatgcccccacctacaagctgtggcacctggaccctgacacagaatatgagatccgggtgctgctgaccaggcctggagagggcggcaccggcctgcccggccccccactcatcaccaggaccaagtgtgccgagcccatgaggacccccaagaccctgaagattgctgagatccaggccaggagaattgctgtggactgggagagcctgggctacaacatcacccgctgccacaccttcaacgtgaccatctgctaccactacttccggggccacaatgaaagcaaggctgactgcctggacatggaccccaaggccccccagcacgtggtgaaccacctgcccccctacaccaacgtgtccctgaagatgatcctgaccaaccctgagggcaggaaggagagcgaggagaccatcatccagacagatgaagatgtgcccggccctgtgcctgtgaagagcctgcagggcaccagctttgagaacaagatcttcctgaactggaaggagcccctggaccccaacggcatcatcacccagtatgagatctcctacagcagcatccgcagctttgatcctgctgtgcctgtggccggccccccccagacagtgagcaacctgtggaacagcacccaccacgtgttcatgcacctgcaccctggcaccacctaccagttcttcatccgggccagcacagtgaagggctttggacctgccacagccatcaacgtgaccaccaacatcagcgcccccaccctgcctgactatgaaggagtggatgccagcctgaatgaaacagccaccaccatcaccgtgctgctgcggcctgcccaggccaagggggcccccatcagcgcctaccagatcgtggtggaggagctgcacccccacaggaccaagcgggaggccggggccatggagtgctaccaggtgcctgtgacctaccagaatgccatgtctggaggagccccctactactttgctgctgagctgcccccaggcaacctgcctgagcccgcccccttcaccgtgggggacaacagaacctaccagggcttctggaacccccccctggcccccaggaagggctacaacatctacttccaggccatgagctctgtggagaaggagaccaagacccagtgtgtgcgcatcgccaccaaggctgctgccacagaggagcctgaggtgatcccagaccctgccaagcagacagacagagtggtgaagattgctggcatctctgctggcatcctggtgttcatcctgctgctgctggtggtgatcctgattgtgaagaagagcaagctggccaagaagaggaaggatgccatgggcaacacccggcaggagatgacccacatggtgaatgccatggacaggagctatgctgaccagagcaccctgcacgccgaggaccccctgagcatcaccttcatggaccagcacaacttcagcccccggctgcccaatgaccccctggtgcccacagctgtgctggatgagaaccacagcgccacagctgagagcagccggctgctggatgtgccccgctacctgtgtgagggcacagagagcccctaccagacaggccagctgcacccagccatccgggtggccgacctgctgcagcacatcaacctgatgaagaccagtgacagctatggcttcaaggaggagtatgagagcttctttgagggccagagcgcctcctgggatgtggccaagaaggaccagaacagagccaagaacagatatggcaacatcatcgcctatgaccacagcagggtcatcctgcagcctgtggaggatgaccccagcagtgactacatcaatgccaactacatcgacatctggctgtacagagatggctaccagaggcccagccactacatcgccacccagggccctgtgcatgagaccgtgtatgacttctggaggatgatctggcaggagcagagcgcctgcatcgtgatggtgaccaacctggtggaggtgggccgggtgaagtgctacaagtactggccagatgacacagaggtgtatggagacttcaaggtgacctgtgtggagatggagcccctggccgagtatgtggtgaggaccttcaccctggagcggcggggctacaatgagatccgggaggtgaagcagttccacttcaccggctggccagaccacggcgtgccctaccacgccaccggcctgctgtccttcatccggcgggtgaagctgagcaaccccccatctgctggccccatcgtggtgcactgcagcgctggagctggccgcacaggctgctacatcgtcatcgacatcatgctggacatggccgagcgggagggcgtggtggacatctacaactgtgtgaaggccctgcggagccgccgcatcaacatggtgcagacagaggagcagtacatcttcatccatgatgccatcctggaggcctgcctgtgtggggagacagccatccctgtgtgtgagttcaaggccgcctactttgacatgatcagaattgacagccagaccaacagcagccacctgaaggatgagttccagaccctgaacagcgtgaccccccggctgcaggccgaggactgcagcatcgcctgcctgcccaggaaccacgacaagaaccgcttcatggacatgctgcccccagaccgctgcctgcccttcctgatcaccattgatggagagagcagcaactacatcaatgctgccctgatggacagctaccggcagcctgctgccttcatcgtgacccagtaccccctgcccaacacagtgaaggacttctggaggctggtgtatgactatggctgcaccagcatcgtgatgctgaatgaggtggacctgagccagggctgcccccagtactggccagaggagggcatgctgcgctatggccccatccaggtggagtgcatgagctgcagcatggactgtgatgtgatcaaccgcatcttccgcatctgcaacctgacccggccccaggagggctacctgatggtgcagcagttccagtacctgggctgggccagccaccgggaggtgcccggcagcaagaggagcttcctgaagctgatcctgcaggtggagaagtggcaggaggagtgtgaggagggggagggccgcaccatcatccactgcctgaatggaggcggccgcagcggcatgttctgtgccatcggcatcgtggtggagatggtgaagaggcagaatgtggtggatgtgttccacgctgtgaagaccctgaggaacagcaagcccaacatggtggaggcccctgagcagtaccgcttctgctatgatgtggccctggagtacctggagagcagctag

SEQ ID NO: 166352 - DNA, 4341 bp, Artificial Sequence
  Description of Artificial Sequence: Synthetic coding sequence
atggacaccacagctgctgctgccctgcctgcctttgtggccctgctgctgctgagcccctggcccctgctgggcagcgcccagggccagttctctgctgggggctgcacctttgatgatggccctggggcctgtgactaccaccaggacctgtatgatgactttgagtgggtgcacgtgtctgcccaggagccccactacctgcccccagagatgccccagggcagctacatgattgtggacagcagtgaccatgaccctggagagaaggcccggctgcagctgcccaccatgaaggaaaatgacacccactgcatcgacttctcctacctgctgtacagccagaagggcctgaaccctggcaccctgaacatcctggtgcgggtgaacaagggccccctggccaaccccatctggaatgtgacaggcttcaccggccgggactggctgcgggcagagctggccgtgtccaccttctggcccaatgagtaccaggtgatctttgaggccgaggtgtctgggggccgcagcggctacatcgccattgatgacatccaggtgctgagctacccctgtgacaagagcccccacttcctgcggctgggagatgtggaggtgaatgccggccagaatgccaccttccagtgcatcgccaccggcagagatgctgtgcacaacaagctgtggctgcagaggagaaatggagaggacatccctgtggcccagaccaagaacatcaaccacagaagatttgctgccagcttccggctgcaggaggtgaccaagacagaccaggacctgtaccgctgtgtgacccagagcgagcggggcagcggcgtgagcaactttgcccagctgattgtgcgggagcccccccggcccatcgccccaccccagctgctgggcgtgggccccacctacctgctgatccagctgaatgccaacagcatcattggagatggccccatcatcctgaaggaggtggagtacaggatgaccagcggctcctggacagagacccatgctgtgaatgcccccacctacaagctgtggcacctggaccctgacacagaatatgagatccgggtgctgctgaccaggcctggagagggcggcaccggcctgcccggccccccactcatcaccaggaccaagtgtgccgagcccatgaggacccccaagaccctgaagattgctgagatccaggccaggagaattgctgtggactgggagagcctgggctacaacatcacccgctgccacaccttcaacgtgaccatctgctaccactacttccggggccacaatgaaagcaaggctgactgcctggacatggaccccaaggccccccagcacgtggtgaaccacctgcccccctacaccaacgtgtccctgaagatgatcctgaccaaccctgagggcaggaaggagagcgaggagaccatcatccagacagatgaagatgtgcccggccctgtgcctgtgaagagcctgcagggcaccagctttgagaacaagatcttcctgaactggaaggagcccctggaccccaacggcatcatcacccagtatgagatctcctacagcagcatccgcagctttgatcctgctgtgcctgtggccggccccccccagacagtgagcaacctgtggaacagcacccaccacgtgttcatgcacctgcaccctggcaccacctaccagttcttcatccgggccagcacagtgaagggctttggacctgccacagccatcaacgtgaccaccaacatcagcgcccccaccctgcctgactatgaaggagtggatgccagcctgaatgaaacagccaccaccatcaccgtgctgctgcggcctgcccaggccaagggggcccccatcagcgcctaccagatcgtggtggaggagctgcacccccacaggaccaagcgggaggccggggccatggagtgctaccaggtgcctgtgacctaccagaatgccatgtctggaggagccccctactactttgctgctgagctgcccccaggcaacctgcctgagcccgcccccttcaccgtgggggacaacagaacctaccagggcttctggaacccccccctggcccccaggaagggctacaacatctacttccaggccatgagctctgtggagaaggagaccaagacccagtgtgtgcgcatcgccaccaaggctgctgccacagaggagcctgaggtgatcccagaccctgccaagcagacagacagagtggtgaagattgctggcatctctgctggcatcctggtgttcatcctgctgctgctggtggtgatcctgattgtgaagaagagcaagctggccaagaagaggaaggatgccatgggcaacacccggcaggagatgacccacatggtgaatgccatggacaggagctatgctgaccagagcaccctgcacgccgaggaccccctgagcatcaccttcatggaccagcacaacttcagccccaggtatgagaaccacagcgccacagctgagagcagccggctgctggatgtgccccgctacctgtgtgagggcacagagagcccctaccagacaggccagctgcacccagccatccgggtggccgacctgctgcagcacatcaacctgatgaagaccagtgacagctatggcttcaaggaggagtatgagagcttctttgagggccagagcgcctcctgggatgtggccaagaaggaccagaacagagccaagaacagatatggcaacatcatcgcctatgaccacagcagggtcatcctgcagcctgtggaggatgaccccagcagtgactacatcaatgccaactacatcgacatctggctgtacagagatggctaccagaggcccagccactacatcgccacccagggccctgtgcatgagaccgtgtatgacttctggaggatgatctggcaggagcagagcgcctgcatcgtgatggtgaccaacctggtggaggtgggccgggtgaagtgctacaagtactggccagatgacacagaggtgtatggagacttcaaggtgacctgtgtggagatggagcccctggccgagtatgtggtgaggaccttcaccctggagcggcggggctacaatgagatccgggaggtgaagcagttccacttcaccggctggccagaccacggcgtgccctaccacgccaccggcctgctgtccttcatccggcgggtgaagctgagcaaccccccatctgctggccccatcgtggtgcactgcagcgctggagctggccgcacaggctgctacatcgtcatcgacatcatgctggacatggccgagcgggagggcgtggtggacatctacaactgtgtgaaggccctgcggagccgccgcatcaacatggtgcagacagaggagcagtacatcttcatccatgatgccatcctggaggcctgcctgtgtggggagacagccatccctgtgtgtgagttcaaggccgcctactttgacatgatcagaattgacagccagaccaacagcagccacctgaaggatgagttccagaccctgaacagcgtgaccccccggctgcaggccgaggactgcagcatcgcctgcctgcccaggaaccacgacaagaaccgcttcatggacatgctgcccccagaccgctgcctgcccttcctgatcaccattgatggagagagcagcaactacatcaatgctgccctgatggacagctaccggcagcctgctgccttcatcgtgacccagtaccccctgcccaacacagtgaaggacttctggaggctggtgtatgactatggctgcaccagcatcgtgatgctgaatgaggtggacctgagccagggctgcccccagtactggccagaggagggcatgctgcgctatggccccatccaggtggagtgcatgagctgcagcatggactgtgatgtgatcaaccgcatcttccgcatctgcaacctgacccggccccaggagggctacctgatggtgcagcagttccagtacctgggctgggccagccaccgggaggtgcccggcagcaagaggagcttcctgaagctgatcctgcaggtggagaagtggcaggaggagtgtgaggagggggagggccgcaccatcatccactgcctgaatggaggcggccgcagcggcatgttctgtgccatcggcatcgtggtggagatggtgaagaggcagaatgtggtggatgtgttccacgctgtgaagaccctgaggaacagcaagcccaacatggtggaggcccctgagcagtaccgcttctgctatgatgtggccctggagtacctggagagcagctag

SEQ ID NO: 166353 - DNA, 4320 bp, Artificial Sequence
  Description of Artificial Sequence: Synthetic coding sequence
atggacaccacagctgctgctgccctgcctgcctttgtggccctgctgctgctgagcccctggcccctgctgggcagcgcccagggccagttctctgctgggggctgcacctttgatgatggccctggggcctgtgactaccaccaggacctgtatgatgactttgagtgggtgcacgtgtctgcccaggagccccactacctgcccccagagatgccccagggcagctacatgattgtggacagcagtgaccatgaccctggagagaaggcccggctgcagctgcccaccatgaaggaaaatgacacccactgcatcgacttctcctacctgctgtacagccagaagggcctgaaccctggcaccctgaacatcctggtgcgggtgaacaagggccccctggccaaccccatctggaatgtgacaggcttcaccggccgggactggctgcgggcagagctggccgtgtccaccttctggcccaatgagtaccaggtgatctttgaggccgaggtgtctgggggccgcagcggctacatcgccattgatgacatccaggtgctgagctacccctgtgacaagagcccccacttcctgcggctgggagatgtggaggtgaatgccggccagaatgccaccttccagtgcatcgccaccggcagagatgctgtgcacaacaagctgtggctgcagaggagaaatggagaggacatccctgtggcccagaccaagaacatcaaccacagaagatttgctgccagcttccggctgcaggaggtgaccaagacagaccaggacctgtaccgctgtgtgacccagagcgagcggggcagcggcgtgagcaactttgcccagctgattgtgcgggagcccccccggcccatcgccccaccccagctgctgggcgtgggccccacctacctgctgatccagctgaatgccaacagcatcattggagatggccccatcatcctgaaggaggtggagtacaggatgaccagcggctcctggacagagacccatgctgtgaatgcccccacctacaagctgtggcacctggaccctgacacagaatatgagatccgggtgctgctgaccaggcctggagagggcggcaccggcctgcccggccccccactcatcaccaggaccaagtgtgccgagcccatgaggacccccaagaccctgaagattgctgagatccaggccaggagaattgctgtggactgggagagcctgggctacaacatcacccgctgccacaccttcaacgtgaccatctgctaccactacttccggggccacaatgaaagcaaggctgactgcctggacatggaccccaaggccccccagcacgtggtgaaccacctgcccccctacaccaacgtgtccctgaagatgatcctgaccaaccctgagggcaggaaggagagcgaggagaccatcatccagacagatgaagatgtgcccggccctgtgcctgtgaagagcctgcagggcaccagctttgagaacaagatcttcctgaactggaaggagcccctggaccccaacggcatcatcacccagtatgagatctcctacagcagcatccgcagctttgatcctgctgtgcctgtggccggccccccccagacagtgagcaacctgtggaacagcacccaccacgtgttcatgcacctgcaccctggcaccacctaccagttcttcatccgggccagcacagtgaagggctttggacctgccacagccatcaacgtgaccaccaacatcagcgcccccaccctgcctgactatgaaggagtggatgccagcctgaatgaaacagccaccaccatcaccgtgctgctgcggcctgcccaggccaagggggcccccatcagcgcctaccagatcgtggtggaggagctgcacccccacaggaccaagcgggaggccggggccatggagtgctaccaggtgcctgtgacctaccagaatgccatgtctggaggagccccctactactttgctgctgagctgcccccaggcaacctgcctgagcccgcccccttcaccgtgggggacaacagaacctaccagggcttctggaacccccccctggcccccaggaagggctacaacatctacttccaggccatgagctctgtggagaaggagaccaagacccagtgtgtgcgcatcgccaccaaggccgccacagaggagcctgaggtgatcccagaccctgccaagcagacagacagagtggtgaagattgctggcatctctgctggcatcctggtgttcatcctgctgctgctggtggtgatcctgattgtgaagaagagcaagctggccaagaagaggaaggatgccatgggcaacacccggcaggagatgacccacatggtgaatgccatggacaggagctatgctgaccagagcaccctgcatgctgaggaccccctgagcatcaccttcatggaccagcacaacttcagccccaggtatgagaaccacagcgccacagctgagagcagccggctgctggatgtgccccgctacctgtgtgagggcacagagagcccctaccagacaggccagctgcacccagccatccgggtggccgacctgctgcagcacatcaacctgatgaagaccagtgacagctatggcttcaaggaggagtatgagagcttctttgagggccagagcgcctcctgggatgtggccaagaaggaccagaacagagccaagaacagatatggcaacatcatcgcctatgaccacagcagggtcatcctgcagcctgtggaggatgaccccagcagtgactacatcaatgccaactacattgatggctaccagaggcccagccactacatcgccacccagggccctgtgcatgaaacagtgtatgacttctggaggatgatctggcaggagcagagcgcctgcatcgtgatggtgaccaacctggtggaggtgggccgggtgaagtgctacaagtactggccagatgacacagaggtgtatggagacttcaaggtgacctgtgtggagatggagcccctggccgagtatgtggtgaggaccttcaccctggagcggcggggctacaatgagatccgggaggtgaagcagttccacttcaccggctggccagaccatggagtgccctaccacgccaccggcctgctgtccttcatcagaagagtgaagctgagcaacccccccagcgctggccccatcgtggtgcactgcagcgctggggccggccgcacaggctgctacatcgtgattgacatcatgctggacatggccgagcgggagggcgtggtggacatctacaactgtgtgaaggccctgcggagccgccgcatcaacatggtgcagacagaggagcagtacatcttcatccatgatgccatcctggaggcctgcctgtgtggggagacagccatccctgtgtgtgagttcaaggccgcctactttgacatgatcagaattgacagccagaccaacagcagccacctgaaggatgagttccagaccctgaacagcgtgaccccccggctgcaggccgaggactgcagcatcgcctgcctgcccagaaatcatgacaagaaccgcttcatggacatgctgcccccagaccgctgcctgcccttcctgatcaccattgatggagagagcagcaactacatcaatgctgccctgatggacagctaccggcagcctgctgccttcatcgtgacccagtaccccctgcccaacacagtgaaggacttctggaggctggtgtatgactatggctgcaccagcatcgtgatgctgaatgaggtggacctgagccagggctgcccccagtactggccagaggagggcatgctgcgctatggccccatccaggtggagtgcatgagctgcagcatggactgtgatgtgatcaaccgcatcttccgcatctgcaacctgacccggccccaggagggctacctgatggtgcagcagttccagtacctgggctgggccagccaccgggaggtgcccggcagcaagaggagcttcctgaagctgatcctgcaggtggagaagtggcaggaggagtgtgaggagggggagggccgcaccatcatccactgcctgaatggaggcggccgcagcggcatgttctgtgccatcggcatcgtggtggagatggtgaagaggcagaatgtggtggatgtgttccacgctgtgaagaccctgaggaacagcaagcccaacatggtggaggcccctgagcagtaccgcttctgctatgatgtggccctggagtacctggagagcagctag

SEQ ID NO: 166354 - DNA, 4323 bp, Artificial Sequence
  Description of Artificial Sequence: Synthetic coding sequence
atggacaccacagctgctgctgccctgcctgcctttgtggccctgctgctgctgagcccctggcccctgctgggcagcgcccagggccagttctctgctgggggctgcacctttgatgatggccctggggcctgtgactaccaccaggacctgtatgatgactttgagtgggtgcacgtgtctgcccaggagccccactacctgcccccagagatgccccagggcagctacatgattgtggacagcagtgaccatgaccctggagagaaggcccggctgcagctgcccaccatgaaggaaaatgacacccactgcatcgacttctcctacctgctgtacagccagaagggcctgaaccctggcaccctgaacatcctggtgcgggtgaacaagggccccctggccaaccccatctggaatgtgacaggcttcaccggccgggactggctgcgggcagagctggccgtgtccaccttctggcccaatgagtaccaggtgatctttgaggccgaggtgtctgggggccgcagcggctacatcgccattgatgacatccaggtgctgagctacccctgtgacaagagcccccacttcctgcggctgggagatgtggaggtgaatgccggccagaatgccaccttccagtgcatcgccaccggcagagatgctgtgcacaacaagctgtggctgcagaggagaaatggagaggacatccctgtggcccagaccaagaacatcaaccacagaagatttgctgccagcttccggctgcaggaggtgaccaagacagaccaggacctgtaccgctgtgtgacccagagcgagcggggcagcggcgtgagcaactttgcccagctgattgtgcgggagcccccccggcccatcgccccaccccagctgctgggcgtgggccccacctacctgctgatccagctgaatgccaacagcatcattggagatggccccatcatcctgaaggaggtggagtacaggatgaccagcggctcctggacagagacccatgctgtgaatgcccccacctacaagctgtggcacctggaccctgacacagaatatgagatccgggtgctgctgaccaggcctggagagggcggcaccggcctgcccggccccccactcatcaccaggaccaagtgtgccgagcccatgaggacccccaagaccctgaagattgctgagatccaggccaggagaattgctgtggactgggagagcctgggctacaacatcacccgctgccacaccttcaacgtgaccatctgctaccactacttccggggccacaatgaaagcaaggctgactgcctggacatggaccccaaggccccccagcacgtggtgaaccacctgcccccctacaccaacgtgtccctgaagatgatcctgaccaaccctgagggcaggaaggagagcgaggagaccatcatccagacagatgaagatgtgcccggccctgtgcctgtgaagagcctgcagggcaccagctttgagaacaagatcttcctgaactggaaggagcccctggaccccaacggcatcatcacccagtatgagatctcctacagcagcatccgcagctttgatcctgctgtgcctgtggccggccccccccagacagtgagcaacctgtggaacagcacccaccacgtgttcatgcacctgcaccctggcaccacctaccagttcttcatccgggccagcacagtgaagggctttggacctgccacagccatcaacgtgaccaccaacatcagcgcccccaccctgcctgactatgaaggagtggatgccagcctgaatgaaacagccaccaccatcaccgtgctgctgcggcctgcccaggccaagggggcccccatcagcgcctaccagatcgtggtggaggagctgcacccccacaggaccaagcgggaggccggggccatggagtgctaccaggtgcctgtgacctaccagaatgccatgtctggaggagccccctactactttgctgctgagctgcccccaggcaacctgcctgagcccgcccccttcaccgtgggggacaacagaacctaccagggcttctggaacccccccctggcccccaggaagggctacaacatctacttccaggccatgagctctgtggagaaggagaccaagacccagtgtgtgcgcatcgccaccaaggctgctgccacagaggagcctgaggtgatcccagaccctgccaagcagacagacagagtggtgaagattgctggcatctctgctggcatcctggtgttcatcctgctgctgctggtggtgatcctgattgtgaagaagagcaagctggccaagaagaggaaggatgccatgggcaacacccggcaggagatgacccacatggtgaatgccatggacaggagctatgctgaccagagcaccctgcacgccgaggaccccctgagcatcaccttcatggaccagcacaacttcagccccaggtatgagaaccacagcgccacagctgagagcagccggctgctggatgtgccccgctacctgtgtgagggcacagagagcccctaccagacaggccagctgcacccagccatccgggtggccgacctgctgcagcacatcaacctgatgaagaccagtgacagctatggcttcaaggaggagtatgagagcttctttgagggccagagcgcctcctgggatgtggccaagaaggaccagaacagagccaagaacagatatggcaacatcatcgcctatgaccacagcagggtcatcctgcagcctgtggaggatgaccccagcagtgactacatcaatgccaactacattgatggctaccagaggcccagccactacatcgccacccagggccctgtgcatgagaccgtgtatgacttctggaggatgatctggcaggagcagagcgcctgcatcgtgatggtgaccaacctggtggaggtgggccgggtgaagtgctacaagtactggccagatgacacagaggtgtatggagacttcaaggtgacctgtgtggagatggagcccctggccgagtatgtggtgaggaccttcaccctggagcggcggggctacaatgagatccgggaggtgaagcagttccacttcaccggctggccagaccacggcgtgccctaccacgccaccggcctgctgtccttcatccggcgggtgaagctgagcaaccccccatctgctggccccatcgtggtgcactgcagcgctggagctggccgcacaggctgctacatcgtcatcgacatcatgctggacatggccgagcgggagggcgtggtggacatctacaactgtgtgaaggccctgcggagccgccgcatcaacatggtgcagacagaggagcagtacatcttcatccatgatgccatcctggaggcctgcctgtgtggggagacagccatccctgtgtgtgagttcaaggccgcctactttgacatgatcagaattgacagccagaccaacagcagccacctgaaggatgagttccagaccctgaacagcgtgaccccccggctgcaggccgaggactgcagcatcgcctgcctgcccaggaaccacgacaagaaccgcttcatggacatgctgcccccagaccgctgcctgcccttcctgatcaccattgatggagagagcagcaactacatcaatgctgccctgatggacagctaccggcagcctgctgccttcatcgtgacccagtaccccctgcccaacacagtgaaggacttctggaggctggtgtatgactatggctgcaccagcatcgtgatgctgaatgaggtggacctgagccagggctgcccccagtactggccagaggagggcatgctgcgctatggccccatccaggtggagtgcatgagctgcagcatggactgtgatgtgatcaaccgcatcttccgcatctgcaacctgacccggccccaggagggctacctgatggtgcagcagttccagtacctgggctgggccagccaccgggaggtgcccggcagcaagaggagcttcctgaagctgatcctgcaggtggagaagtggcaggaggagtgtgaggagggggagggccgcaccatcatccactgcctgaatggaggcggccgcagcggcatgttctgtgccatcggcatcgtggtggagatggtgaagaggcagaatgtggtggatgtgttccacgctgtgaagaccctgaggaacagcaagcccaacatggtggaggcccctgagcagtaccgcttctgctatgatgtggccctggagtacctggagagcagctag

SEQ ID NO: 166355 - DNA, 4374 bp, Artificial Sequence
  Description of Artificial Sequence: Synthetic coding sequence
atggacaccacagctgctgctgccctgcctgcctttgtggccctgctgctgctgagcccctggcccctgctgggcagcgcccagggccagttctctgctgggggctgcacctttgatgatggccctggggcctgtgactaccaccaggacctgtatgatgactttgagtgggtgcacgtgtctgcccaggagccccactacctgcccccagagatgccccagggcagctacatgattgtggacagcagtgaccatgaccctggagagaaggcccggctgcagctgcccaccatgaaggaaaatgacacccactgcatcgacttctcctacctgctgtacagccagaagggcctgaaccctggcaccctgaacatcctggtgcgggtgaacaagggccccctggccaaccccatctggaatgtgacaggcttcaccggccgggactggctgcgggcagagctggccgtgtccaccttctggcccaatgagtaccaggtgatctttgaggccgaggtgtctgggggccgcagcggctacatcgccattgatgacatccaggtgctgagctacccctgtgacaagagcccccacttcctgcggctgggagatgtggaggtgaatgccggccagaatgccaccttccagtgcatcgccaccggcagagatgctgtgcacaacaagctgtggctgcagaggagaaatggagaggacatccctgtggcccagaccaagaacatcaaccacagaagatttgctgccagcttccggctgcaggaggtgaccaagacagaccaggacctgtaccgctgtgtgacccagagcgagcggggcagcggcgtgagcaactttgcccagctgattgtgcgggagcccccccggcccatcgccccaccccagctgctgggcgtgggccccacctacctgctgatccagctgaatgccaacagcatcattggagatggccccatcatcctgaaggaggtggagtacaggatgaccagcggctcctggacagagacccatgctgtgaatgcccccacctacaagctgtggcacctggaccctgacacagaatatgagatccgggtgctgctgaccaggcctggagagggcggcaccggcctgcccggccccccactcatcaccaggaccaagtgtgccgagcccatgaggacccccaagaccctgaagattgctgagatccaggccaggagaattgctgtggactgggagagcctgggctacaacatcacccgctgccacaccttcaacgtgaccatctgctaccactacttccggggccacaatgaaagcaaggctgactgcctggacatggaccccaaggccccccagcacgtggtgaaccacctgcccccctacaccaacgtgtccctgaagatgatcctgaccaaccctgagggcaggaaggagagcgaggagaccatcatccagacagatgaagatgtgcccggccctgtgcctgtgaagagcctgcagggcaccagctttgagaacaagatcttcctgaactggaaggagcccctggaccccaacggcatcatcacccagtatgagatctcctacagcagcatccgcagctttgatcctgctgtgcctgtggccggccccccccagacagtgagcaacctgtggaacagcacccaccacgtgttcatgcacctgcaccctggcaccacctaccagttcttcatccgggccagcacagtgaagggctttggacctgccacagccatcaacgtgaccaccaacatcagcgcccccaccctgcctgactatgaaggagtggatgccagcctgaatgaaacagccaccaccatcaccgtgctgctgcggcctgcccaggccaagggggcccccatcagcgcctaccagatcgtggtggaggagctgcacccccacaggaccaagcgggaggccggggccatggagtgctaccaggtgcctgtgacctaccagaatgccatgtctggaggagccccctactactttgctgctgagctgcccccaggcaacctgcctgagcccgcccccttcaccgtgggggacaacagaacctaccagggcttctggaacccccccctggcccccaggaagggctacaacatctacttccaggccatgagctctgtggagaaggagaccaagacccagtgtgtgcgcatcgccaccaaggctgctgccacagaggagcctgaggtgatcccagaccctgccaagcagacagacagagtggtgaagattgctggcatctctgctggcatcctggtgttcatcctgctgctgctggtggtgatcctgattgtgaagaagagcaagctggccaagaagaggaaggatgccatgggcaacacccggcaggagatgacccacatggtgaatgccatggacaggagctatgctgaccagagcaccctgcacgccgaggaccccctgagcatcaccttcatggaccagcacaacttcagcccccggctgcccaatgaccccctggtgcccacagctgtgctggatgagaaccacagcgccacagctgagagcagccggctgctggatgtgccccgctacctgtgtgagggcacagagagcccctaccagacaggccagctgcacccagccatccgggtggccgacctgctgcagcacatcaacctgatgaagaccagtgacagctatggcttcaaggaggagtatgagagcttctttgagggccagagcgcctcctgggatgtggccaagaaggaccagaacagagccaagaacagatatggcaacatcatcgcctatgaccacagcagggtcatcctgcagcctgtggaggatgaccccagcagtgactacatcaatgccaactacattgatgtgtccatcttcatcggctaccagaggcccagccactacatcgccacccagggccctgtgcatgaaacagtgtatgacttctggaggatgatctggcaggagcagagcgcctgcatcgtgatggtgaccaacctggtggaggtgggccgggtgaagtgctacaagtactggccagatgacacagaggtgtatggagacttcaaggtgacctgtgtggagatggagcccctggccgagtatgtggtgaggaccttcaccctggagcggcggggctacaatgagatccgggaggtgaagcagttccacttcaccggctggccagaccatggagtgccctaccacgccaccggcctgctgtccttcatcagaagagtgaagctgagcaacccccccagcgctggccccatcgtggtgcactgcagcgctggggccggccgcacaggctgctacatcgtgattgacatcatgctggacatggccgagcgggagggcgtggtggacatctacaactgtgtgaaggccctgcggagccgccgcatcaacatggtgcagacagaggagcagtacatcttcatccatgatgccatcctggaggcctgcctgtgtggggagacagccatccctgtgtgtgagttcaaggccgcctactttgacatgatcagaattgacagccagaccaacagcagccacctgaaggatgagttccagaccctgaacagcgtgaccccccggctgcaggccgaggactgcagcatcgcctgcctgcccagaaatcatgacaagaaccgcttcatggacatgctgcccccagaccgctgcctgcccttcctgatcaccattgatggagagagcagcaactacatcaatgctgccctgatggacagctaccggcagcctgctgccttcatcgtgacccagtaccccctgcccaacacagtgaaggacttctggaggctggtgtatgactatggctgcaccagcatcgtgatgctgaatgaggtggacctgagccagggctgcccccagtactggccagaggagggcatgctgcgctatggccccatccaggtggagtgcatgagctgcagcatggactgtgatgtgatcaaccgcatcttccgcatctgcaacctgacccggccccaggagggctacctgatggtgcagcagttccagtacctgggctgggccagccaccgggaggtgcccggcagcaagaggagcttcctgaagctgatcctgcaggtggagaagtggcaggaggagtgtgaggagggggagggccgcaccatcatccactgcctgaatggaggcggccgcagcggcatgttctgtgccatcggcatcgtggtggagatggtgaagaggcagaatgtggtggatgtgttccacgctgtgaagaccctgaggaacagcaagcccaacatggtggaggcccctgagcagtaccgcttctgctatgatgtggccctggagtacctggagagcagctag

SEQ ID NO: 166356 - DNA, 2244 bp, Artificial Sequence
  Description of Artificial Sequence: Synthetic coding sequence
atgaccctgaatggctgcatgctggtgctgaagagcctcatcatctaccacccccgctgccccaaggtgatctttgaagctgaggtgtctgggggccgcagcggctacatcgccattgatgacatccaggtgctgagctacccctgtgacaagagcccccacttcctgcggctgggagatgtggaggtgaatgccggccagaatgccaccttccagtgcatcgccaccggcagagatgctgtgcacaacaagctgtggctgcagaggagaaatggagaggacatccctgtggcccagaccaagaacatcaaccacagaagatttgctgccagcttccggctgcaggaggtgaccaagacagaccaggacctgtaccgctgtgtgacccagagcgagcggggcagcggcgtgagcaactttgcccagctgattgtgcgggagcccccccggcccatcgccccaccccagctgctgggcgtgggccccacctacctgctgatccagctgaatgccaacagcatcattggagatggccccatcatcctgaaggaggtggagtacaggatgaccagcggctcctggacagagacccatgctgtgaatgcccccacctacaagctgtggcacctggaccctgacacagaatatgagatccgggtgctgctgaccaggcctggagagggcggcaccggcctgcccggccccccactcatcaccaggaccaagtgtgccgagcccatgaggacccccaagaccctgaagattgctgagatccaggccaggagaattgctgtggactgggagagcctgggctacaacatcacccgctgccacaccttcaacgtgaccatctgctaccactacttccggggccacaatgaaagcaaggctgactgcctggacatggaccccaaggccccccagcacgtggtgaaccacctgcccccctacaccaacgtgtccctgaagatgatcctgaccaaccctgagggcaggaaggagagcgaggagaccatcatccagacagatgaagatgtgcccggccctgtgcctgtgaagagcctgcagggcaccagctttgagaacaagatcttcctgaactggaaggagcccctggaccccaacggcatcatcacccagtatgagatctcctacagcagcatccgcagctttgatcctgctgtgcctgtggccggccccccccagacagtgagcaacctgtggaacagcacccaccacgtgttcatgcacctgcaccctggcaccacctaccagttcttcatccgggccagcacagtgaagggcttcggccctgccacagccatcaacgtgaccaccaacatcagcgcccccaccctgcctgactatgagggcgtggatgccagcctgaatgaaacagccaccaccatcaccgtgctgctgcggcctgcccaggccaagggggcccccatcagcgcctaccagatcgtggtggaggagctgcacccccacaggaccaagcgggaggccggggccatggagtgctaccaggtgcctgtgacctaccagaatgccatgtctgggggcgccccctactactttgctgctgagctgcccccaggcaacctgcctgagcccgcccccttcaccgtgggggacaacagaacctaccagggcttctggaacccccccctggcccccaggaagggctacaacatctacttccaggccatgagctctgtggagaaggagaccaagacccagtgtgtgagaattgccaccaaggccgccgccacagaggagcctgaggtgatcccagaccctgccaagcagacagacagagtggtgaagattgctggcatctctgctggcatcctggtgttcatcctgctgctgctggtggtgatcctgattgtgaagaagcgctacatctgctggaggaggcacatctgcatccggaacatcagaagaagctactacagctacagctactacctgaagctggccaagaagaggaaggatgccatgggcaacacccggcaggagatgacccacatggtgaatgccatggacaggagctatgctgaccagagcaccctgcatgctgaggaccccctgagcatcaccttcatggaccagcacaacttcagcccccggctgcccaatgaccccctggtgcccacagctgtgctggtgcccagccctggcaggaagaatgtgtaccatggagacaacaacagcttctttgccatctcctacctgtag

SEQ ID NO: 166357 - DNA, 4389 bp, Artificial Sequence
  Description of Artificial Sequence: Synthetic coding sequence
atggacaccacagctgctgctgccctgcctgcctttgtggccctgctgctgctgagcccctggcccctgctgggcagcgcccagggccagttctctgctgggggctgcacctttgatgatggccctggggcctgtgactaccaccaggacctgtatgatgactttgagtgggtgcacgtgtctgcccaggagccccactacctgcccccagagatgccccagggcagctacatgattgtggacagcagtgaccatgaccctggagagaaggcccggctgcagctgcccaccatgaaggaaaatgacacccactgcatcgacttctcctacctgctgtacagccagaagggcctgaaccctggcaccctgaacatcctggtgcgggtgaacaagggccccctggccaaccccatctggaatgtgacaggcttcaccggccgggactggctgcgggcagagctggccgtgtccaccttctggcccaatgagtaccaggtgatctttgaggccgaggtgtctgggggccgcagcggctacatcgccattgatgacatccaggtgctgagctacccctgtgacaagagcccccacttcctgcggctgggagatgtggaggtgaatgccggccagaatgccaccttccagtgcatcgccaccggcagagatgctgtgcacaacaagctgtggctgcagaggagaaatggagaggacatccctgtggcccagaccaagaacatcaaccacagaagatttgctgccagcttccggctgcaggaggtgaccaagacagaccaggacctgtaccgctgtgtgacccagagcgagcggggcagcggcgtgagcaactttgcccagctgattgtgcgggagcccccccggcccatcgccccaccccagctgctgggcgtgggccccacctacctgctgatccagctgaatgccaacagcatcattggagatggccccatcatcctgaaggaggtggagtacaggatgaccagcggctcctggacagagacccatgctgtgaatgcccccacctacaagctgtggcacctggaccctgacacagaatatgagatccgggtgctgctgaccaggcctggagagggcggcaccggcctgcccggccccccactcatcaccaggaccaagtgtgccgagcccatgaggacccccaagaccctgaagattgctgagatccaggccaggagaattgctgtggactgggagagcctgggctacaacatcacccgctgccacaccttcaacgtgaccatctgctaccactacttccggggccacaatgaaagcaaggctgactgcctggacatggaccccaaggccccccagcacgtggtgaaccacctgcccccctacaccaacgtgtccctgaagatgatcctgaccaaccctgagggcaggaaggagagcgaggagaccatcatccagacagatgaagatgtgcccggccctgtgcctgtgaagagcctgcagggcaccagctttgagaacaagatcttcctgaactggaaggagcccctggaccccaacggcatcatcacccagtatgagatctcctacagcagcatccgcagctttgatcctgctgtgcctgtggccggccccccccagacagtgagcaacctgtggaacagcacccaccacgtgttcatgcacctgcaccctggcaccacctaccagttcttcatccgggccagcacagtgaagggctttggacctgccacagccatcaacgtgaccaccaacatcagcgcccccaccctgcctgactatgaaggagtggatgccagcctgaatgaaacagccaccaccatcaccgtgctgctgcggcctgcccaggccaagggggcccccatcagcgcctaccagatcgtggtggaggagctgcacccccacaggaccaagcgggaggccggggccatggagtgctaccaggtgcctgtgacctaccagaatgccatgtctggaggagccccctactactttgctgctgagctgcccccaggcaacctgcctgagcccgcccccttcaccgtgggggacaacagaacctaccagggcttctggaacccccccctggcccccaggaagggctacaacatctacttccaggccatgagctctgtggagaaggagaccaagacccagtgtgtgcgcatcgccaccaaggctgctgccacagaggagcctgaggtgatcccagaccctgccaagcagacagacagagtggtgaagattgctggcatctctgctggcatcctggtgttcatcctgctgctgctggtggtgatcctgattgtgaagaagagcaagctggccaagaagaggaaggatgccatgggcaacacccggcaggagatgacccacatggtgaatgccatggacaggagctatgctgaccagagcaccctgcacgccgaggaccccctgagcatcaccttcatggaccagcacaacttcagcccccggctgcccaatgaccccctggtgcccacagctgtgctggtgcccatcacagatgagaaccacagcgccacagctgagagcagccggctgctggatgtgccccgctacctgtgtgagggcacagagagcccctaccagacaggccagctgcacccagccatccgggtggccgacctgctgcagcacatcaacctgatgaagaccagtgacagctatggcttcaaggaggagtatgagagcttctttgagggccagagcgcctcctgggatgtggccaagaaggaccagaacagagccaagaacagatatggcaacatcatcgcctatgaccacagcagggtcatcctgcagcctgtggaggatgaccccagcagtgactacatcaatgccaactacatcgacatctggctgtacagagatggctaccagaggcccagccactacatcgccacccagggccctgtgcatgagaccgtgtatgacttctggaggatgatctggcaggagcagagcgcctgcatcgtgatggtgaccaacctggtggaggtgggccgggtgaagtgctacaagtactggccagatgacacagaggtgtatggagacttcaaggtgacctgtgtggagatggagcccctggccgagtatgtggtgaggaccttcaccctggagcggcggggctacaatgagatccgggaggtgaagcagttccacttcaccggctggccagaccacggcgtgccctaccacgccaccggcctgctgtccttcatccggcgggtgaagctgagcaaccccccatctgctggccccatcgtggtgcactgcagcgctggagctggccgcacaggctgctacatcgtcatcgacatcatgctggacatggccgagcgggagggcgtggtggacatctacaactgtgtgaaggccctgcggagccgccgcatcaacatggtgcagacagaggagcagtacatcttcatccatgatgccatcctggaggcctgcctgtgtggggagacagccatccctgtgtgtgagttcaaggccgcctactttgacatgatcagaattgacagccagaccaacagcagccacctgaaggatgagttccagaccctgaacagcgtgaccccccggctgcaggccgaggactgcagcatcgcctgcctgcccaggaaccacgacaagaaccgcttcatggacatgctgcccccagaccgctgcctgcccttcctgatcaccattgatggagagagcagcaactacatcaatgctgccctgatggacagctaccggcagcctgctgccttcatcgtgacccagtaccccctgcccaacacagtgaaggacttctggaggctggtgtatgactatggctgcaccagcatcgtgatgctgaatgaggtggacctgagccagggctgcccccagtactggccagaggagggcatgctgcgctatggccccatccaggtggagtgcatgagctgcagcatggactgtgatgtgatcaaccgcatcttccgcatctgcaacctgacccggccccaggagggctacctgatggtgcagcagttccagtacctgggctgggccagccaccgggaggtgcccggcagcaagaggagcttcctgaagctgatcctgcaggtggagaagtggcaggaggagtgtgaggagggggagggccgcaccatcatccactgcctgaatggaggcggccgcagcggcatgttctgtgccatcggcatcgtggtggagatggtgaagaggcagaatgtggtggatgtgttccacgctgtgaagaccctgaggaacagcaagcccaacatggtggaggcccctgagcagtaccgcttctgctatgatgtggccctggagtacctggagagcagctag

SEQ ID NO: 166358 - DNA, 4359 bp, Artificial Sequence
  Description of Artificial Sequence: Synthetic coding sequence
atgaggggcctgggcacctgcctggccaccctggccggcctgctgctgacagctgctggggagaccttcagcggcggctgcctgtttgatgagccctacagcacctgtggctacagccagagtgaaggagatgacttcaactgggagcaggtgaacaccctgaccaagcccaccagtgacccctggatgcccagcggcagcttcatgctggtgaatgccagcggccggcctgagggccagagggcccacctgctgctgccccagctgaaggaaaatgacacccactgcatcgacttccactactttgtgagcagcaagagcaacagccccccaggcctgctgaatgtgtatgtgaaggtgaacaacggccccctgggcaaccccatctggaacatcagcggggaccccaccaggacctggaacagagctgagctggccatcagcaccttctggcccaacttctaccaggtgatctttgaagtcatcaccagcggccaccagggctacctggccattgatgaggtgaaggtgctgggccacccctgcaccaggaccccccacttcctgcgcatccagaatgtggaggtgaatgccggccagtttgccaccttccagtgcagcgccatcggccgcacagtggccggggaccggctgtggctgcagggcattgatgtgagagatgcccccctgaaggagatcaaggtgaccagcagccgccgcttcatcgccagcttcaacgtggtgaacaccaccaagagagatgctgggaagtaccgctgcatgatcagaacagagggcggcgtgggcatcagcaactatgcagagctggtggtgaaggagccccctgtgcccatcgccccaccccagctggcctctgtgggcgccacctacctgtggatccagctgaatgccaacagcatcaatggagatggccccatcgtggcccgggaggtggagtactgcacagccagcggctcctggaatgaccggcagcctgtggacagcaccagctacaagattggccacctggaccctgacacagaatatgagatctctgtgctgctgaccaggcctggagagggcggcaccggcagccctggccctgccctgcggaccaggaccaagtgtgccgaccccatgaggggccccaggaagctggaggtggtggaggtgaagagccggcagatcaccatccgctgggagcccttcggctacaacgtgacccgctgccacagctacaacctgactgtgcactactgctaccaggtgggcggccaggagcaggtgcgggaggaggtgtcctgggacacagagaacagccacccccagcacaccatcaccaacctgagcccctacaccaacgtgtctgtgaagctgatcctgatgaaccctgagggcaggaaggagagccaggagctgattgtgcagacagatgaggacctgcccggggctgtgcccacagagagcatccagggcagcacctttgaggagaagatcttcctgcagtggagggagcccacccagacctacggcgtcatcaccctgtatgagatcacctacaaggctgtgtcctcctttgatcctgagattgacctgagcaaccagagcggccgggtgtccaagctgggcaatgagacccacttcctgttcttcggcctgtacccaggcaccacctacagcttcaccatccgggccagcacagccaagggctttggacctccagccaccaaccagttcaccaccaagatcagcgcccccagcatgcctgcctatgagctggagacccccctgaaccagacagacaacacagtgacagtgatgctgaagccagcccacagcagaggagcccctgtgtctgtgtaccagatcgtggtggaggaggagcggcccaggaggaccaagaagaccacagagatcctgaagtgctaccctgtgcccatccacttccagaatgccagcctgctgaacagccagtactactttgctgctgagttccctgctgacagcctgcaggccgcccagcccttcaccatcggggacaacaagacctacaacggctactggaacacccccctgctgccctacaagagctaccgcatctacttccaggccgccagccgggccaatggagagaccaagattgactgtgtgcaggtggccaccaagggggccgccacccccaagcctgtgcctgagcctgagaagcagacagaccacacagtgaagattgctggggtgattgctggcatcctgctgtttgtgatcatcttcctgggcgtggtgctggtgatgaagaagaggaagctggccaagaagaggaaggagaccatgagcagcacccggcaggagatgacagtgatggtgaacagcatggacaagagctatgcagagcagggcaccaactgtgatgaggccttctccttcatggacacccacaacctgaatggccgctctgtgagcagccccagcagcttcaccatgaagaccaacaccctgagcacctctgtgcccaacagctactacccagatgagacccacaccatggccagtgacaccagcagcctggtgcagagccacacctacaagaagcgggagccagcagatgtgccctaccagacaggccagctgcacccagccatccgggtggccgacctgctgcagcacatcacccagatgaagtgtgccgagggctacggcttcaaggaggagtatgagagcttctttgagggccagagcgccccctgggacagcgccaagaaggatgagaacaggatgaagaacagatatggcaacatcatcgcctatgaccacagccgggtgcggctgcagaccattgaaggagacaccaacagcgactacatcaatggaaactacattgatggctaccaccggcccaaccactacatcgccacccagggccccatgcaggagaccatctatgacttctggaggatggtgtggcatgaaaatacagccagcatcatcatggtgaccaacctggtggaggtgggccgggtgaagtgctgcaagtactggccagatgacacagagatctacaaggacatcaaggtgaccctgattgaaacagagctgctggccgagtatgtgatccgcacctttgctgtggagaagaggggcgtgcatgagatccgggagatccggcagttccacttcaccggctggccagaccacggcgtgccctaccacgccaccggcctgctgggctttgtgcggcaggtgaagagcaagagccccccatctgctggccccctggtggtgcactgcagcgctggagctggccgcacaggctgcttcatcgtcatcgacatcatgctggacatggccgagcgggagggcgtggtggacatctacaactgtgtgcgggagctgcggagcagaagagtgaacatggtgcagacagaggagcagtatgtgttcatccatgatgccatcctggaggcctgcctgtgtggggacacctctgtgcctgccagccaggtgcgcagcctgtactatgacatgaacaagctggacccccagaccaacagcagccagatcaaggaggagttccgcaccctgaacatggtgacccccaccctgcgggtggaggactgcagcatcgccctgctgcccaggaaccacgagaagaaccgctgcatggacatcctgcccccagaccgctgcctgcccttcctgatcaccattgatggagagagcagcaactacatcaatgctgccctgatggacagctacaagcagcccagcgccttcatcgtgacccagcaccccctgcccaacacagtgaaggacttctggaggctggtgctggactaccactgcacctctgtggtgatgctgaatgatgtggaccctgcccagctgtgcccccagtactggccagaaaatggagtgcacagacatggccccatccaggtggagtttgtgtctgctgacctggaggaggacatcatcagccgcatcttccgcatctacaatgctgcccggccccaggacggctacaggatggtgcagcagttccagttcctgggctggcccatgtacagagacacccctgtgtccaagaggagcttcctgaagctgatccggcaggtggacaagtggcaggaggagtacaatggaggagagggccgcacagtggtgcactgcctgaatggaggcggccgcagcggcaccttctgtgccatcagcatcgtgtgtgagatgctgcggcaccagaggacagtggatgtgttccacgctgtgaagaccctgaggaacaacaagcccaacatggtggacctgctggaccagtacaagttctgctatgaggtggccctggagtacctgaacagcggctag

SEQ ID NO: 166359 - DNA, 4173 bp, Artificial Sequence
  Description of Artificial Sequence: Synthetic coding sequence
atgcccagcggcagcttcatgctggtgaatgccagcggccggcctgagggccagagggcccacctgctgctgccccagctgaaggaaaatgacacccactgcatcgacttccactactttgtgagcagcaagagcaacagccccccaggcctgctgaatgtgtatgtgaaggtgaacaacggccccctgggcaaccccatctggaacatcagcggggaccccaccaggacctggaacagagctgagctggccatcagcaccttctggcccaacttctaccaggtgatctttgaagtcatcaccagcggccaccagggctacctggccattgatgaggtgaaggtgctgggccacccctgcaccaggaccccccacttcctgcgcatccagaatgtggaggtgaatgccggccagtttgccaccttccagtgcagcgccatcggccgcacagtggccggggaccggctgtggctgcagggcattgatgtgagagatgcccccctgaaggagatcaaggtgaccagcagccgccgcttcatcgccagcttcaacgtggtgaacaccaccaagagagatgctgggaagtaccgctgcatgatcagaacagagggcggcgtgggcatcagcaactatgcagagctggtggtgaaggagccccctgtgcccatcgccccaccccagctggcctctgtgggcgccacctacctgtggatccagctgaatgccaacagcatcaatggagatggccccatcgtggcccgggaggtggagtactgcacagccagcggctcctggaatgaccggcagcctgtggacagcaccagctacaagattggccacctggaccctgacacagaatatgagatctctgtgctgctgaccaggcctggagagggcggcaccggcagccctggccctgccctgcggaccaggaccaagtgtgccgaccccatgaggggccccaggaagctggaggtggtggaggtgaagagccggcagatcaccatccgctgggagcccttcggctacaacgtgacccgctgccacagctacaacctgactgtgcactactgctaccaggtgggcggccaggagcaggtgcgggaggaggtgtcctgggacacagagaacagccacccccagcacaccatcaccaacctgagcccctacaccaacgtgtctgtgaagctgatcctgatgaaccctgagggcaggaaggagagccaggagctgattgtgcagacagatgaggacctgcccggggctgtgcccacagagagcatccagggcagcacctttgaggagaagatcttcctgcagtggagggagcccacccagacctacggcgtcatcaccctgtatgagatcacctacaaggctgtgtcctcctttgatcctgagattgacctgagcaaccagagcggccgggtgtccaagctgggcaatgagacccacttcctgttcttcggcctgtacccaggcaccacctacagcttcaccatccgggccagcacagccaagggctttggacctccagccaccaaccagttcaccaccaagatcagcgcccccagcatgcctgcctatgagctggagacccccctgaaccagacagacaacacagtgacagtgatgctgaagccagcccacagcagaggagcccctgtgtctgtgtaccagatcgtggtggaggaggagcggcccaggaggaccaagaagaccacagagatcctgaagtgctaccctgtgcccatccacttccagaatgccagcctgctgaacagccagtactactttgctgctgagttccctgctgacagcctgcaggccgcccagcccttcaccatcggggacaacaagacctacaacggctactggaacacccccctgctgccctacaagagctaccgcatctacttccaggccgccagccgggccaatggagagaccaagattgactgtgtgcaggtggccaccaagggggccgccacccccaagcctgtgcctgagcctgagaagcagacagaccacacagtgaagattgctggggtgattgctggcatcctgctgtttgtgatcatcttcctgggcgtggtgctggtgatgaagaagaggaagctggccaagaagaggaaggagaccatgagcagcacccggcaggagatgacagtgatggtgaacagcatggacaagagctatgcagagcagggcaccaactgtgatgaggccttctccttcatggacacccacaacctgaatggccgctctgtgagcagccccagcagcttcaccatgaagaccaacaccctgagcacctctgtgcccaacagctactacccagatgagacccacaccatggccagtgacaccagcagcctggtgcagagccacacctacaagaagcgggagccagcagatgtgccctaccagacaggccagctgcacccagccatccgggtggccgacctgctgcagcacatcacccagatgaagtgtgccgagggctacggcttcaaggaggagtatgagagcttctttgagggccagagcgccccctgggacagcgccaagaaggatgagaacaggatgaagaacagatatggcaacatcatcgcctatgaccacagccgggtgcggctgcagaccattgaaggagacaccaacagcgactacatcaatggaaactacattgatggctaccaccggcccaaccactacatcgccacccagggccccatgcaggagaccatctatgacttctggaggatggtgtggcatgaaaatacagccagcatcatcatggtgaccaacctggtggaggtgggccgggtgaagtgctgcaagtactggccagatgacacagagatctacaaggacatcaaggtgaccctgattgaaacagagctgctggccgagtatgtgatccgcacctttgctgtggagaagaggggcgtgcatgagatccgggagatccggcagttccacttcaccggctggccagaccacggcgtgccctaccacgccaccggcctgctgggctttgtgcggcaggtgaagagcaagagccccccatctgctggccccctggtggtgcactgcagcgctggagctggccgcacaggctgcttcatcgtcatcgacatcatgctggacatggccgagcgggagggcgtggtggacatctacaactgtgtgcgggagctgcggagcagaagagtgaacatggtgcagacagaggagcagtatgtgttcatccatgatgccatcctggaggcctgcctgtgtggggacacctctgtgcctgccagccaggtgcgcagcctgtactatgacatgaacaagctggacccccagaccaacagcagccagatcaaggaggagttccgcaccctgaacatggtgacccccaccctgcgggtggaggactgcagcatcgccctgctgcccaggaaccacgagaagaaccgctgcatggacatcctgcccccagaccgctgcctgcccttcctgatcaccattgatggagagagcagcaactacatcaatgctgccctgatggacagctacaagcagcccagcgccttcatcgtgacccagcaccccctgcccaacacagtgaaggacttctggaggctggtgctggactaccactgcacctctgtggtgatgctgaatgatgtggaccctgcccagctgtgcccccagtactggccagaaaatggagtgcacagacatggccccatccaggtggagtttgtgtctgctgacctggaggaggacatcatcagccgcatcttccgcatctacaatgctgcccggccccaggacggctacaggatggtgcagcagttccagttcctgggctggcccatgtacagagacacccctgtgtccaagaggagcttcctgaagctgatccggcaggtggacaagtggcaggaggagtacaatggaggagagggccgcacagtggtgcactgcctgaatggaggcggccgcagcggcaccttctgtgccatcagcatcgtgtgtgagatgctgcggcaccagaggacagtggatgtgttccacgctgtgaagaccctgaggaacaacaagcccaacatggtggacctgctggaccagtacaagttctgctatgaggtggccctggagtacctgaacagcggctag

SEQ ID NO: 166360 - DNA, 4401 bp, Artificial Sequence
  Description of Artificial Sequence: Synthetic coding sequence
atgaggggcctgggcacctgcctggccaccctggccggcctgctgctgacagctgctggggagaccttcagcggcggctgcctgtttgatgagccctacagcacctgtggctacagccagagtgaaggagatgacttcaactgggagcaggtgaacaccctgaccaagcccaccagtgacccctggatgcccagcggcagcttcatgctggtgaatgccagcggccggcctgagggccagagggcccacctgctgctgccccagctgaaggaaaatgacacccactgcatcgacttccactactttgtgagcagcaagagcaacagccccccaggcctgctgaatgtgtatgtgaaggtgaacaacggccccctgggcaaccccatctggaacatcagcggggaccccaccaggacctggaacagagctgagctggccatcagcaccttctggcccaacttctaccaggtgatctttgaagtcatcaccagcggccaccagggctacctggccattgatgaggtgaaggtgctgggccacccctgcaccaggaccccccacttcctgcgcatccagaatgtggaggtgaatgccggccagtttgccaccttccagtgcagcgccatcggccgcacagtggccggggaccggctgtggctgcagggcattgatgtgagagatgcccccctgaaggagatcaaggtgaccagcagccgccgcttcatcgccagcttcaacgtggtgaacaccaccaagagagatgctgggaagtaccgctgcatgatcagaacagagggcggcgtgggcatcagcaactatgcagagctggtggtgaaggagccccctgtgcccatcgccccaccccagctggcctctgtgggcgccacctacctgtggatccagctgaatgccaacagcatcaatggagatggccccatcgtggcccgggaggtggagtactgcacagccagcggctcctggaatgaccggcagcctgtggacagcaccagctacaagattggccacctggaccctgacacagaatatgagatctctgtgctgctgaccaggcctggagagggcggcaccggcagccctggccctgccctgcggaccaggaccaagtgtgccgaccccatgaggggccccaggaagctggaggtggtggaggtgaagagccggcagatcaccatccgctgggagcccttcggctacaacgtgacccgctgccacagctacaacctgactgtgcactactgctaccaggtgggcggccaggagcaggtgcgggaggaggtgtcctgggacacagagaacagccacccccagcacaccatcaccaacctgagcccctacaccaacgtgtctgtgaagctgatcctgatgaaccctgagggcaggaaggagagccaggagctgattgtgcagacagatgaggacctgcccggggctgtgcccacagagagcatccagggcagcacctttgaggagaagatcttcctgcagtggagggagcccacccagacctacggcgtcatcaccctgtatgagatcacctacaaggctgtgtcctcctttgatcctgagattgacctgagcaaccagagcggccgggtgtccaagctgggcaatgagacccacttcctgttcttcggcctgtacccaggcaccacctacagcttcaccatccgggccagcacagccaagggctttggacctccagccaccaaccagttcaccaccaagatcagcgcccccagcatgcctgcctatgagctggagacccccctgaaccagacagacaacacagtgacagtgatgctgaagccagcccacagcagaggagcccctgtgtctgtgtaccagatcgtggtggaggaggagcggcccaggaggaccaagaagaccacagagatcctgaagtgctaccctgtgcccatccacttccagaatgccagcctgctgaacagccagtactactttgctgctgagttccctgctgacagcctgcaggccgcccagcccttcaccatcggggacaacaagacctacaacggctactggaacacccccctgctgccctacaagagctaccgcatctacttccaggccgccagccgggccaatggagagaccaagattgactgtgtgcaggtggccaccaagggggccgccacccccaagcctgtgcctgagcctgagaagcagacagaccacacagtgaagattgctggggtgattgctggcatcctgctgtttgtgatcatcttcctgggcgtggtgctggtgatgaagaagaggaagctggccaagaagaggaaggagaccatgagcagcacccggcaggagatgacagtgatggtgaacagcatggacaagagctatgcagagcagggcaccaactgtgatgaggccttctccttcatggacacccacaacctgaatggccgctctgtgagcagccccagcagcttcaccatgaagaccaacaccctgagcacctctgtgcccaacagctactacccagacccctttgtgcccacagccatcctggacttcagcctgaacaatgagacccacaccatggccagtgacaccagcagcctggtgcagagccacacctacaagaagcgggagccagcagatgtgccctaccagacaggccagctgcacccagccatccgggtggccgacctgctgcagcacatcacccagatgaagtgtgccgagggctacggcttcaaggaggagtatgagagcttctttgagggccagagcgccccctgggacagcgccaagaaggatgagaacaggatgaagaacagatatggcaacatcatcgcctatgaccacagccgggtgcggctgcagaccattgaaggagacaccaacagcgactacatcaatggaaactacattgatggctaccaccggcccaaccactacatcgccacccagggccccatgcaggagaccatctatgacttctggaggatggtgtggcatgaaaatacagccagcatcatcatggtgaccaacctggtggaggtgggccgggtgaagtgctgcaagtactggccagatgacacagagatctacaaggacatcaaggtgaccctgattgaaacagagctgctggccgagtatgtgatccgcacctttgctgtggagaagaggggcgtgcatgagatccgggagatccggcagttccacttcaccggctggccagaccacggcgtgccctaccacgccaccggcctgctgggctttgtgcggcaggtgaagagcaagagccccccatctgctggccccctggtggtgcactgcagcgctggagctggccgcacaggctgcttcatcgtcatcgacatcatgctggacatggccgagcgggagggcgtggtggacatctacaactgtgtgcgggagctgcggagcagaagagtgaacatggtgcagacagaggagcagtatgtgttcatccatgatgccatcctggaggcctgcctgtgtggggacacctctgtgcctgccagccaggtgcgcagcctgtactatgacatgaacaagctggacccccagaccaacagcagccagatcaaggaggagttccgcaccctgaacatggtgacccccaccctgcgggtggaggactgcagcatcgccctgctgcccaggaaccacgagaagaaccgctgcatggacatcctgcccccagaccgctgcctgcccttcctgatcaccattgatggagagagcagcaactacatcaatgctgccctgatggacagctacaagcagcccagcgccttcatcgtgacccagcaccccctgcccaacacagtgaaggacttctggaggctggtgctggactaccactgcacctctgtggtgatgctgaatgatgtggaccctgcccagctgtgcccccagtactggccagaaaatggagtgcacagacatggccccatccaggtggagtttgtgtctgctgacctggaggaggacatcatcagccgcatcttccgcatctacaatgctgcccggccccaggacggctacaggatggtgcagcagttccagttcctgggctggcccatgtacagagacacccctgtgtccaagaggagcttcctgaagctgatccggcaggtggacaagtggcaggaggagtacaatggaggagagggccgcacagtggtgcactgcctgaatggaggcggccgcagcggcaccttctgtgccatcagcatcgtgtgtgagatgctgcggcaccagaggacagtggatgtgttccacgctgtgaagaccctgaggaacaacaagcccaacatggtggacctgctggaccagtacaagttctgctatgaggtggccctggagtacctgaacagcggctag

SEQ ID NO: 166361 - DNA, 3720 bp, Artificial Sequence
  Description of Artificial Sequence: Synthetic coding sequence
atgggcaccctgagcctgcaccctggcattgatgtgagagatgcccccctgaaggagatcaaggtgaccagcagccgccgcttcatcgccagcttcaacgtggtgaacaccaccaagagagatgctgggaagtaccgctgcatgatcagaacagaaggaggagtgggcatcagcaactatgcagagctggtggtgaaggagccccctgtgcccatcgccccaccccagctggcctctgtgggcgccacctacctgtggatccagctgaatgccaacagcatcaatggagatggccccatcgtggcccgggaggtggagtactgcacagccagcggctcctggaatgaccggcagcctgtggacagcaccagctacaagattggccacctggaccctgacacagaatatgagatctctgtgctgctgaccaggcctggagagggcggcaccggcagccctggccctgccctgcggaccaggaccaagtgtgccgaccccatgaggggccccaggaagctggaggtggtggaggtgaagagccggcagatcaccatccgctgggagcccttcggctacaacgtgacccgctgccacagctacaacctgactgtgcactactgctaccaggtgggcggccaggagcaggtgcgggaggaggtgtcctgggacacagagaacagccacccccagcacaccatcaccaacctgagcccctacaccaacgtgtctgtgaagctgatcctgatgaaccctgagggcaggaaggagagccaggagctgattgtgcagacagatgaggacctgcctggagctgtgcccacagagagcatccagggcagcacctttgaggagaagatcttcctgcagtggagggagcccacccagacctatggagtcatcaccctgtatgagatcacctacaaggctgtgagcagctttgatcctgagattgacctgagcaaccagagcggccgggtgtccaagctgggcaatgagacccacttcctgttcttcggcctgtacccaggcaccacctacagcttcaccatccgggccagcacagccaagggcttcggccccccagccaccaaccagttcaccaccaagatcagcgcccccagcatgcctgcctatgagctggagacccccctgaaccagacagacaacacagtgacagtgatgctgaagccagcccacagcagaggagcccctgtgtctgtgtaccagatcgtggtggaggaggagcggcccaggaggaccaagaagaccacagagatcctgaagtgctaccctgtgcccatccacttccagaatgccagcctgctgaacagccagtactactttgctgctgagttccctgctgacagcctgcaggccgcccagcccttcaccatcggggacaacaagacctacaacggctactggaacacccccctgctgccctacaagagctaccgcatctacttccaggccgccagccgggccaacggggagaccaagattgactgtgtgcaggtggccaccaagggagctgccacccccaagcctgtgcctgagcctgagaagcagacagaccacacagtgaagattgctggggtgattgctggcatcctgctcttcgtcatcatcttcctgggcgtggtgctggtgatgaagaagaggaagctggccaagaagaggaaggagaccatgagcagcacccggcaggagatgacagtgatggtgaacagcatggacaagagctatgcagagcagggcaccaactgtgatgaggccttctccttcatggacacccacaacctgaatggccgctctgtgagcagccccagcagcttcaccatgaagaccaacaccctgagcacctctgtgcccaacagctactacccagatgagacccacaccatggccagtgacaccagcagcctggtgcagagccacacctacaagaagcgggagccagcagatgtgccctaccagacaggccagctgcacccagccatccgggtggccgacctgctgcagcacatcacccagatgaagtgtgccgagggctacggcttcaaggaggagtatgagagcttctttgagggccagagcgccccctgggacagcgccaagaaggatgaaaataggatgaagaacagatatggcaacatcatcgcctatgaccacagccgggtgcggctgcagaccatcgagggggacaccaacagcgactacatcaatggaaactacattgatggctaccaccggcccaaccactacatcgccacccagggccccatgcaggagaccatctatgacttctggaggatggtgtggcatgagaacacagccagcatcatcatggtgaccaacctggtggaggtgggccgggtgaagtgctgcaagtactggccagatgacacagagatctacaaggacatcaaggtgaccctcatcgagacagagctgctggccgagtatgtgatccgcacctttgctgtggagaagaggggcgtgcatgagatccgggagatccggcagttccacttcaccggctggccagaccatggagtgccctaccacgccaccggcctgctgggctttgtgcggcaggtgaagagcaagagcccccccagcgctggccccctggtggtgcactgcagcgctggggccggccgcacaggctgcttcatcgtgattgacatcatgctggacatggccgagcgggagggcgtggtggacatctacaactgtgtgcgggagctgcggagccggcgggtgaacatggtgcagacagaggagcagtatgtgttcatccatgatgccatcctggaggcctgcctgtgtggggacacctctgtgcctgccagccaggtgcgcagcctgtactatgacatgaacaagctggacccccagaccaacagcagccagatcaaggaggagttccgcaccctgaacatggtgacccccaccctgcgggtggaggactgcagcatcgccctgctgcccagaaatcatgagaagaaccgctgcatggacatcctgcccccagaccgctgcctgcccttcctgatcaccattgatggagagagcagcaactacatcaatgctgccctgatggacagctacaagcagcccagcgccttcatcgtgacccagcaccccctgcccaacacagtgaaggacttctggaggctggtgctggactaccactgcacctctgtggtgatgctgaatgatgtggaccctgcccagctgtgcccccagtactggccagaaaatggagtgcaccgccacggccccatccaggtggagtttgtgtctgctgacctggaggaggacatcatcagccgcatcttccgcatctacaatgctgcccggccccaggacggctacaggatggtgcagcagttccagttcctgggctggcccatgtacagagacacccctgtgtccaagaggagcttcctgaagctgatccggcaggtggacaagtggcaggaggagtacaacggcggggagggccgcacagtggtgcactgcctgaatggaggcggccgcagcggcaccttctgtgccatcagcatcgtgtgtgagatgctgcggcaccagaggacagtggatgtgttccacgctgtgaagaccctgaggaacaacaagcccaacatggtggacctgctggaccagtacaagttctgctatgaggtggccctggagtacctgaacagcggctag

SEQ ID NO: 166362 - DNA, 2940 bp, Artificial Sequence
  Description of Artificial Sequence: Synthetic coding sequence
atgaggcggcccaggaggcctgggggcctgggcggcagcggcggcctgcggctgctgctgtgcctgctgctgctgagcagcaggcctgggggctgcagcgctgtgtctgcccacggctgcctgtttgaccggcggctgtgcagccacctggaggtgtgcatccaggacggcctgtttggccagtgccaggtgggcgtgggccaggcccggcccctgctgcaggtgaccagccctgtgctgcagaggctgcagggcgtgctgcggcagctgatgagccagggcctgtcctggcatgatgacctgacccagtatgtgatcagccaggagatggagcgcatcccccggctgcggcccccagagccccggccccgggacagaagtggcctggcccccaagaggcctggccctgctggggagctgctgctgcaggacatccccactggaagtgccccagctgcccagcaccggctgccccagccccctgtgggcaagggcggggccggggccagcagcagcctgagccccctgcaggccgagctgctgccccccctgctggagcacctgctgctgcccccccagcccccccaccccagcctgtcctatgagcccgccctgctgcagccctacctgttccaccagtttggcagcagagatggcagccgggtgtctgagggcagccctggcatggtgtctgtgggccccctgcccaaggccgaggccccagccctcttcagcaggacagccagcaagggcatctttggagaccaccctggccacagctatggagacctgcccggccccagccctgcccagctgttccaggacagcggcctgctgtacctggcccaggagctgcctgcccccagccgggcccgggtgccccggctgcctgagcagggcagcagcagcagagctgaggacagccctgagggctatgagaaggagggcctgggggacagaggagagaagccagccagccctgctgtgcagccagatgctgccctgcagaggctggccgctgtgctggccggctatggagtggagctgcggcagctgaccccagagcagctgagcaccctgctgaccctgctgcagctgctgcccaagggagctggaagaaatcctggaggagtggtgaatgtgggcgctgacatcaagaagaccatggagggccctgtggagggccgggacacagctgagctgcctgcccggaccagccccatgcctggccaccccacagccagccccaccagcagcgaggtgcagcaggtgcccagccctgtgagcagcgagccccccaaggccgcccggccccctgtgacccctgtgctgctggagaagaagagccccctgggccagagccagcccaccgtggccggccagcccagcgcccggcctgctgctgaggagtatggctacatcgtgacagaccagaagcccctgagcctggccgccggcgtgaagctgctggagatcctggccgagcacgtgcacatgagcagcggcagcttcatcaacatctctgtggtgggccctgccctgaccttccgcatccgccacaatgagcagaacctgagcctggctgatgtgacccagcaggccggcctggtgaagtctgagctggaggcccagacaggcctgcagatcctgcagacaggagtgggccagcgggaggaggccgctgctgtgctgccccagacagcccacagcaccagccccatgaggtctgtgctgctgaccctggtggccctggccggcgtggccggcctgctggtggccctggccgtggccctgtgtgtgcggcagcacgcccggcagcaggacaaggagcggctggccgccctgggccctgagggcgcccatggagacaccacctttgagtaccaggacctgtgccggcagcacatggccaccaagagcctcttcaacagagctgagggccccccagagcccagccgggtgtcctctgtgagcagccagttcagtgatgctgcccaggccagccccagcagccacagcagcacccccagctggtgtgaggagcccgcccaggccaacatggacatcagcacaggccacatgatcctggcctacatggaggaccacctgaggaacagagaccggctggccaaggagtggcaggccctgtgtgcctaccaggccgagcccaacacctgtgccacagcccagggcgagggcaacatcaagaagaacagacacccagacttcctgccctatgaccacgcccgcatcaagctgaaggtggagagcagccccagcagaagtgactacatcaatgccagccccatcattgaacatgaccccaggatgcctgcctacatcgccacccagggccccctgagccacaccatcgctgacttctggcagatggtgtgggagagcggctgcaccgtcatcgtgatgctgacccccctggtggaggatggagtgaagcagtgtgaccgctactggccagatgagggcgccagcctgtaccacgtgtatgaggtgaacctggtgtctgagcacatctggtgtgaggacttcctggtgcgctccttctacctgaagaatgtgcagacccaggagaccaggaccctgacccagttccacttcctgtcctggccagctgagggcaccccagccagcacccggcccctgctggacttccggaggaaggtgaacaagtgctaccggggccgcagctgccccatcatcgtgcactgcagtgatggagctggccgcacaggcacctacatcctgattgacatggtgctgaacaggatggccaagggcgtgaaggagattgatattgctgccaccctggagcacgtgcgggaccagaggcctggcctggtgcgcagcaaggaccagtttgaatttgccctgacagctgtggccgaggaggtgaatgccatcctgaaggccctgccccagtag

SEQ ID NO: 166363 - DNA, 2853 bp, Artificial Sequence
  Description of Artificial Sequence: Synthetic coding sequence
atgaggcggcccaggaggcctgggggcctgggcggcagcggcggcctgcggctgctgctgtgcctgctgctgctgagcagcaggcctgggggctgcagcgctgtgtctgcccacggctgcctgtttgaccggcggctgtgcagccacctggaggtgtgcatccaggacggcctgtttggccagtgccaggtgggcgtgggccaggcccggcccctgctgcaggtgaccagccctgtgctgcagaggctgcagggcgtgctgcggcagctgatgagccagggcctgtcctggcatgatgacctgacccagtatgtgatcagccaggagatggagcgcatcccccggctgcggcccccagagccccggccccgggacagaagtggcctggcccccaagaggcctggccctgctggggagctgctgctgcaggacatccccactggaagtgccccagctgcccagcaccggctgccccagccccctgtgggcaagggcggggccggggccagcagcagcctgagccccctgcaggccgagctgctgccccccctgctggagcacctgctgctgcccccccagcccccccaccccagcctgtcctatgagcccgccctgctgcagccctacctgttccaccagtttggcagcagagatggcagccgggtgtctgagggcagccctggcatggtgtctgtgggccccctgcccaaggccgaggccccagccctcttcagcaggacagccagcaagggcatctttggagaccaccctggccacagctatggagacctgcccggccccagccctgcccagctgttccaggacagcggcctgctgtacctggcccaggagctgcctgcccccagccgggcccgggtgccccggctgcctgagcagggcagcagcagcagagctgaggacagccctgagggctatgagaaggagggcctgggggacagaggagagaagccagccagccctgctgtgcagccagatgctgccctgcagaggctggccgctgtgctggccggctatggagtggagctgcggcagctgaccccagagcagctgagcaccctgctgaccctgctgcagctgctgcccaagggagctggaagaaatcctggaggagtggtgaatgtgggcgctgacatcaagaagaccatggagggccctgtggagggccgggacacagctgagctgcctgcccggaccagccccatgcctggccaccccacagccagccccaccagcagcgaggtgcagcaggtgcccagccctgtgagcagcgagccccccaaggccgcccggccccctgtgacccctgtgctgctggagaagaagagccccctgggccagagccagcccaccgtggccggccagcccagcgcccggcctgctgctgaggagtatggctacatcgtgacagaccagaatgtggtgggccctgccctgaccttccgcatccgccacaatgagcagaacctgagcctggctgatgtgacccagcaggccggcctggtgaagtctgagctggaggcccagacaggcctgcagatcctgcagacaggagtgggccagcgggaggaggccgctgctgtgctgccccagacagcccacagcaccagccccatgaggtctgtgctgctgaccctggtggccctggccggcgtggccggcctgctggtggccctggccgtggccctgtgtgtgcggcagcacgcccggcagcaggacaaggagcggctggccgccctgggccctgagggcgcccacggggacaccacctttgagtaccaggacctgtgccggcagcacatggccaccaagagcctcttcaacagagctgagggccccccagagcccagccgggtgtcctctgtgagcagccagttcagtgatgctgcccaggccagccccagcagccacagcagcacccccagctggtgtgaggagcccgcccaggccaacatggacatcagcacaggccacatgatcctggcctacatggaggaccacctgaggaacagagaccggctggccaaggagtggcaggccctgtgtgcctaccaggccgagcccaacacctgtgccacagcccagggcgagggcaacatcaagaagaacagacacccagacttcctgccctatgaccacgcccgcatcaagctgaaggtggagagcagccccagcagaagtgactacatcaatgccagccccatcatcgagcatgaccccaggatgcctgcctacatcgccacccagggccccctgagccacaccatcgctgacttctggcagatggtgtgggagagcggctgcaccgtgattgtgatgctgacccccctggtggaggatggagtgaagcagtgtgaccgctactggccagatgaaggagccagcctgtaccacgtgtatgaggtgaacctggtgtctgagcacatctggtgtgaggacttcctggtgcgctccttctacctgaagaatgtgcagacccaggagaccaggaccctgacccagttccacttcctgtcctggccagctgagggcaccccagccagcacccggcccctgctggacttccggaggaaggtgaacaagtgctaccggggccgcagctgccccatcatcgtgcactgcagtgatggagctggccgcacaggcacctacatcctgattgacatggtgctgaacaggatggccaagggcgtgaaggagattgatattgctgccaccctggagcacgtgcgggaccagaggcctggcctggtgcgcagcaaggaccagtttgaatttgccctgacagctgtggccgaggaggtgaatgccatcctgaaggccctgccccagtag

SEQ ID NO: 166364 - DNA, 489 bp, Artificial Sequence
  Description of Artificial Sequence: Synthetic coding sequence
atgaggcggcccaggaggcctgggggcctgggcggcagcggcggcctgcggctgctgctgtgcctgctgctgctgagcagcaggcctgggggctgcagcgctgtgtctgcccacggctgcctgtttgaccggcggctgtgcagccacctggaggtgtgcatccaggacggcctgtttggccagtgccaggtgggcgtgggccaggcccggcccctgctgcaggtgaccagccctgtgctgcagaggctgcagggcgtgctgcggcagctgatgagccagggcctgtcctggcatgatgacctgacccagtatgtgatcagccaggagatggagcgcatcccccggctgcggcccccagagccccggccccgggacagaagtggcctggcccccaagaggcctggccctgctggggagctgctgctgcaggacatccccactggaagtgccccagctgcccagctgctgtctgtgcccagcgctggatag

SEQ ID NO: 166365 - DNA, 2670 bp, Artificial Sequence
  Description of Artificial Sequence: Synthetic coding sequence
atgagccagggcctgtcctggcatgatgacctgacccagtatgtgatcagccaggagatggagcgcatcccccggctgcggcccccagagccccggccccgggacagaagtggcctggcccccaagaggcctggccctgctggggagctgctgctgcaggacatccccactggaagtgccccagctgcccagcaccggctgccccagccccctgtgggcaagggcggggccggggccagcagcagcctgagccccctgcaggccgagctgctgccccccctgctggagcacctgctgctgcccccccagcccccccaccccagcctgtcctatgagcccgccctgctgcagccctacctgttccaccagtttggcagcagagatggcagccgggtgtctgagggcagccctggcatggtgtctgtgggccccctgcccaaggccgaggccccagccctcttcagcaggacagccagcaagggcatctttggagaccaccctggccacagctatggagacctgcccggccccagccctgcccagctgttccaggacagcggcctgctgtacctggcccaggagctgcctgcccccagccgggcccgggtgccccggctgcctgagcagggcagcagcagcagagctgaggacagccctgagggctatgagaaggagggcctgggggacagaggagagaagccagccagccctgctgtgcagccagatgctgccctgcagaggctggccgctgtgctggccggctatggagtggagctgcggcagctgaccccagagcagctgagcaccctgctgaccctgctgcagctgctgcccaagggagctggaagaaatcctggaggagtggtgaatgtgggcgctgacatcaagaagaccatggagggccctgtggagggccgggacacagctgagctgcctgcccggaccagccccatgcctggccaccccacagccagccccaccagcagcgaggtgcagcaggtgcccagccctgtgagcagcgagccccccaaggccgcccggccccctgtgacccctgtgctgctggagaagaagagccccctgggccagagccagcccaccgtggccggccagcccagcgcccggcctgctgctgaggagtatggctacatcgtgacagaccagaagcccctgagcctggccgccggcgtgaagctgctggagatcctggccgagcacgtgcacatgagcagcggcagcttcatcaacatctctgtggtgggccctgccctgaccttccgcatccgccacaatgagcagaacctgagcctggctgatgtgacccagcaggccggcctggtgaagtctgagctggaggcccagacaggcctgcagatcctgcagacaggagtgggccagcgggaggaggccgctgctgtgctgccccagacagcccacagcaccagccccatgaggtctgtgctgctgaccctggtggccctggccggcgtggccggcctgctggtggccctggccgtggccctgtgtgtgcggcagcacgcccggcagcaggacaaggagcggctggccgccctgggccctgagggcgcccatggagacaccacctttgagtaccaggacctgtgccggcagcacatggccaccaagagcctcttcaacagagctgagggccccccagagcccagccgggtgtcctctgtgagcagccagttcagtgatgctgcccaggccagccccagcagccacagcagcacccccagctggtgtgaggagcccgcccaggccaacatggacatcagcacaggccacatgatcctggcctacatggaggaccacctgaggaacagagaccggctggccaaggagtggcaggccctgtgtgcctaccaggccgagcccaacacctgtgccacagcccagggcgagggcaacatcaagaagaacagacacccagacttcctgccctatgaccacgcccgcatcaagctgaaggtggagagcagccccagcagaagtgactacatcaatgccagccccatcattgaacatgaccccaggatgcctgcctacatcgccacccagggccccctgagccacaccatcgctgacttctggcagatggtgtgggagagcggctgcaccgtcatcgtgatgctgacccccctggtggaggatggagtgaagcagtgtgaccgctactggccagatgagggcgccagcctgtaccacgtgtatgaggtgaacctggtgtctgagcacatctggtgtgaggacttcctggtgcgctccttctacctgaagaatgtgcagacccaggagaccaggaccctgacccagttccacttcctgtcctggccagctgagggcaccccagccagcacccggcccctgctggacttccggaggaaggtgaacaagtgctaccggggccgcagctgccccatcatcgtgcactgcagtgatggagctggccgcacaggcacctacatcctgattgacatggtgctgaacaggatggccaagggcgtgaaggagattgatattgctgccaccctggagcacgtgcgggaccagaggcctggcctggtgcgcagcaaggaccagtttgaatttgccctgacagctgtggccgaggaggtgaatgccatcctgaaggccctgccccagtag

SEQ ID NO: 166366 - DNA, 2853 bp, Artificial Sequence; identical to SEQ ID NO: 166363
  Description of Artificial Sequence: Synthetic coding sequence

SEQ ID NO: 166367 - DNA, 2961 bp, Artificial Sequence
  Description of Artificial Sequence: Synthetic coding sequence
atgggcccccccctgcccctgctgctgctgctgctgctgctgctgcccccccgggtgctgcctgctgcccccagctctgtgccccggggccggcagctgcccggccgcctgggctgcctgctggaggagggcctgtgtggggccagcgaggcctgtgtgaatgatggagtgtttggccgctgccagaaggtgcctgccatggacttctaccgctatgaggtgtcccctgtggccctgcagaggctgcgggtggccctgcagaagctgagcggcaccggcttcacctggcaggatgactacacccagtatgtgatggaccaggagctggccgacctgcccaagacctacctgcggcggcctgaggccagcagccctgcccggcccagcaagcacagcgtgggcagcgagcggcgctacagccgggagggcggggccgccctggccaatgccctgcggcggcacctgcccttcctggaggccctgagccaggccccagccagtgatgtgctggcccggacccacacagcccaggaccggcccccagcagaaggagatgaccgcttcagcgagagcatcctgacctacgtggcccacaccagcgccctgacctacccacctggcagcaggacccagctgcgggaggacctgctgcccaggaccctgggccagctgcagccagatgagctgagccccaaggtggacagcggcgtggacagacaccacctgatggccgccctgagcgcctatgctgcccagaggcccccagcccctcctggagagggcagcctggagccccagtacctgctgcgggcccccagcaggatgccccggcccctgctggccccagctgccccccagaagtggcccagccccctgggggacagcgaggaccccagcagcactggagatggagcccgcatccacaccctgctgaaggacctgcagaggcagcctgctgaggtgcggggcctgagcggcctggagctggatggcatggccgagctgatggccggcctgatgcagggcgtggaccatggagtggcccggggcagccctggccgggccgccctgggggagagcggggagcaggctgatggccccaaggccaccctgcggggggacagcttcccagatgatggagtgcaggatgatgatgaccggctgtaccaggaggtgcaccggctgagcgccaccctgggcggcctgctgcaggaccacggcagccggctgctgcccggggccctgccctttgcccggcccctggacatggagaggaagaagtctgagcaccctgagagcagcctgagcagcgaggaggagacagctggggtggagaatgtgaagagccagacctacagcaaggacctgctgggccagcagccccacagcgagcctggagctgctgccttcggggagctgcagaaccagatgcctggccccagcaaggaggagcagagcctgcctgctggggcccaggaggccctgagtgatggcctgcagctggaggtgcagcccagcgaggaggaggcccggggctacatcgtgacagaccgggaggtgctgggccctgctgtgaccttcaaggtgtctgccaacgtgcagaatgtgaccacagaagatgtggagaaggccaccgtggacaacaaggacaagctggaggagaccagcggcctgaagatcctgcagacaggagtgggcagcaagagcaagctgaagttcctgcccccccaggccgagcaggaggacagcaccaagttcatcgccctgaccctggtgtccctggcctgcatcctgggcgtgctgctggccagcggcctcatctactgcctgcggcacagcagccagcaccggctgaaggagaagctgagcggcctgggcggggaccctggagcagatgccacagctgcctaccaggagctgtgccggcagaggatggccacccggcccccagacaggcctgagggcccccacaccagccgcatcagctctgtgagcagccagttcagtgatggccccatccccagccccagcgcccggagcagcgccagctcctggagcgaggagcctgtgcagagcaacatggacatcagcacaggccacatgatcctgagctacatggaggaccacctgaagaacaagaaccggctggagaaggagtgggaggccctgtgtgcctaccaggccgagcccaacagcagctttgtggcccagcgggaggagaatgtgcccaagaacagaagcctggccgtgctgacctatgaccacagccgggtgctgctgaaggccgagaacagccacagccacagcgactacatcaatgccagccccatcatggaccatgaccccagaaatcctgcctacatcgccacccagggccccctgcctgccaccgtggccgacttctggcagatggtgtgggagagcggctgtgtggtgattgtgatgctgacccccctggctgaaaatggagtgcggcagtgctaccactactggccagatgagggcagcaacctgtaccacatctatgaggtgaacctggtgtctgagcacatctggtgtgaggacttcctggtgcgctccttctacctgaagaacctgcagaccaatgagaccaggacagtgacccagttccacttcctgtcctggtatgaccggggcgtgcccagcagcagccgcagcctgctggacttccggaggaaggtgaacaagtgctaccggggccgcagctgccccatcatcgtgcactgcagtgatggagctggccgcagcggcacctacgtgctgattgacatggtgctgaacaagatggccaagggggccaaggagattgatattgctgccaccctggagcacctgcgggaccagaggcctggcatggtgcagaccaaggagcagtttgaatttgccctgacagctgtggccgaggaggtgaatgccatcctgaaggccctgccccagtag

SEQ ID NO: 166368 - DNA, 2997 bp, Artificial Sequence
  Description of Artificial Sequence: Synthetic coding sequence
atgggcccccccctgcccctgctgctgctgctgctgctgctgctgcccccccgggtgctgcctgctgcccccagctctgtgccccggggccggcagctgcccggccgcctggatggagtgtttggccgctgccagaaggtgcctgccatggacttctaccgctatgaggtgtcccctgtggccctgcagaggctgcgggtggccctgcagaagctgtctggaacaggcttcacctggcaggatgactacacccagtatgtgatggaccaggagctggccgacctgcccaagacctacctgcggcggcctgaggccagcagccctgcccggcccagcaagcacagcgtgggcagcgagcggcgctacagccgggagggcggggccgccctggccaatgccctgcggcggcacctgcccttcctggaggccctgagccaggccccagccagtgatgtgctggcccggacccacacagcccaggaccggcccccagcagaaggagatgaccgcttcagcgagagcatcctgacctacgtggcccacaccagcgccctgacctacccacctggcagcaggacccagctgcgggaggacctgctgcccaggaccctgggccagctgcagccagatgagctgagccccaaggtggacagcggcgtggacagacaccacctgatggccgccctgagcgcctatgctgcccagaggcccccagcccctcctggagagggcagcctggagccccagtacctgctgcgggcccccagcaggatgccccggcccctgctggccccagctgccccccagaagtggcccagccccctgggggacagcgaggaccccagcagcactggagatggagcccgcatccacaccctgctgaaggacctgcagaggcagcctgctgaggtgcggggcctgagcggcctggagctggatggcatggccgagctgatggccggcctgatgcagggcgtggaccacggcgtggcccggggcagccctggccgggccgccctgggggagagcggggagcaggctgatggccccaaggccaccctgcggggggacagcttcccagatgatggagtgcaggatgatgatgaccggctgtaccaggaggtgcaccggctgagcgccaccctgggcggcctgctgcaggaccacggcagccggctgctgcccggggccctgccctttgcccggcccctggacatggagaggaagaagtctgagcaccctgagagcagcctgagcagcgaggaggagacagctggggtggagaatgtgaagagccagacctacagcaaggacctgctgggccagcagccccacagcgagcccggggctgctgcctttggagagctgcagaaccagatgcctggccccagcaaggaggagcagagcctgcctgctggggcccaggaggccctgagtgatggcctgcagctggaggtgcagcccagcgaggaggaggcccggggctacatcgtgacagaccgggaccccctgcggcctgaggagggccggcggctggtggaggatgtggcccggctgctgcaggtgcccagcagcgcctttgctgatgtggaggtgctgggccctgctgtgaccttcaaggtgtctgccaacgtgcagaatgtgaccacagaagatgtggagaaggccaccgtggacaacaaggacaagctggaggagaccagcggcctgaagatcctgcagacaggagtgggcagcaagagcaagctgaagttcctgcccccccaggccgagcaggaggacagcaccaagttcatcgccctgaccctggtgtccctggcctgcatcctgggcgtgctgctggccagcggcctcatctactgcctgcggcacagcagccagcaccggctgaaggagaagctgagcggcctgggcggggaccctggagcagatgccacagctgcctaccaggagctgtgccggcagaggatggccacccggcccccagacaggcctgagggcccccacaccagccgcatcagctctgtgagcagccagttcagtgatggccccatccccagccccagcgcccggagcagcgccagctcctggagcgaggagcctgtgcagagcaacatggacatcagcacaggccacatgatcctgagctacatggaggaccacctgaagaacaagaaccggctggagaaggagtgggaggccctgtgtgcctaccaggccgagcccaacagcagctttgtggcccagcgggaggagaatgtgcccaagaacagaagcctggccgtgctgacctatgaccacagccgggtgctgctgaaggccgagaacagccacagccacagcgactacatcaatgccagccccatcatggaccatgaccccagaaatcctgcctacatcgccacccagggccccctgcctgccaccgtggccgacttctggcagatggtgtgggagagcggctgtgtggtgattgtgatgctgacccccctggctgaaaatggagtgcggcagtgctaccactactggccagatgagggcagcaacctgtaccacatctatgaggtgaacctggtgtctgagcacatctggtgtgaggacttcctggtgcgctccttctacctgaagaacctgcagaccaatgagaccaggacagtgacccagttccacttcctgtcctggtatgaccggggcgtgcccagcagcagccgcagcctgctggacttccggaggaaggtgaacaagtgctaccggggccgcagctgccccatcatcgtgcactgcagtgatggagctggccgcagcggcacctacgtgctgattgacatggtgctgaacaagatggccaagggggccaaggagattgatattgctgccaccctggagcacctgcgggaccagaggcctggcatggtgcagaccaaggagcagtttgaatttgccctgacagctgtggccgaggaggtgaatgccatcctgaaggccctgccccagtag

SEQ ID NO: 166369 - DNA, 3048 bp, Artificial Sequence
  Description of Artificial Sequence: Synthetic coding sequence
atgggcccccccctgcccctgctgctgctgctgctgctgctgctgcccccccgggtgctgcctgctgcccccagctctgtgccccggggccggcagctgcccggccgcctgggctgcctgctggaggagggcctgtgtggggccagcgaggcctgtgtgaatgatggagtgtttggccgctgccagaaggtgcctgccatggacttctaccgctatgaggtgtcccctgtggccctgcagaggctgcgggtggccctgcagaagctgagcggcaccggcttcacctggcaggatgactacacccagtatgtgatggaccaggagctggccgacctgcccaagacctacctgcggcggcctgaggccagcagccctgcccggcccagcaagcacagcgtgggcagcgagcggcgctacagccgggagggcggggccgccctggccaatgccctgcggcggcacctgcccttcctggaggccctgagccaggccccagccagtgatgtgctggcccggacccacacagcccaggaccggcccccagcagaaggagatgaccgcttcagcgagagcatcctgacctacgtggcccacaccagcgccctgacctacccacctggcagcaggacccagctgcgggaggacctgctgcccaggaccctgggccagctgcagccagatgagctgagccccaaggtggacagcggcgtggacagacaccacctgatggccgccctgagcgcctatgctgcccagaggcccccagcccctcctggagagggcagcctggagccccagtacctgctgcgggcccccagcaggatgccccggcccctgctggccccagctgccccccagaagtggcccagccccctgggggacagcgaggaccccagcagcactggagatggagcccgcatccacaccctgctgaaggacctgcagaggcagcctgctgaggtgcggggcctgagcggcctggagctggatggcatggccgagctgatggccggcctgatgcagggcgtggaccatggagtggcccggggcagccctggccgggccgccctgggggagagcggggagcaggctgatggccccaaggccaccctgcggggggacagcttcccagatgatggagtgcaggatgatgatgaccggctgtaccaggaggtgcaccggctgagcgccaccctgggcggcctgctgcaggaccacggcagccggctgctgcccggggccctgccctttgcccggcccctggacatggagaggaagaagtctgagcaccctgagagcagcctgagcagcgaggaggagacagctggggtggagaatgtgaagagccagacctacagcaaggacctgctgggccagcagccccacagcgagcctggagctgctgccttcggggagctgcagaaccagatgcctggccccagcaaggaggagcagagcctgcctgctggggcccaggaggccctgagtgatggcctgcagctggaggtgcagcccagcgaggaggaggcccggggctacatcgtgacagaccgggaccccctgcggcctgaggagggccgccgcctggtggaggatgtggcccggctgctgcaggtgcccagcagcgcctttgctgatgtggaggtgctgggccctgctgtgaccttcaaggtgtctgccaacgtgcagaatgtgaccacagaagatgtggagaaggccaccgtggacaacaaggacaagctggaggagaccagcggcctgaagatcctgcagacaggagtgggcagcaagagcaagctgaagttcctgcccccccaggccgagcaggaggacagcaccaagttcatcgccctgaccctggtgtccctggcctgcatcctgggcgtgctgctggccagcggcctcatctactgcctgcggcacagcagccagcaccggctgaaggagaagctgagcggcctgggcggggaccccggggctgatgccacagctgcctaccaggagctgtgccggcagaggatggccacccggcccccagacaggcctgagggcccccacaccagccgcatcagctctgtgagcagccagttcagtgatggccccatccccagccccagcgcccggagcagcgccagctcctggagcgaggagcctgtgcagagcaacatggacatcagcacaggccacatgatcctgagctacatggaggaccacctgaagaacaagaaccggctggagaaggagtgggaggccctgtgtgcctaccaggccgagcccaacagcagctttgtggcccagcgggaggagaatgtgcccaagaacagaagcctggccgtgctgacctatgaccacagccgggtgctgctgaaggccgagaacagccacagccacagcgactacatcaatgccagccccatcatggaccatgaccccaggaacccagcctacatcgccacccagggccccctgcctgccaccgtggccgacttctggcagatggtgtgggagagcggctgtgtggtgattgtgatgctgacccccctggccgagaatggagtgcggcagtgctaccactactggccagatgagggcagcaacctgtaccacatctatgaggtgaacctggtgtctgagcacatctggtgtgaggacttcctggtgcgctccttctacctgaagaacctgcagaccaatgagaccaggacagtgacccagttccacttcctgtcctggtatgacagaggagtgcccagcagcagccgcagcctgctggacttccggaggaaggtgaacaagtgctaccggggccgcagctgccccatcatcgtgcactgcagtgatggagctggccgcagcggcacctacgtgctgattgacatggtgctgaacaagatggccaagggggccaaggagattgatattgctgccaccctggagcacctgcgggaccagaggcctggcatggtgcagaccaaggagcagtttgaatttgccctgacagctgtggccgaggaggtgaatgccatcctgaaggccctgccccagtag

SEQ ID NO: 166370 - DNA, 3117 bp, Artificial Sequence
  Description of Artificial Sequence: Synthetic coding sequence
atggctgtggagagcgagtacagcctgctgaggacagaggccagcttccccaccatgaagatgttctgtgtgagccacaccctgccccgggtggaggtgatgtttgtgtctggcccccagacccgggagaggacagagcctgtggacccccgctggcagtgcctggtgcagatgtgggccggctgcctgctggaggagggcctgtgtggggccagcgaggcctgtgtgaatgatggagtgtttggccgctgccagaaggtgcctgccatggacttctaccgctatgaggtgtcccctgtggccctgcagaggctgcgggtggccctgcagaagctgtctggaacaggcttcacctggcaggatgactacacccagtatgtgatggaccaggagctggccgacctgcccaagacctacctgcggcggcctgaggccagcagccctgcccggcccagcaagcacagcgtgggcagcgagcggcgctacagccgggagggcggggccgccctggccaatgccctgcggcggcacctgcccttcctggaggccctgagccaggccccagccagtgatgtgctggcccggacccacacagcccaggaccggcccccagcagaaggagatgaccgcttcagcgagagcatcctgacctacgtggcccacaccagcgccctgacctacccacctggcagcaggacccagctgcgggaggacctgctgcccaggaccctgggccagctgcagccagatgagctgagccccaaggtggacagcggcgtggacagacaccacctgatggccgccctgagcgcctatgctgcccagaggcccccagcccctcctggagagggcagcctggagccccagtacctgctgcgggcccccagcaggatgccccggcccctgctggccccagctgccccccagaagtggcccagccccctgggggacagcgaggaccccagcagcactggagatggagcccgcatccacaccctgctgaaggacctgcagaggcagcctgctgaggtgcggggcctgagcggcctggagctggatggcatggccgagctgatggccggcctgatgcagggcgtggaccacggcgtggcccggggcagccctggccgggccgccctgggggagagcggggagcaggctgatggccccaaggccaccctgcggggggacagcttcccagatgatggagtgcaggatgatgatgaccggctgtaccaggaggtgcaccggctgagcgccaccctgggcggcctgctgcaggaccacggcagccggctgctgcccggggccctgccctttgcccggcccctggacatggagaggaagaagtctgagcaccctgagagcagcctgagcagcgaggaggagacagctggggtggagaatgtgaagagccagacctacagcaaggacctgctgggccagcagccccacagcgagcccggggctgctgcctttggagagctgcagaaccagatgcctggccccagcaaggaggagcagagcctgcctgctggggcccaggaggccctgagtgatggcctgcagctggaggtgcagcccagcgaggaggaggcccggggctacatcgtgacagaccgggaccccctgcggcctgaggagggccggcggctggtggaggatgtggcccggctgctgcaggtgcccagcagcgcctttgctgatgtggaggtgctgggccctgctgtgaccttcaaggtgtctgccaacgtgcagaatgtgaccacagaagatgtggagaaggccaccgtggacaacaaggacaagctggaggagaccagcggcctgaagatcctgcagacaggagtgggcagcaagagcaagctgaagttcctgcccccccaggccgagcaggaggacagcaccaagttcatcgccctgaccctggtgtccctggcctgcatcctgggcgtgctgctggccagcggcctcatctactgcctgcggcacagcagccagcaccggctgaaggagaagctgagcggcctgggcggggaccctggagcagatgccacagctgcctaccaggagctgtgccggcagaggatggccacccggcccccagacaggcctgagggcccccacaccagccgcatcagctctgtgagcagccagttcagtgatggccccatccccagccccagcgcccggagcagcgccagctcctggagcgaggagcctgtgcagagcaacatggacatcagcacaggccacatgatcctgagctacatggaggaccacctgaagaacaagaaccggctggagaaggagtgggaggccctgtgtgcctaccaggccgagcccaacagcagctttgtggcccagcgggaggagaatgtgcccaagaacagaagcctggccgtgctgacctatgaccacagccgggtgctgctgaaggccgagaacagccacagccacagcgactacatcaatgccagccccatcatggaccatgaccccagaaatcctgcctacatcgccacccagggccccctgcctgccaccgtggccgacttctggcagatggtgtgggagagcggctgtgtggtgattgtgatgctgacccccctggctgaaaatggagtgcggcagtgctaccactactggccagatgagggcagcaacctgtaccacatctatgaggtgaacctggtgtctgagcacatctggtgtgaggacttcctggtgcgctccttctacctgaagaacctgcagaccaatgagaccaggacagtgacccagttccacttcctgtcctggtatgaccggggcgtgcccagcagcagccgcagcctgctggacttccggaggaaggtgaacaagtgctaccggggccgcagctgccccatcatcgtgcactgcagtgatggagctggccgcagcggcacctacgtgctgattgacatggtgctgaacaagatggccaagggggccaaggagattgatattgctgccaccctggagcacctgcgggaccagaggcctggcatggtgcagaccaaggagcagtttgaatttgccctgacagctgtggccgaggaggtgaatgccatcctgaaggccctgccccagtag

SEQ ID NO: 166371 - DNA, 2934 bp, Artificial Sequence
  Description of Artificial Sequence: Synthetic coding sequence
atgggcccccccctgcccctgctgctgctgctgctgctgctgctgcccccccgggtgctgcctgctgcccccagctctgtgccccggggccggcagctgcccggccgcctgggctgcctgctggaggagggcctgtgtggggccagcgaggcctgtgtgaatggcttcacctggcaggatgactacacccagtatgtgatggaccaggagctggccgacctgcccaagacctacctgcggcggcctgaggccagcagccctgcccggcccagcaagcacagcgtgggcagcgagcggcgctacagccgggagggcggggccgccctggccaatgccctgcggcggcacctgcccttcctggaggccctgagccaggccccagccagtgatgtgctggcccggacccacacagcccaggaccggcccccagcagaaggagatgaccgcttcagcgagagcatcctgacctacgtggcccacaccagcgccctgacctacccacctggcagcaggacccagctgcgggaggacctgctgcccaggaccctgggccagctgcagccagatgagctgagccccaaggtggacagcggcgtggacagacaccacctgatggccgccctgagcgcctatgctgcccagaggcccccagcccctcctggagagggcagcctggagccccagtacctgctgcgggcccccagcaggatgccccggcccctgctggccccagctgccccccagaagtggcccagccccctgggggacagcgaggaccccagcagcactggagatggagcccgcatccacaccctgctgaaggacctgcagaggcagcctgctgaggtgcggggcctgagcggcctggagctggatggcatggccgagctgatggccggcctgatgcagggcgtggaccatggagtggcccggggcagccctggccgggccgccctgggggagagcggggagcaggctgatggccccaaggccaccctgcggggggacagcttcccagatgatggagtgcaggatgatgatgaccggctgtaccaggaggtgcaccggctgagcgccaccctgggcggcctgctgcaggaccacggcagccggctgctgcccggggccctgccctttgcccggcccctggacatggagaggaagaagtctgagcaccctgagagcagcctgagcagcgaggaggagacagctggggtggagaatgtgaagagccagacctacagcaaggacctgctgggccagcagccccacagcgagcctggagctgctgccttcggggagctgcagaaccagatgcctggccccagcaaggaggagcagagcctgcctgctggggcccaggaggccctgagtgatggcctgcagctggaggtgcagcccagcgaggaggaggcccggggctacatcgtgacagaccgggaccccctgcggcctgaggagggccgccgcctggtggaggatgtggcccggctgctgcaggtgcccagcagcgcctttgctgatgtggaggtgctgggccctgctgtgaccttcaaggtgtctgccaacgtgcagaatgtgaccacagaagatgtggagaaggccaccgtggacaacaaggacaagctggaggagaccagcggcctgaagatcctgcagacaggagtgggcagcaagagcaagctgaagttcctgcccccccaggccgagcaggaggacagcaccaagttcatcgccctgaccctggtgtccctggcctgcatcctgggcgtgctgctggccagcggcctcatctactgcctgcggcacagcagccagcaccggctgaaggagaagctgagcggcctgggcggggaccccggggctgatgccacagctgcctaccaggagctgtgccggcagaggatggccacccggcccccagacaggcctgagggcccccacaccagccgcatcagctctgtgagcagccagttcagtgatggccccatccccagccccagcgcccggagcagcgccagctcctggagcgaggagcctgtgcagagcaacatggacatcagcacaggccacatgatcctgagctacatggaggaccacctgaagaacaagaaccggctggagaaggagtgggaggccctgtgtgcctaccaggccgagcccaacagcagctttgtggcccagcgggaggagaatgtgcccaagaacagaagcctggccgtgctgacctatgaccacagccgggtgctgctgaaggccgagaacagccacagccacagcgactacatcaatgccagccccatcatggaccatgaccccaggaacccagcctacatcgccacccagggccccctgcctgccaccgtggccgacttctggcagatggtgtgggagagcggctgtgtggtgattgtgatgctgacccccctggccgagaatggagtgcggcagtgctaccactactggccagatgagggcagcaacctgtaccacatctatgaggtgaacctggtgtctgagcacatctggtgtgaggacttcctggtgcgctccttctacctgaagaacctgcagaccaatgagaccaggacagtgacccagttccacttcctgtcctggtatgacagaggagtgcccagcagcagccgcagcctgctggacttccggaggaaggtgaacaagtgctaccggggccgcagctgccccatcatcgtgcactgcagtgatggagctggccgcagcggcacctacgtgctgattgacatggtgctgaacaagatggccaagggggccaaggagattgatattgctgccaccctggagcacctgcgggaccagaggcctggcatggtgcagaccaaggagcagtttgaatttgccctgacagctgtggccgaggaggtgaatgccatcctgaaggccctgccccagtag

SEQ ID NO: 166372 - DNA, 3651 bp, Artificial Sequence
  Description of Artificial Sequence: Synthetic coding sequence
atgggccacctgcccaccggcatccatggagcccggcggctgctgcccctgctgtggctgtttgtgctcttcaagaatgccacagccttccacgtgacagtgcaggatgacaacaacatcgtggtgtccctggaggccagtgatgtgatcagccctgcctctgtgtatgtggtgaagatcactggagagagcaagaactacttctttgaatttgaggagttcaacagcaccctgcccccacctgtgatcttcaaggccagctaccacggcctgtactacatcatcaccctggtggtggtgaatggaaatgtggtgaccaagcccagccgcagcatcaccgtgctgaccaagcccctgcctgtgacctctgtgtccatctatgactacaagcccagccctgagactggagtgctgtttgagatccactacccagagaagtacaacgtgttcaccagggtgaacatctcctactgggagggcaaggacttccgcaccatgctgtacaaggacttcttcaagggcaagacagtgttcaaccactggctgcccggcatgtgctacagcaacatcaccttccagctggtgtctgaggccaccttcaacaagagcaccctggtggagtacagcggcgtgtcccatgagcccaagcagcacaggacagccccctacccaccccagaacatctctgtgcgcatcgtgaacctgaacaagaacaactgggaggagcagagcggcaacttccctgaggagagcttcatgaggagccaggacaccatcggcaaggagaagctgttccacttcacagaggagaccccagagatccccagcggcaacatcagcagcggctggccagacttcaacagcagtgactatgagaccaccagccagccctactggtgggacagcgccagcgctgcccctgagagtgaagatgaatttgtgtctgtgctgcccatggagtatgagaacaacagcaccctgtctgaaacagagaagagcaccagcggcagcttctccttcttccctgtgcagatgatcctgacctggctgccccccaagccacccacagcctttgatggcttccacatccacatcgagcgggaggagaacttcacagagtacctgatggtggatgaggaggcccacgagtttgtggccgagctgaaggagcccgggaagtacaagctgtctgtgaccaccttcagcagcagcggcagctgtgagaccaggaagagccagagcgccaagagcctgtccttctacatcagccccagcggggagtggattgaggagctgacagagaagccccagcacgtgtctgtgcacgtgctgagcagcaccacagccctgatgtcctggaccagcagccaggagaactacaacagcaccatcgtgtctgtggtgtccctgacctgccagaagcagaaggagagccagaggctggagaagcagtactgcacccaggtgaacagcagcaagcccatcatcgagaacctggtgcctggggcccagtaccaggtggtgatctacctgaggaagggccccctgattggccccccaagtgaccctgtgacctttgccatcgtgcccaccggcatcaaggacctgatgctgtaccccctgggccccacagctgtggtgctgtcctggacccggccctacctgggcgtcttcagaaaatatgtggtggagatgttctacttcaacccagccaccatgaccagcgagtggaccacctactatgaaattgctgccaccgtgtccctgacagcctctgtgagaattgccaacctgctgcctgcctggtactacaacttccgggtgaccatggtgacctggggagaccctgagctgagctgctgtgacagcagcaccatctccttcatcacagcccctgtggcccctgagatcacctctgtggagtacttcaacagcctgctgtacatctcctggacctatggagatgacaccacagacctgagccacagcaggatgctgcactggatggtggtggccgagggcaagaagaagatcaagaagtctgtgaccagaaatgtgatgacagccatcctgagcctgcccccaggggacatctacaacctgtctgtgacagcctgcacagagcggggcagcaacacctccatgctgcggctggtgaagctggagcccgccccacccaagagcctgtttgctgtgaacaagacccagacctctgtgaccctgctgtgggtggaggagggcgtggccgacttctttgaggtgttctgccagcaggtgggcagcagccagaagaccaagctgcaggagcctgtggccgtgagcagccacgtggtgaccatcagcagcctgctgcctgccacagcctacaactgcagcgtgaccagcttcagccatgacagccccagcgtgcccaccttcatcgctgtgtccaccatggtgacagagatgaaccccaacgtggtggtgatctctgtgctggccatcctgagcaccctgctgattggcctgctgctggtgaccctcatcatcctgaggaagaagcacctgcagatggcccgggagtgtggggccggcacctttgtgaactttgccagcctggagagagatggcaagctgccctacaactggaggaggagcatctttgccttcctgaccctgctgcccagctgcctgtggacagactacctgctggccttctacatcaacccctggagcaagaatggcctgaagaagaggaagctgaccaaccctgtgcagctggatgactttgatgcctacatcaaggacatggccaaggacagcgactacaagttcagcctgcagtttgaggagctgaagctgattggcctggacatcccccactttgctgctgacctgcccctgaaccgctgcaagaaccgctacaccaacatcctgccctatgacttcagccgggtgcggctggtgtccatgaatgaggaggagggcgctgactacatcaatgccaactacatccctggctacaacagcccccaggagtacatcgccacccagggccccctgcctgagaccagaaatgacttctggaagatggtgctgcagcagaagagccagatcatcgtgatgctgacccagtgcaatgagaagagaagagtgaagtgtgaccactactggcccttcacagaggagcccatcgcctacggggacatcaccgtggagatgatcagcgaggaggagcaggatgactgggcctgccgccacttccgcatcaactatgcagatgagatgcaggatgtgatgcacttcaactacacagcctggccagaccatggagtgcccacagccaatgctgctgagagcatcctgcagtttgtgcacatggtgcggcagcaggccaccaagagcaagggccccatgatcatccactgcagcgctggggtgggccgcacaggcaccttcatcgccctggaccggctgctgcagcacatccgggaccatgaatttgtggacatcctgggcctggtgtctgagatgaggagctacaggatgtccatggtgcagacagaggagcagtacatcttcatccaccagtgtgtgcagctgatgtggatgaagaagaagcagcagttctgcatcagtgatgtgatctatgaaaatgtgtccaagagctag

SEQ ID NO: 166373 - DNA, 3567 bp, Artificial Sequence
  Description of Artificial Sequence: Synthetic coding sequence
atgggccacctgcccaccggcatccatggagcccggcggctgctgcccctgctgtggctgtttgtgctcttcaagaatgccacagccttccacgtgacagtgcaggatgacaacaacatcgtggtgtccctggaggccagtgatgtgatcagccctgcctctgtgtatgtggtgaagatcactggagagagcaagaactacttctttgaatttgaggagttcaacagcaccctgcccccacctgtgatcttcaaggccagctaccacggcctgtactacatcatcaccctggtggtggtgaatggaaatgtggtgaccaagcccagccgcagcatcaccgtgctgaccaagcccctgcctgtgacctctgtgtccatctatgactacaagcccagccctgagactggagtgctgtttgagatccactacccagagaagtacaacgtgttcaccagggtgaacatctcctactgggagggcaaggacttccgcaccatgctgtacaaggacttcttcaagggcaagacagtgttcaaccactggctgcccggcatgtgctacagcaacatcaccttccagctggtgtctgaggccaccttcaacaagagcaccctggtggagtacagcggcgtgtcccatgagcccaagcagcacaggacagccccctacccaccccagaacatctctgtgcgcatcgtgaacctgaacaagaacaactgggaggagcagagcggcaacttccctgaggagagcttcatgaggagccaggacaccatcggcaaggagaagctgttccacttcacagaggagaccccagagatccccagcggcaacatcagcagcggctggccagacttcaacagcagtgactatgagaccaccagccagccctactggtgggacagcgccagcgctgcccctgagagtgaagatgaatttgtgtctgtgctgcccatggagtatgagaacaacagcaccctgtctgaaacagagaagagcaccagcggcagcttctccttcttccctgtgcagatgatcctgacctggctgccccccaagccacccacagcctttgatggcttccacatccacatcgagcgggaggagaacttcacagagtacctgatggtggatgaggaggcccacgagtttgtggccgagctgaaggagcccgggaagtacaagctgtctgtgaccaccttcagcagcagcggcagctgtgagaccaggaagagccagagcgccaagagcctgtccttctacatcagccccagcggggagtggattgaggagctgacagagaagccccagcacgtgtctgtgcacgtgctgagcagcaccacagccctgatgtcctggaccagcagccaggagaactacaacagcaccatcgtgtctgtggtgtccctgacctgccagaagcagaaggagagccagaggctggagaagcagtactgcacccaggtgaacagcagcaagcccatcatcgagaacctggtgcctggggcccagtaccaggtggtgatctacctgaggaagggccccctgattggccccccaagtgaccctgtgacctttgccatcgtgcccaccggcatcaaggacctgatgctgtaccccctgggccccacagctgtggtgctgtcctggacccggccctacctgggcgtcttcagaaaatatgtggtggagatgttctacttcaacccagccaccatgaccagcgagtggaccacctactatgaaattgctgccaccgtgtccctgacagcctctgtgagaattgccaacctgctgcctgcctggtactacaacttccgggtgaccatggtgacctggggagaccctgagctgagctgctgtgacagcagcaccatctccttcatcacagcccctgtggcccctgagatcacctctgtggagtacttcaacagcctgctgtacatctcctggacctatggagatgacaccacagacctgagccacagcaggatgctgcactggatggtggtggccgagggcaagaagaagatcaagaagtctgtgaccagaaatgtgatgacagccatcctgagcctgcccccaggggacatctacaacctgtctgtgacagcctgcacagagcggggcagcaacacctccatgctgcggctggtgaagctggagcccgccccacccaagagcctgtttgctgtgaacaagacccagacctctgtgaccctgctgtgggtggaggagggcgtggccgacttctttgaggtgttctgccagcaggtgggcagcagccagaagaccaagctgcaggagcctgtggccgtgagcagccacgtggtgaccatcagcagcctgctgcctgccacagcctacaactgcagcgtgaccagcttcagccatgacagccccagcgtgcccaccttcatcgctgtgtccaccatggtgacagagatgaaccccaacgtggtggtgatctctgtgctggccatcctgagcaccctgctgattggcctgctgctggtgaccctcatcatcctgaggaagaagcacctgcagatggcccgggagtgtggggccggcacctttgtgaactttgccagcctggagagagatggcaagctgccctacaactggagcaagaatggcctgaagaagaggaagctgaccaaccctgtgcagctggatgactttgatgcctacatcaaggacatggccaaggacagcgactacaagttcagcctgcagtttgaggagctgaagctgattggcctggacatcccccactttgctgctgacctgcccctgaaccgctgcaagaaccgctacaccaacatcctgccctatgacttcagccgggtgcggctggtgtccatgaatgaggaggagggcgctgactacatcaatgccaactacatccctggctacaacagcccccaggagtacatcgccacccagggccccctgcctgagaccagaaatgacttctggaagatggtgctgcagcagaagagccagatcatcgtgatgctgacccagtgcaatgagaagagaagagtgaagtgtgaccactactggcccttcacagaggagcccatcgcctacggggacatcaccgtggagatgatcagcgaggaggagcaggatgactgggcctgccgccacttccgcatcaactatgcagatgagatgcaggatgtgatgcacttcaactacacagcctggccagaccatggagtgcccacagccaatgctgctgagagcatcctgcagtttgtgcacatggtgcggcagcaggccaccaagagcaagggccccatgatcatccactgcagcgctggggtgggccgcacaggcaccttcatcgccctggaccggctgctgcagcacatccgggaccatgaatttgtggacatcctgggcctggtgtctgagatgaggagctacaggatgtccatggtgcagacagaggagcagtacatcttcatccaccagtgtgtgcagctgatgtggatgaagaagaagcagcagttctgcatcagtgatgtgatctatgaaaatgtgtccaagagctag

SEQ ID NO: 166374 - DNA, 1218 bp, Artificial Sequence
  Description of Artificial Sequence: Synthetic coding sequence
atggtgacagagatgaaccccaacgtggtggtgatctctgtgctggccatcctgagcaccctgctgattggcctgctgctggtgaccctcatcatcctgaggaagaagcacctgcagatggccagagaatgtggggccggcacctttgtgaactttgccagcctggagagagatggcaagctgccctacaactggaggaggagcatctttgccttcctgaccctgctgcccagctgcctgtggacagactacctgctggccttctacatcaacccctggagcaagaatggcctgaagaagaggaagctgaccaaccctgtgcagctggatgactttgatgcctacatcaaggacatggccaaggacagcgactacaagttcagcctgcagtttgaggagctgaagctgattggcctggacatcccccactttgctgctgacctgcccctgaaccgctgcaagaaccgctacaccaacatcctgccctatgacttcagccgggtgcggctggtgtccatgaatgaggaggagggcgctgactacatcaatgccaactacatccctggctacaacagcccccaggagtacatcgccacccagggccccctgcctgagaccagaaatgacttctggaagatggtgctgcagcagaagagccagatcatcgtgatgctgacccagtgcaatgagaagagaagagtgaagtgtgaccactactggcccttcacagaggagcccatcgcctatggagacatcaccgtggagatgatcagcgaggaggagcaggatgactgggcctgccgccacttccgcatcaactatgcagatgagatgcaggatgtgatgcacttcaactacacagcctggccagaccacggcgtgcccacagccaatgctgctgagagcatcctgcagtttgtgcacatggtgcggcagcaggccaccaagagcaagggccccatgatcatccactgcagcgctggggtgggccgcacaggcaccttcatcgccctggaccggctgctgcagcacatccgggaccacgagtttgtggacatcctgggcctggtgtctgagatgaggagctacaggatgtccatggtgcagacagaggagcagtacatcttcatccaccagtgtgtgcagctgatgtggatgaagaagaagcagcagttctgcatcagtgatgtgatctatgaaaatgtgtccaagagctag

SEQ ID NO: 166375 - DNA, 1218 bp, Artificial Sequence; identical to SEQ ID NO: 166374
  Description of Artificial Sequence: Synthetic coding sequence

SEQ ID NO: 166376 - DNA, 1134 bp, Artificial Sequence
  Description of Artificial Sequence: Synthetic coding sequence
atggtgacagagatgaaccccaacgtggtggtgatctctgtgctggccatcctgagcaccctgctgattggcctgctgctggtgaccctcatcatcctgaggaagaagcacctgcagatggccagagaatgtggggccggcacctttgtgaactttgccagcctggagagagatggcaagctgccctacaactggagcaagaatggcctgaagaagaggaagctgaccaaccctgtgcagctggatgactttgatgcctacatcaaggacatggccaaggacagcgactacaagttcagcctgcagtttgaggagctgaagctgattggcctggacatcccccactttgctgctgacctgcccctgaaccgctgcaagaaccgctacaccaacatcctgccctatgacttcagccgggtgcggctggtgtccatgaatgaggaggagggcgctgactacatcaatgccaactacatccctggctacaacagcccccaggagtacatcgccacccagggccccctgcctgagaccagaaatgacttctggaagatggtgctgcagcagaagagccagatcatcgtgatgctgacccagtgcaatgagaagagaagagtgaagtgtgaccactactggcccttcacagaggagcccatcgcctatggagacatcaccgtggagatgatcagcgaggaggagcaggatgactgggcctgccgccacttccgcatcaactatgcagatgagatgcaggatgtgatgcacttcaactacacagcctggccagaccacggcgtgcccacagccaatgctgctgagagcatcctgcagtttgtgcacatggtgcggcagcaggccaccaagagcaagggccccatgatcatccactgcagcgctggggtgggccgcacaggcaccttcatcgccctggaccggctgctgcagcacatccgggaccacgagtttgtggacatcctgggcctggtgtctgagatgaggagctacaggatgtccatggtgcagacagaggagcagtacatcttcatccaccagtgtgtgcagctgatgtggatgaagaagaagcagcagttctgcatcagtgatgtgatctatgaaaatgtgtccaagagctag

SEQ ID NO: 166377 - DNA, 1134 bp, Artificial Sequence; identical to SEQ ID NO: 166376
  Description of Artificial Sequence: Synthetic coding sequence

SEQ ID NO: 166378 - DNA, 6888 bp, Artificial Sequence
  Description of Artificial Sequence: Synthetic coding sequence
atggacttcctgatcatcttcctgctgctcttcatcggcaccagcgagacccaggtggatgtgtccaatgtggtgcccggcaccaggtatgacatcaccatcagcagcatcagcaccacctacaccagccctgtgacccgcatcgtgaccaccaacgtgaccaagccaggcccccctgtgttcctggccggggagcgggtgggcagcgctggcatcctgctgtcctggaacaccccacccaaccccaacggccgcatcatctcctacatcgtgaagtacaaggaggtgtgcccctggatgcagacagtgtacacccaggtgcgcagcaagccagacagcctggaggtgctgctgaccaacctgaaccctggcaccacctatgagatcaaggtgatcatcctgaatgccaccaaggtgggctgcctgctgagccccatcctgctgaacacagtgctggagggcctggcccgggccatcaacctgacccgggagtgccagacagtggatgctggccagtgtgtgcagtgtgctgtgcgggagcccaagcagggcagcaccagcggcggccgggcccagaccaacaagaagacagctgtgaccagcgctgacctgaaccacacagctggggacctgaggacaggccgcctgcccccccagcccctgacagctgagcagcccaactgggaggccccacccagccggggccgcctgaccccccacaaggccggctacagcagcgccacagctgctggcacccaggccaacagagtgtggagccggcccctggccaagatccagaccaccatccgggagtactacaagcacctgtatgccaagaaggagggcatcctgcccaacagcttctatgaggccagcatcatcctgatccccaagcctgtgcctgagggccccccccagaactgtgtgacaggcaacatcaccgggaagagcttcagcatcctgtgggacccccccaccatcgtgacaggcaagttctcctacagagtggagctgtatggccccagcggccgcatcctggacaacagcaccaaggacctgaagtttgccttcaccaacctgacccccttcaccatgtatgatgtgtacatcgctgctgagaccagcgctggcaccggccccaagagcaacatctctgtgttcaccccaccagatgtgcctggagctgtgtttgacctgcagctggccgaggtggagagcacccaggtgcgcatcacctggaagaagccccggcagcccaacggcatcatcaaccagtacagagtgaaggtgctggtgcctgagaccggcatcatcctggagaacaccctgctgactggaaataatgagtacatcaatgaccccatggcccctgagatcgtgaacatcgtggagcccatggtgggcctgtatgagggcagcgctgagatgagcagtgacctgcacagcctggccaccttcatctacaacagccacccagacaagaacttccctgccaggaacagagctgaggaccagaccagccctgtggtgaccaccaggaaccagtacatcacagacattgctgctgagcagctgtcctatgtgatccggcggctggtgcccttcacagagcacatgatctctgtgtctgccttcaccatcatgggagagggcccccccaccgtgctgtctgtgaggacccggcagcaggtgcccagcagcatcaagatcatcaactacaagaacatcagcagcagcagcatcctgctgtactgggaccccccagagtaccccaacgggaagatcacccactacaccatctatgccatggagctggacaccaacagagccttccagatcaccaccatcgacaacagcttcctgatcaccggcctgaagaagtacaccaagtacaagatgagggtggccgccagcacccacgtgggggagagcagcctgtctgaagaaaatgacatctttgtgaggaccagtgaagatgagcctgagagcagcccccaggatgtggaggtgattgatgtgacagcagatgagatccggctgaagtggagccccccagagaagcccaacggcatcatcatcgcctatgaggtgctgtacaagaacatcgacaccctgtacatgaagaacaccagcaccacagacatcatcctgaggaacctgcggccccacaccctgtacaacatctctgtgcgcagctacacccgcttcggccacggcaaccaggtgagcagcctgctgtctgtgaggaccagcgagaccgtgcctgattctgcccctgagaacatcacctacaagaacatcagcagtggagaaattgagctgtccttcctgccccccagcagccccaacggcatcatccagaagtacaccatctacctgaagaggagcaatggaaatgaggagaggaccatcaacaccaccagcctgacccagaacatcaaggtgctgaagaagtacacccagtacatcatcgaggtgtctgccagcaccctgaagggggagggcgtgcgcagcgcccccatcagcatcctgacagaagaagatgccccagacagccccccccaggacttctctgtgaagcagctgtctggagtgacagtgaagctgtcctggcagccccccctggagcccaacggcatcatcctgtactacacagtgtatgtgtggaacagaagcagcctgaagaccatcaacgtgacagagaccagcctggagctgagtgacctggactacaacgtggagtacagcgcctacgtgacagccagcaccaggtttggagatggcaagaccaggagcaacatcatctccttccagaccccagagggcgcccccagcgacccccccaaggatgtgtactatgccaacctgagcagcagcagcatcatcctcttctggaccccacccagcaagcccaacggcatcatccagtactacagcgtgtactacagaaacaccagcggcaccttcatgcagaacttcaccctgcacgaggtgaccaatgactttgacaacatgacagtgtccaccatcatcgacaagctgaccatcttctcctactacaccttctggctgacagccagcacctctgtgggcaatggaaacaagagcagtgacatcatcgaggtgtacacagaccaggacatccctgagggctttgtgggcaacctgacctatgagagcatcagcagcacagccatcaacgtgtcctgggtgcccccagcccagcccaacggcctggtgttctactacgtgtccctcatcctgcagcagacccccaggcatgtgcggccccccctggtgacctatgaaagaagcatctactttgacaacctggagaagtacacagactacatcctgaagatcacccccagcacagagaagggcttcagtgacacctacacagcccagctgtacatcaagacagaagaagatgtgcctgagaccagccccatcatcaacaccttcaagaacctgagcagcacctctgtgctgctgtcctgggacccccctgtgaagcccaacggggccatcatctcctatgacctgaccctgcagggccccaatgaaaactacagcttcatcaccagtgacaactacatcatcctggaggagctgagccccttcaccctgtacagcttctttgctgctgcccggaccaggaagggcctgggccccagcagcatcctcttcttctacacagatgagagcgtgcccctggccccaccccagaacctgaccctcatcaactgcaccagtgactttgtgtggctgaagtggagccccagccccctgcccggcggcatcgtgaaggtgtacagcttcaagatccatgaacatgaaacagacaccatctactacaagaacatcagcggcttcaagacagaggccaagctggtgggcctggagcctgtgtccacctacagcatccgggtgtctgccttcaccaaggtgggcaatggaaaccagttcagcaatgtggtgaagttcaccacccaggagagcgtgcctgatgtggtgcagaacatgcagtgcatggccacctcctggcagagcgtgctggtgaagtgggacccccccaagaaggccaacggcatcatcacccagtacatggtgacagtggagaggaacagcaccaaggtgagcccccaggaccacatgtacaccttcatcaagctgctggccaacaccagctatgtgttcaaggtgcgggccagcaccagcgctggggagggagatgagagcacctgccacgtgtccaccctgcctgagaccgtgcccagcgtgcccaccaacatcgccttcagtgatgtgcagagcaccagcgccaccctgacctggatccggccagacaccatcctgggctacttccagaactacaagatcaccacccagctgcgggcccagaagtgcaaggagtgggagagtgaagaatgtgtggagtaccagaagatccagtacctgtatgaggcccacctgacagaggagaccgtgtatggcctgaagaagttccgctggtaccgcttccaggtggccgccagcaccaatgccggctatggaaatgccagcaactggatcagcaccaagaccctgcccggccccccagatggccccccagaaaatgtgcacgtggtggccaccagccccttcagcatcagcatctcctggagcgagcctgctgtgatcaccggccccacctgctacctgattgatgtgaagtctgtggacaatgatgagttcaacatctccttcatcaagagcaatgaggagaacaagaccatcgagatcaaggacctggagatcttcacccgctacagcgtggtgatcacagccttcaccggcaacatctctgctgcctacgtggagggcaagagcagcgctgagatgattgtgaccaccctggagagcgcccccaaggacccccccaacaacatgaccttccagaagatcccagatgaggtgaccaagttccagctgaccttcctgccccccagccagcccaatggaaacatccaggtgtaccaggccctggtgtaccgggaggatgaccccacagctgtgcagatccacaacctgagcatcatccagaagaccaacaccttcgtcatcgccatgctggagggcctgaagggcggccacacctacaacatctctgtgtatgctgtgaacagcgctggggccggccccaaggtgcccatgaggatcaccatggacatcaaggccccagcccggcccaagaccaagcccacccccatctatgatgccaccgggaagctgctggtgaccagcaccaccatcaccatccgcatgcccatctgctactacagtgatgaccacggccccatcaagaatgtgcaggtgctggtgacagaaacaggagcccagcatgatggaaatgtgaccaagtggtatgatgcctacttcaacaaggcccggccctacttcaccaatgaaggcttccccaaccccccctgcacagagggcaagaccaagttctctggaaatgaggagatctacatcatcggggctgacaatgcctgcatgatccctggaaatgaagacaagatctgcaatggccccctgaagcccaagaagcagtacctgttcaagttccgggccaccaacatcatgggccagttcacagacagcgactacagcgaccctgtgaagaccctgggggagggcctgtctgagaggacagtggagatcatcctgtctgtgaccctgtgcatcctgagcatcatcctgctgggcacagccatctttgcctttgcccgcatccggcagaagcagaaggagggcggcacctacagcccccaggatgctgagatcatcgacaccaagctgaagctggaccagctgatcaccgtggccgacctggagctgaaggatgagcggctgacccggctgctgagctacaggaagagcatcaagcccatcagcaagaagagcttcctgcagcacgtggaggagctgtgcaccaacaacaacctgaagttccaggaggagttcagcgagctgcccaagttcctgcaggacctgagcagcacagatgctgacctgccctggaacagagccaagaaccgcttccccaacatcaagccctacaacaacaacagagtgaagctgattgctgatgcctctgtgcccggcagtgactacatcaatgccagctacatcagcggctacctgtgccccaatgagttcatcgccacccagggccccctgcccggcaccgtgggggacttctggaggatggtgtgggagacccgggccaagaccctggtgatgctgacccagtgctttgagaagggccgcatccgctgccaccagtactggccagaggacaacaagcctgtgacagtgtttggagacatcgtcatcaccaagctgatggaggatgtgcagattgactggaccatccgggacctgaagattgagcggcacggggactgcatgacagtgcggcagtgcaacttcaccgcctggccagagcacggcgtgcctgaaaattctgcccccctcatccactttgtgaagctggtgcgggccagccgggcccatgacaccacccccatgattgtgcactgcagcgctggggtgggccgcactggagtcttcatcgccctggaccacctgacccagcacatcaatgaccatgactttgtggacatctacggcctggtggccgagctgcggtctgagaggatgtgcatggtgcagaacctggcccagtacatcttcctgcaccagtgcatcctggacctgctgagcaacaagggcagcaaccagcccatctgctttgtgaactacagcgccctgcagaagatggacagcctggatgccatggagggagatgtggagctggagtgggaggagaccaccatgtag

SEQ ID NO: 166379 - DNA, 5787 bp, Artificial Sequence
  Description of Artificial Sequence: Synthetic coding sequence
atggcccccacctggggccctggcatggtgtctgtggtgggccccatgggcctgctggtggtgctgctggtgggcggctgtgccgctgaggagcccccacgcttcatcaaggagcccaaggaccagattggagtgtctgggggcgtggccagctttgtgtgccaggccactggagaccccaagccccgggtgacctggaacaagaagggcaagaaggtgaacagccagagatttgagaccattgaatttgatgagagcgctggagctgtgctgcgcatccagcccctgcggaccccaagagatgaaaatgtgtatgaatgtgtggcccagaacagcgtgggggagatcaccgtgcacgccaagctgactgtgctgcgggaggaccagctgcccagcggcttccccaacatcgacatgggcccccagctgaaggtggtggagaggaccaggacagccaccatgctgtgtgccgccagcggcaacccagaccctgagatcacctggttcaaggacttcctgcctgtggaccccagcgccagcaatggccgcatcaagcagctgcggagtgaccaggccttcagccacctgcccaccggggccctgcagatcgagagcagcgaggagacagaccagggcaagtatgaatgtgtggccaccaacagcgctggggtgcgctacagcagccctgccaacctgtatgtgcgggtgagaagagtggccccccgcttcagcatcctgcccatgagccatgagatcatgcctggaggaaatgtgaacatcacctgtgtggccgtgggcagccccatgccctacgtgaagtggatgcagggcgctgaggacctgaccccagaagatgacatgcctgtgggcagaaatgtgctggagctgacagatgtgaaggacagcgccaactacacctgtgtggccatgagcagcctgggcgtcatcgaggccgtggcccagatcaccgtgaagagcctgcccaaggcccctggcacccccatggtgacagagaacacagccaccagcatcaccatcacctgggacagcggcaacccagaccctgtgtcctactacgtgattgagtacaagagcaagagccaggacggcccctaccagatcaaggaggacatcaccaccacccgctacagcattggaggcctgagccccaacagtgaatatgagatctgggtgtctgctgtgaacagcatcggccagggcccccccagcgagagcgtggtgaccaggactggagagcaggccccagccagcgcccccagaaatgtgcaggccaggatgctgagcgccaccaccatgattgtgcagtgggaggagcctgtggagcccaacggcctcatccggggctacagagtgtactacaccatggagcctgagcaccctgtgggcaactggcagaagcacaacgtggatgacagcctgctgaccaccgtgggcagcctgctggaggatgagacctacacagtgcgggtgctggccttcacctctgtgggagatggccccctgagtgaccccatccaggtgaagacccagcagggcgtgcccggccagcccatgaacctgcgggcagaggcccggtctgagaccagcatcaccctgtcctggagccccccccggcaggagagcatcatcaagtatgagctgctcttccgggagggggaccacggccgggaggtgggccgcacctttgaccccaccaccagctatgtggtggaggacctgaagcccaacacagaatatgccttccggctggccgcccggagcccccagggcctgggcgccttcacccctgtggtgcggcagaggaccctgcagagcaagcccagcgccccaccccaggatgtgaagtgtgtgtctgtgcgcagcacagccatcctggtgtcctggaggcctcctcctcctgagacccacaacggggccctggtgggctacagcgtgcgctaccggcccctgggcagcgaggaccctgagcccaaggaggtgaatggcatcccccccaccaccacccagatcctgctggaggccctggagaagtggacccagtaccgcatcaccaccgtggcccacacagaggtgggccctggccctgagagcagccctgtggtggtgaggacagatgaagatgtgcccagcgccccacccaggaaggtggaggccgaggccctgaatgccacagccatccgggtgctgtggaggagccctgcccctggccggcagcacggccagatccggggctaccaggtgcactacgtgaggatggagggcgctgaggcccggggccccccacgcatcaaggatgtgatgctggctgatgcccagtgggagacagatgacacagcagaatatgagatggtgatcaccaacctgcagcctgagacagcctacagcatcaccgtggccgcctacaccatgaagggagatggagcccggagcaagcccaaggtggtggtgaccaagggagctgtgctgggccggcccaccctgtctgtgcagcagaccccagagggcagcctgctggcccgctgggagcccccagctggaacagctgaggaccaggtgctgggctaccgcctgcagtttggaagagaggacagcacccccctggccaccctggagttccccccatctgaagatcgctacacagccagcggcgtgcacaagggggccacctacgtgttccggctggccgcccggagcagaggaggcctgggggaggaggccgctgaggtgctgagcatccctgaggacaccccccggggccacccccagatcctggaggccgctggaaatgccagcgctggcaccgtgctgctgcgctggctgccccctgtgcctgctgagagaaatggagccatcgtgaagtacacagtggccgtgcgggaggccggggccctgggccctgcccgggagacagagctgcctgctgctgctgagcctggagcagaaaatgccctgaccctgcagggcctgaagccagacacagcctatgacctgcaggtgcgggcccacacccggcggggccctggccccttcagcccccctgtgcgctaccgcaccttcctgcgggaccaggtgagccccaagaacttcaaggtgaagatgatcatgaagacctctgtgctgctgtcctgggagttcccagacaactacaacagccccaccccctacaagatccagtacaacggcctgaccctggatgtggatggccgcaccaccaagaagctgatcacccacctgaagccccacaccttctacaactttgtgctgaccaacagaggcagcagcctgggcggcctgcagcagacagtgacagcctggacagccttcaacctgctgaatggcaagcccagcgtggcccccaagccagatgctgatggcttcatcatggtgtacctgcctgatggccagagccctgtgcctgtgcagagctacttcatcgtgatggtgcccctgaggaagagccggggcggccagttcctgacccccctgggcagccctgaggacatggacctggaggagctgatccaggacatcagccggctgcagaggaggagcctgcggcacagccggcagctggaggtgccccggccctacatcgccgcccgcttctctgtgctgccccccaccttccaccctggggaccagaagcagtatggaggctttgacaacagaggcctggagcccggccaccgctacgtgctgtttgtgctggccgtgctgcagaagtctgagcccacctttgctgccagccccttcagtgaccccttccagctggacaacccagacccccagcccatcgtggatggagaggagggcctcatctgggtgattggccctgtgctggccgtggtgttcatcatctgcatcgtgattgccatcctgctgtacaagaacaagccagacagcaagaggaaggacagcgagcccaggaccaagtgcctgctgaacaatgctgacctggccccccaccaccccaaggaccctgtggagatgaggcgcatcaacttccagaccccaggcatgctgagccacccccccatccccatcgctgacatggccgagcacacagagcggctgaaggccaatgacagcctgaagctgagccaggagtatgagagcattgaccccggccagcagttcacctgggagcacagcaacctggaggtgaacaagcccaagaacagatatgccaacgtcatcgcctatgaccacagcagggtcatcctgcagcccatcgagggcatcatgggcagtgactacatcaatgccaactacgtggatggctaccgctgccagaatgcctacatcgccacccagggccccctgcctgagaccttcggggacttctggaggatggtgtgggagcagaggtctgccaccatcgtgatgatgacccggctggaggagaagagccgcatcaagtgtgaccagtactggcccaacagaggaacagagacctacggcttcatccaggtgaccctgctggacaccatcgagctggccaccttctgtgtgaggaccttcagcctgcacaagaatggcagcagcgagaagcgggaggtgcggcagttccagttcaccgcctggccagaccacggcgtgcctgagtaccccacccccttcctggccttcctgcggcgggtgaagacctgcaaccccccagatgctggccccatcgtggtgcactgcagcgctggggtgggccgcacaggctgcttcatcgtgattgatgccatgctggagcgcatcaagccagagaagacagtggatgtgtatggccacgtgaccctgatgaggagccagaggaactacatggtgcagacagaggaccagtacagcttcatccacgaggccctgctggaggccgtgggctgcggcaacacagaggtgcctgcccggagcctgtatgcctacatccagaagctggcccaggtggagcctggagagcacgtgacaggcatggagctggagttcaagaggctggccaacagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagaacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagagcggggagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgagggcgtggtggacatcttccagacagtgaagatgctgcggacccagaggcctgccatggtgcagacagaagatgagtaccagttctgctaccaggccgccctggagtacctgggcagctttgaccactacgccacctag

SEQ ID NO: 166380 - DNA, 5733 bp, Artificial Sequence
  Description of Artificial Sequence: Synthetic coding sequence
atggcccccacctggggccctggcatggtgtctgtggtgggccccatgggcctgctggtggtgctgctggtgggcggctgtgccgctgaggagcccccacgcttcatcaaggagcccaaggaccagattggagtgtctgggggcgtggccagctttgtgtgccaggccactggagaccccaagccccgggtgacctggaacaagaagggcaagaaggtgaacagccagagatttgagaccattgaatttgatgagagcgctggagctgtgctgcgcatccagcccctgcggaccccaagagatgaaaatgtgtatgaatgtgtggcccagaacagcgtgggggagatcaccgtgcacgccaagctgactgtgctgcgggaggaccagctgcccagcggcttccccaacatcgacatgggcccccagctgaaggtggtggagaggaccaggacagccaccatgctgtgtgccgccagcggcaacccagaccctgagatcacctggttcaaggacttcctgcctgtggaccccagcgccagcaatggccgcatcaagcagctgcggagcggggccctgcagatcgagagcagcgaggagacagaccagggcaagtatgaatgtgtggccaccaacagcgctggggtgcgctacagcagccctgccaacctgtatgtgcgggtgcggcgggtggccccccgcttcagcatcctgcccatgagccatgagatcatgcctggaggaaatgtgaacatcacctgtgtggccgtgggcagccccatgccctacgtgaagtggatgcagggcgctgaggacctgaccccagaagatgacatgcctgtgggcagaaatgtgctggagctgacagatgtgaaggacagcgccaactacacctgtgtggccatgagcagcctgggcgtgattgaagctgtggcccagatcaccgtgaagagcctgcccaaggcccctggcacccccatggtgacagaaaatacagccaccagcatcaccatcacctgggacagcggcaacccagaccctgtgtcctactacgtgattgagtacaagagcaagagccaggacggcccctaccagatcaaggaggacatcaccaccacccgctacagcatcggcggcctgagccccaacagtgaatatgagatctgggtgtctgctgtgaacagcatcggccagggccccccatctgagagcgtggtgaccaggactggagagcaggccccagccagcgcccccagaaatgtgcaggccaggatgctgagcgccaccaccatgattgtgcagtgggaggagcctgtggagcccaacggcctcatccggggctacagagtgtactacaccatggagcctgagcaccctgtgggcaactggcagaagcacaacgtggatgacagcctgctgaccaccgtgggcagcctgctggaggatgagacctacacagtgcgggtgctggccttcacctctgtgggagatggccccctgagtgaccccatccaggtgaagacccagcagggcgtgcccggccagcccatgaacctgcgggcagaggcccggtctgagaccagcatcaccctgtcctggagccccccccggcaggagagcatcatcaagtatgagctgctcttccgggagggggaccacggccgggaggtgggccgcacctttgaccccaccaccagctatgtggtggaggacctgaagcccaacacagaatatgccttccggctggccgcccggagcccccagggcctgggcgccttcacccctgtggtgcggcagaggaccctgcagagcaagcccagcgccccaccccaggatgtgaagtgtgtgtctgtgcgcagcacagccatcctggtgtcctggaggcctcctcctcctgagacccacaatggagccctggtgggctacagcgtgcgctaccggcccctgggctctgaagatcctgagcccaaggaggtgaatggcatcccccccaccaccacccagatcctgctggaggccctggagaagtggacccagtaccgcatcaccaccgtggcccacacagaggtgggccctggccctgagagcagccctgtggtggtgaggacagatgaagatgtgcccagcgccccacccaggaaggtggaggccgaggccctgaatgccacagccatccgggtgctgtggaggagccctgcccctggccggcagcacggccagatccggggctaccaggtgcactacgtgaggatggagggcgctgaggcccggggccccccacgcatcaaggatgtgatgctggctgatgcccaggagatggtgatcaccaacctgcagcctgagacagcctacagcatcaccgtggccgcctacaccatgaagggagatggagcccggagcaagcccaaggtggtggtgaccaagggagctgtgctgggccggcccaccctgtctgtgcagcagaccccagagggcagcctgctggcccgctgggagcccccagctggaacagctgaggaccaggtgctgggctaccgcctgcagtttggaagagaggacagcacccccctggccaccctggagttccccccatctgaagatcgctacacagccagcggcgtgcacaagggggccacctacgtgttccggctggccgcccggagcagaggaggcctgggggaggaggccgctgaggtgctgagcatccctgaggacaccccccggggccacccccagatcctggaggccgctggaaatgccagcgctggcaccgtgctgctgcgctggctgccccctgtgcctgctgagagaaatggagccatcgtgaagtacacagtggccgtgcgggaggccggggccctgggccctgcccgggagacagagctgcctgctgctgctgagcctggagcagaaaatgccctgaccctgcagggcctgaagccagacacagcctatgacctgcaggtgcgggcccacacccggcggggccctggccccttcagcccccctgtgcgctaccgcaccttcctgcgggaccaggtgagccccaagaacttcaaggtgaagatgatcatgaagacctctgtgctgctgtcctgggagttcccagacaactacaacagccccaccccctacaagatccagtacaacggcctgaccctggatgtggatggccgcaccaccaagaagctgatcacccacctgaagccccacaccttctacaactttgtgctgaccaacagaggcagcagcctgggcggcctgcagcagacagtgacagcctggacagccttcaacctgctgaatggcaagcccagcgtggcccccaagccagatgctgatggcttcatcatggtgtacctgcctgatggccagagccctgtgcctgtgcagagctacttcatcgtgatggtgcccctgaggaagagccggggcggccagttcctgacccccctgggcagccctgaggacatggacctggaggagctgatccaggacatcagccggctgcagaggaggagcctgcggcacagccggcagctggaggtgccccggccctacatcgccgcccgcttctctgtgctgccccccaccttccaccctggggaccagaagcagtatggaggctttgacaacagaggcctggagcccggccaccgctacgtgctgtttgtgctggccgtgctgcagaagtctgagcccacctttgctgccagccccttcagtgaccccttccagctggacaacccagacccccagcccatcgtggatggagaggagggcctcatctgggtgattggccctgtgctggccgtggtgttcatcatctgcatcgtgattgccatcctgctgtacaagaacaagccagacagcaagaggaaggacagcgagcccaggaccaagtgcctgctgaacaatgctgacctggccccccaccaccccaaggaccctgtggagatgaggcgcatcaacttccagaccccaggcatgctgagccacccccccatccccatcgctgacatggccgagcacacagagcggctgaaggccaatgacagcctgaagctgagccaggagtatgagagcattgaccccggccagcagttcacctgggagcacagcaacctggaggtgaacaagcccaagaacagatatgccaacgtcatcgcctatgaccacagcagggtcatcctgcagcccatcgagggcatcatgggcagtgactacatcaatgccaactacgtggatggctaccgctgccagaatgcctacatcgccacccagggccccctgcctgagaccttcggggacttctggaggatggtgtgggagcagaggtctgccaccatcgtgatgatgacccggctggaggagaagagccgcatcaagtgtgaccagtactggcccaacagaggaacagagacctacggcttcatccaggtgaccctgctggacaccatcgagctggccaccttctgtgtgaggaccttcagcctgcacaagaatggcagcagcgagaagcgggaggtgcggcagttccagttcaccgcctggccagaccacggcgtgcctgagtaccccacccccttcctggccttcctgcggcgggtgaagacctgcaaccccccagatgctggccccatcgtggtgcactgcagcgctggggtgggccgcacaggctgcttcatcgtgattgatgccatgctggagcgcatcaagccagagaagacagtggatgtgtatggccacgtgaccctgatgaggagccagaggaactacatggtgcagacagaggaccagtacagcttcatccacgaggccctgctggaggccgtgggctgcggcaacacagaggtgcctgcccggagcctgtatgcctacatccagaagctggcccaggtggagcctggagagcacgtgacaggcatggagctggagttcaagaggctggccaacagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagaacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagagcggggagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgagggcgtggtggacatcttccagacagtgaagatgctgcggacccagaggcctgccatggtgcagacagaagatgagtaccagttctgctaccaggccgccctggagtacctgggcagctttgaccactacgccacctag

SEQ ID NO: 166381 - DNA, 4506 bp, Artificial Sequence
  Description of Artificial Sequence: Synthetic coding sequence
atggcccccacctggggccctggcatggtgtctgtggtgggccccatgggcctgctggtggtgctgctggtgggcggctgtgccgctgaggagcccccacgcttcatcaaggagcccaaggaccagattggagtgtctgggggcgtggccagctttgtgtgccaggccactggagaccccaagccccgggtgacctggaacaagaagggcaagaaggtgaacagccagagatttgagaccattgaatttgatgagagcgctggagctgtgctgcgcatccagcccctgcggaccccaagagatgaaaatgtgtatgaatgtgtggcccagaacagcgtgggggagatcaccgtgcacgccaagctgactgtgctgcgggaggaccagctgcccagcggcttccccaacatcgacatgggcccccagctgaaggtggtggagaggaccaggacagccaccatgctgtgtgccgccagcggcaacccagaccctgagatcacctggttcaaggacttcctgcctgtggaccccagcgccagcaatggccgcatcaagcagctgcggagcggggccctgcagatcgagagcagcgaggagacagaccagggcaagtatgaatgtgtggccaccaacagcgctggggtgcgctacagcagccctgccaacctgtatgtgcgggtgcggcgggtggccccccgcttcagcatcctgcccatgagccatgagatcatgcctggaggaaatgtgaacatcacctgtgtggccgtgggcagccccatgccctacgtgaagtggatgcagggcgctgaggacctgaccccagaagatgacatgcctgtgggcagaaatgtgctggagctgacagatgtgaaggacagcgccaactacacctgtgtggccatgagcagcctgggcgtgattgaagctgtggcccagatcaccgtgaagagcctgcccaaggcccctggcacccccatggtgacagaaaatacagccaccagcatcaccatcacctgggacagcggcaacccagaccctgtgtcctactacgtgattgagtacaagagcaagagccaggacggcccctaccagatcaaggaggacatcaccaccacccgctacagcatcggcggcctgagccccaacagtgaatatgagatctgggtgtctgctgtgaacagcatcggccagggccccccatctgagagcgtggtgaccaggactggagagcaggccccagccagcgcccccagaaatgtgcaggccaggatgctgagcgccaccaccatgattgtgcagtgggaggagcctgtggagcccaacggcctcatccggggctacagagtgtactacaccatggagcctgagcaccctgtgggcaactggcagaagcacaacgtggatgacagcctgctgaccaccgtgggcagcctgctggaggatgagacctacacagtgcgggtgctggccttcacctctgtgggagatggccccctgagtgaccccatccaggtgaagacccagcagggcgtgcccggccagcccatgaacctgcgggcagaggcccggtctgagaccagcatcaccctgtcctggagccccccccggcaggagagcatcatcaagtatgagctgctcttccgggagggggaccacggccgggaggtgggccgcacctttgaccccaccaccagctatgtggtggaggacctgaagcccaacacagaatatgccttccggctggccgcccggagcccccagggcctgggcgccttcacccctgtggtgcggcagaggaccctgcagagcatcagccccaagaacttcaaggtgaagatgatcatgaagacctctgtgctgctgtcctgggagttcccagacaactacaacagccccaccccctacaagatccagtacaacggcctgaccctggatgtggatggccgcaccaccaagaagctgatcacccacctgaagccccacaccttctacaactttgtgctgaccaacagaggcagcagcctgggcggcctgcagcagacagtgacagcctggacagccttcaacctgctgaatggcaagcccagcgtggcccccaagccagatgctgatggcttcatcatggtgtacctgcctgatggccagagccctgtgcctgtgcagagctacttcatcgtgatggtgcccctgaggaagagcagaggaggccagttcctgacccccctgggcagccctgaggacatggacctggaggagctgatccaggacatcagccggctgcagaggaggagcctgcggcacagccggcagctggaggtgccccggccctacatcgccgcccgcttctctgtgctgccccccaccttccaccctggggaccagaagcagtatggaggctttgacaacagaggcctggagcccggccacagatatgtgctgtttgtgctggccgtgctgcagaagtctgagcccacctttgctgccagccccttcagtgaccccttccagctggacaacccagacccccagcccatcgtggatggagaggagggcctcatctgggtgattggccctgtgctggccgtggtgttcatcatctgcatcgtcatcgccatcctgctgtacaagaacaagccagacagcaagaggaaggacagcgagcccaggaccaagtgcctgctgaacaatgctgacctggccccccaccaccccaaggaccctgtggagatgaggcgcatcaacttccagaccccaggcatgctgagccacccccccatccccatcgctgacatggccgagcacacagagcggctgaaggccaatgacagcctgaagctgagccaggagtatgagagcattgatcctggccagcagttcacctgggagcacagcaacctggaggtgaacaagcccaagaacagatatgccaacgtgattgcctatgaccacagcagggtcatcctgcagcccatcgagggcatcatgggcagtgactacatcaatgccaactacgtggatggctaccgctgccagaatgcctacatcgccacccagggccccctgcctgagacctttggagacttctggaggatggtgtgggagcagaggtctgccaccatcgtgatgatgacccggctggaggagaagagccgcatcaagtgtgaccagtactggcccaacagaggaacagagacctacggcttcatccaggtgaccctgctggacaccatcgagctggccaccttctgtgtgaggaccttcagcctgcacaagaatggcagcagcgagaagcgggaggtgcggcagttccagttcaccgcctggccagaccatggagtgcctgagtaccccacccccttcctggccttcctgcggcgggtgaagacctgcaaccccccagatgctggccccatcgtggtgcactgcagcgctggggtgggccgcacaggctgcttcatcgtgattgatgccatgctggagcgcatcaagccagagaagacagtggatgtgtatggccacgtgaccctgatgaggagccagaggaactacatggtgcagacagaggaccagtacagcttcatccacgaggccctgctggaggccgtgggctgcggcaacacagaggtgcctgcccggagcctgtatgcctacatccagaagctggcccaggtggagcccggggagcacgtgacaggcatggagctggagttcaagaggctggccaacagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagaacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagtctggagagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgaaggagtggtggacatcttccagacagtgaagatgctgcggacccagaggcctgccatggtgcagacagaagatgagtaccagttctgctaccaggccgccctggagtacctgggcagctttgaccactacgccacctag

SEQ ID NO: 166382 - DNA, 5847 bp, Artificial Sequence
  Description of Artificial Sequence: Synthetic coding sequence
atggcccccacctggggccctggcatggtgtctgtggtgggccccatgggcctgctggtggtgctgctggtgggcggctgtgccgctgaggagcccccacgcttcatcaaggagcccaaggaccagattggagtgtctgggggcgtggccagctttgtgtgccaggccactggagaccccaagccccgggtgacctggaacaagaagggcaagaaggtgaacagccagagatttgagaccattgaatttgatgagagcgctggagctgtgctgcgcatccagcccctgcggaccccaagagatgaaaatgtgtatgaatgtgtggcccagaacagcgtgggggagatcaccgtgcacgccaagctgactgtgctgcgggaggaccagctgcccagcggcttccccaacatcgacatgggcccccagctgaaggtggtggagaggaccaggacagccaccatgctgtgtgccgccagcggcaacccagaccctgagatcacctggttcaaggacttcctgcctgtggaccccagcgccagcaatggccgcatcaagcagctgcggagtgaccaggccttcagccacctgcccaccggggccctgcagatcgagagcagcgaggagacagaccagggcaagtatgaatgtgtggccaccaacagcgctggggtgcgctacagcagccctgccaacctgtatgtgcgggtgtggaggacagtgagaagagtggccccccgcttcagcatcctgcccatgagccatgagatcatgcctggaggaaatgtgaacatcacctgtgtggccgtgggcagccccatgccctacgtgaagtggatgcagggcgctgaggacctgaccccagaagatgacatgcctgtgggcagaaatgtgctggagctgacagatgtgaaggacagcgccaactacacctgtgtggccatgagcagcctgggcgtcatcgaggccgtggcccagatcaccgtgaagagcctgcccaaggcccctggcacccccatggtgacagagaacacagccaccagcatcaccatcacctgggacagcggcaacccagaccctgtgtcctactacgtgattgagtacaagagcaagagccaggacggcccctaccagatcaaggaggacatcaccaccacccgctacagcattggaggcctgagccccaacagtgaatatgagatctgggtgtctgctgtgaacagcatcggccagggcccccccagcgagagcgtggtgaccaggactggagagcaggccccagccagcgcccccagaaatgtgcaggccaggatgctgagcgccaccaccatgattgtgcagtgggaggagcctgtggagcccaacggcctcatccggggctacagagtgtactacaccatggagcctgagcaccctgtgggcaactggcagaagcacaacgtggatgacagcctgctgaccaccgtgggcagcctgctggaggatgagacctacacagtgcgggtgctggccttcacctctgtgggagatggccccctgagtgaccccatccaggtgaagacccagcagggcgtgcccggccagcccatgaacctgcgggcagaggcccggtctgagaccagcatcaccctgtcctggagccccccccggcaggagagcatcatcaagtatgagctgctcttccgggagggggaccacggccgggaggtgggccgcacctttgaccccaccaccagctatgtggtggaggacctgaagcccaacacagaatatgccttccggctggccgcccggagcccccagggcctgggcgccttcacccctgtggtgcggcagaggaccctgcagagcaagcccagcgccccaccccaggatgtgaagtgtgtgtctgtgcgcagcacagccatcctggtgtcctggaggcctcctcctcctgagacccacaacggggccctggtgggctacagcgtgcgctaccggcccctgggcagcgaggaccctgagcccaaggaggtgaatggcatcccccccaccaccacccagatcctgctggaggccctggagaagtggacccagtaccgcatcaccaccgtggcccacacagaggtgggccctggccctgagagcagccctgtggtggtgaggacagatgaagatgtgcccagcgccccacccaggaaggtggaggccgaggccctgaatgccacagccatccgggtgctgtggaggagccctgcccctggccggcagcacggccagatccggggctaccaggtgcactacgtgaggatggagggcgctgaggcccggggccccccacgcatcaaggatgtgatgctggctgatgcccagtgggagacagatgacacagcagaatatgagatggtgatcaccaacctgcagcctgagacagcctacagcatcaccgtggccgcctacaccatgaagggagatggagcccggagcaagcccaaggtggtggtgaccaagggagctgtgctgggccggcccaccctgtctgtgcagcagaccccagagggcagcctgctggcccgctgggagcccccagctggaacagctgaggaccaggtgctgggctaccgcctgcagtttggaagagaggacagcacccccctggccaccctggagttccccccatctgaagatcgctacacagccagcggcgtgcacaagggggccacctacgtgttccggctggccgcccggagcagaggaggcctgggggaggaggccgctgaggtgctgagcatccctgaggacaccccccggggccacccccagatcctggaggccgctggaaatgccagcgctggcaccgtgctgctgcgctggctgccccctgtgcctgctgagagaaatggagccatcgtgaagtacacagtggccgtgcgggaggccggggccctgggccctgcccgggagacagagctgcctgctgctgctgagcctggagcagaaaatgccctgaccctgcagggcctgaagccagacacagcctatgacctgcaggtgcgggcccacacccggcggggccctggccccttcagcccccctgtgcgctaccgcaccttcctgcgggaccaggtgagccccaagaacttcaaggtgaagatgatcatgaagacctctgtgctgctgtcctgggagttcccagacaactacaacagccccaccccctacaagatccagtacaacggcctgaccctggatgtggatggccgcaccaccaagaagctgatcacccacctgaagccccacaccttctacaactttgtgctgaccaacagaggcagcagcctgggcggcctgcagcagacagtgacagcctggacagccttcaacctgctgaatggcaagcccagcgtggcccccaagccagatgctgatggcttcatcatggtgtacctgcctgatggccagagccctgtgcctgtgcagagctacttcatcgtgatggtgcccctgaggaagagccggggcggccagttcctgacccccctgggcagccctgaggacatggacctggaggagctgatccaggacatcagccggctgcagaggaggagcctgcggcacagccggcagctggaggtgccccggccctacatcgccgcccgcttctctgtgctgccccccaccttccaccctggggaccagaagcagtatggaggctttgacaacagaggcctggagcccggccaccgctacgtgctgtttgtgctggccgtgctgcagaagtctgagcccacctttgctgccagccccttcagtgaccccttccagctggacaacccagacccccagcccatcgtggatggagaggagggcctcatctgggtgattggccctgtgctggccgtggtgttcatcatctgcatcgtgattgccatcctgctgtacaagaacaagccagacagcaagaggaaggacagcgagcccaggaccaagtgcctgctgaacaatgctgacctggccccccaccaccccaaggaccctgtggagatgaggcgcatcaacttccagaccccagattctggcctgcggagccccctgcgggagcccggcttccactttgagagcatgctgagccacccccccatccccatcgctgacatggccgagcacacagagcggctgaaggccaatgacagcctgaagctgagccaggagtatgagagcattgaccccggccagcagttcacctgggagcacagcaacctggaggtgaacaagcccaagaacagatatgccaacgtcatcgcctatgaccacagcagggtcatcctgcagcccatcgagggcatcatgggcagtgactacatcaatgccaactacgtggatggctaccgctgccagaatgcctacatcgccacccagggccccctgcctgagaccttcggggacttctggaggatggtgtgggagcagaggtctgccaccatcgtgatgatgacccggctggaggagaagagccgcatcaagtgtgaccagtactggcccaacagaggaacagagacctacggcttcatccaggtgaccctgctggacaccatcgagctggccaccttctgtgtgaggaccttcagcctgcacaagaatggcagcagcgagaagcgggaggtgcggcagttccagttcaccgcctggccagaccacggcgtgcctgagtaccccacccccttcctggccttcctgcggcgggtgaagacctgcaaccccccagatgctggccccatcgtggtgcactgcagcgctggggtgggccgcacaggctgcttcatcgtgattgatgccatgctggagcgcatcaagccagagaagacagtggatgtgtatggccacgtgaccctgatgaggagccagaggaactacatggtgcagacagaggaccagtacagcttcatccacgaggccctgctggaggccgtgggctgcggcaacacagaggtgcctgcccggagcctgtatgcctacatccagaagctggcccaggtggagcctggagagcacgtgacaggcatggagctggagttcaagaggctggccaacagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagaacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagagcggggagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgagggcgtggtggacatcttccagacagtgaagatgctgcggacccagaggcctgccatggtgcagacagaagatgagtaccagttctgctaccaggccgccctggagtacctgggcagctttgaccactacgccacctag

SEQ ID NO: 166383 - DNA, 4593 bp, Artificial Sequence
  Description of Artificial Sequence: Synthetic coding sequence
atggcccccacctggggccctggcatggtgtctgtggtgggccccatgggcctgctggtggtgctgctggtgggcggctgtgccgctgaggagcccccacgcttcatcaaggagcccaaggaccagattggagtgtctgggggcgtggccagctttgtgtgccaggccactggagaccccaagccccgggtgacctggaacaagaagggcaagaaggtgaacagccagagatttgagaccattgaatttgatgagagcgctggagctgtgctgcgcatccagcccctgcggaccccaagagatgaaaatgtgtatgaatgtgtggcccagaacagcgtgggggagatcaccgtgcacgccaagctgactgtgctgcgggaggaccagctgcccagcggcttccccaacatcgacatgggcccccagctgaaggtggtggagaggaccaggacagccaccatgctgtgtgccgccagcggcaacccagaccctgagatcacctggttcaaggacttcctgcctgtggaccccagcgccagcaatggccgcatcaagcagctgcggagtgaccaggccttcagccacctgcccaccggggccctgcagatcgagagcagcgaggagacagaccagggcaagtatgaatgtgtggccaccaacagcgctggggtgcgctacagcagccctgccaacctgtatgtgcgggtgtggaggacagtgagaagagtggccccccgcttcagcatcctgcccatgagccatgagatcatgcctggaggaaatgtgaacatcacctgtgtggccgtgggcagccccatgccctacgtgaagtggatgcagggcgctgaggacctgaccccagaagatgacatgcctgtgggcagaaatgtgctggagctgacagatgtgaaggacagcgccaactacacctgtgtggccatgagcagcctgggcgtcatcgaggccgtggcccagatcaccgtgaagagcctgcccaaggcccctggcacccccatggtgacagagaacacagccaccagcatcaccatcacctgggacagcggcaacccagaccctgtgtcctactacgtgattgagtacaagagcaagagccaggacggcccctaccagatcaaggaggacatcaccaccacccgctacagcattggaggcctgagccccaacagtgaatatgagatctgggtgtctgctgtgaacagcatcggccagggcccccccagcgagagcgtggtgaccaggactggagagcaggccccagccagcgcccccagaaatgtgcaggccaggatgctgagcgccaccaccatgattgtgcagtgggaggagcctgtggagcccaacggcctcatccggggctacagagtgtactacaccatggagcctgagcaccctgtgggcaactggcagaagcacaacgtggatgacagcctgctgaccaccgtgggcagcctgctggaggatgagacctacacagtgcgggtgctggccttcacctctgtgggagatggccccctgagtgaccccatccaggtgaagacccagcagggcgtgcccggccagcccatgaacctgcgggcagaggcccggtctgagaccagcatcaccctgtcctggagccccccccggcaggagagcatcatcaagtatgagctgctcttccgggagggggaccacggccgggaggtgggccgcacctttgaccccaccaccagctatgtggtggaggacctgaagcccaacacagaatatgccttccggctggccgcccggagcccccagggcctgggcgccttcacccctgtggtgcggcagaggaccctgcagagcatcagccccaagaacttcaaggtgaagatgatcatgaagacctctgtgctgctgtcctgggagttcccagacaactacaacagccccaccccctacaagatccagtacaacggcctgaccctggatgtggatggccgcaccaccaagaagctgatcacccacctgaagccccacaccttctacaactttgtgctgaccaacagaggcagcagcctgggcggcctgcagcagacagtgacagcctggacagccttcaacctgctgaatggcaagcccagcgtggcccccaagccagatgctgatggcttcatcatggtgtacctgcctgatggccagagccctgtgcctgtgcagagctacttcatcgtgatggtgcccctgaggaagagccggggcggccagttcctgacccccctgggcagccctgaggacatggacctggaggagctgatccaggacatcagccggctgcagaggaggagcctgcggcacagccggcagctggaggtgccccggccctacatcgccgcccgcttctctgtgctgccccccaccttccaccctggggaccagaagcagtatggaggctttgacaacagaggcctggagcccggccaccgctacgtgctgtttgtgctggccgtgctgcagaagtctgagcccacctttgctgccagccccttcagtgaccccttccagctggacaacccagacccccagcccatcgtggatggagaggagggcctcatctgggtgattggccctgtgctggccgtggtgttcatcatctgcatcgtgattgccatcctgctgtacaagaacaagccagacagcaagaggaaggacagcgagcccaggaccaagtgcctgctgaacaatgctgacctggccccccaccaccccaaggaccctgtggagatgaggcgcatcaacttccagaccccagattctggcctgcggagccccctgcgggagcccggcttccactttgagagcatgctgagccacccccccatccccatcgctgacatggccgagcacacagagcggctgaaggccaatgacagcctgaagctgagccaggagtatgagagcattgaccccggccagcagttcacctgggagcacagcaacctggaggtgaacaagcccaagaacagatatgccaacgtcatcgcctatgaccacagcagggtcatcctgcagcccatcgagggcatcatgggcagtgactacatcaatgccaactacgtggatggctaccgctgccagaatgcctacatcgccacccagggccccctgcctgagaccttcggggacttctggaggatggtgtgggagcagaggtctgccaccatcgtgatgatgacccggctggaggagaagagccgcatcaagtgtgaccagtactggcccaacagaggaacagagacctacggcttcatccaggtgaccctgctggacaccatcgagctggccaccttctgtgtgaggaccttcagcctgcacaagaatggcagcagcgagaagcgggaggtgcggcagttccagttcaccgcctggccagaccacggcgtgcctgagtaccccacccccttcctggccttcctgcggcgggtgaagacctgcaaccccccagatgctggccccatcgtggtgcactgcagcgctggggtgggccgcacaggctgcttcatcgtgattgatgccatgctggagcgcatcaagccagagaagacagtggatgtgtatggccacgtgaccctgatgaggagccagaggaactacatggtgcagacagaggaccagtacagcttcatccacgaggccctgctggaggccgtgggctgcggcaacacagaggtgcctgcccggagcctgtatgcctacatccagaagctggcccaggtggagcctggagagcacgtgacaggcatggagctggagttcaagaggctggccaacagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagaacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagagcggggagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgagggcgtggtggacatcttccagacagtgaagatgctgcggacccagaggcctgccatggtgcagacagaagatgagtaccagttctgctaccaggccgccctggagtacctgggcagctttgaccactacgccacctag

SEQ ID NO: 166384 - DNA, 5820 bp, Artificial Sequence
  Description of Artificial Sequence: Synthetic coding sequence
atggcccccacctggggccctggcatggtgtctgtggtgggccccatgggcctgctggtggtgctgctggtgggcggctgtgccgctgaggagcccccacgcttcatcaaggagcccaaggaccagattggagtgtctgggggcgtggccagctttgtgtgccaggccactggagaccccaagccccgggtgacctggaacaagaagggcaagaaggtgaacagccagagatttgagaccattgaatttgatgagagcgctggagctgtgctgcgcatccagcccctgcggaccccaagagatgaaaatgtgtatgaatgtgtggcccagaacagcgtgggggagatcaccgtgcacgccaagctgactgtgctgcgggaggaccagctgcccagcggcttccccaacatcgacatgggcccccagctgaaggtggtggagaggaccaggacagccaccatgctgtgtgccgccagcggcaacccagaccctgagatcacctggttcaaggacttcctgcctgtggaccccagcgccagcaatggccgcatcaagcagctgcggagtgaccaggccttcagccacctgcccaccggggccctgcagatcgagagcagcgaggagacagaccagggcaagtatgaatgtgtggccaccaacagcgctggggtgcgctacagcagccctgccaacctgtatgtgcgggtgtggaggacagtgagaagagtggccccccgcttcagcatcctgcccatgagccatgagatcatgcctggaggaaatgtgaacatcacctgtgtggccgtgggcagccccatgccctacgtgaagtggatgcagggcgctgaggacctgaccccagaagatgacatgcctgtgggcagaaatgtgctggagctgacagatgtgaaggacagcgccaactacacctgtgtggccatgagcagcctgggcgtcatcgaggccgtggcccagatcaccgtgaagagcctgcccaaggcccctggcacccccatggtgacagagaacacagccaccagcatcaccatcacctgggacagcggcaacccagaccctgtgtcctactacgtgattgagtacaagagcaagagccaggacggcccctaccagatcaaggaggacatcaccaccacccgctacagcattggaggcctgagccccaacagtgaatatgagatctgggtgtctgctgtgaacagcatcggccagggcccccccagcgagagcgtggtgaccaggactggagagcaggccccagccagcgcccccagaaatgtgcaggccaggatgctgagcgccaccaccatgattgtgcagtgggaggagcctgtggagcccaacggcctcatccggggctacagagtgtactacaccatggagcctgagcaccctgtgggcaactggcagaagcacaacgtggatgacagcctgctgaccaccgtgggcagcctgctggaggatgagacctacacagtgcgggtgctggccttcacctctgtgggagatggccccctgagtgaccccatccaggtgaagacccagcagggcgtgcccggccagcccatgaacctgcgggcagaggcccggtctgagaccagcatcaccctgtcctggagccccccccggcaggagagcatcatcaagtatgagctgctcttccgggagggggaccacggccgggaggtgggccgcacctttgaccccaccaccagctatgtggtggaggacctgaagcccaacacagaatatgccttccggctggccgcccggagcccccagggcctgggcgccttcacccctgtggtgcggcagaggaccctgcagagcaagcccagcgccccaccccaggatgtgaagtgtgtgtctgtgcgcagcacagccatcctggtgtcctggaggcctcctcctcctgagacccacaacggggccctggtgggctacagcgtgcgctaccggcccctgggcagcgaggaccctgagcccaaggaggtgaatggcatcccccccaccaccacccagatcctgctggaggccctggagaagtggacccagtaccgcatcaccaccgtggcccacacagaggtgggccctggccctgagagcagccctgtggtggtgaggacagatgaagatgtgcccagcgccccacccaggaaggtggaggccgaggccctgaatgccacagccatccgggtgctgtggaggagccctgcccctggccggcagcacggccagatccggggctaccaggtgcactacgtgaggatggagggcgctgaggcccggggccccccacgcatcaaggatgtgatgctggctgatgcccaggagatggtgatcaccaacctgcagcctgagacagcctacagcatcaccgtggccgcctacaccatgaagggagatggagcccggagcaagcccaaggtggtggtgaccaagggagctgtgctgggccggcccaccctgtctgtgcagcagaccccagagggcagcctgctggcccgctgggagcccccagctggaacagctgaggaccaggtgctgggctaccgcctgcagtttggccgggaggacagcacccccctggccaccctggagttccccccatctgaggaccgctacacagccagcggcgtgcacaagggggccacctacgtgttccggctggccgcccggagccggggcggcctgggggaggaggccgctgaggtgctgagcatccctgaggacaccccccggggccacccccagatcctggaggccgctggaaatgccagcgctggcaccgtgctgctgcgctggctgccccctgtgcctgctgagagaaatggagccatcgtgaagtacacagtggccgtgcgggaggccggggccctgggccctgcccgggagacagagctgcctgctgctgctgagcccggggctgaaaatgccctgaccctgcagggcctgaagccagacacagcctatgacctgcaggtgcgggcccacacccggcggggccctggccccttcagcccccctgtgcgctaccgcaccttcctgcgggaccaggtgagccccaagaacttcaaggtgaagatgatcatgaagacctctgtgctgctgtcctgggagttcccagacaactacaacagccccaccccctacaagatccagtacaacggcctgaccctggatgtggatggccgcaccaccaagaagctgatcacccacctgaagccccacaccttctacaactttgtgctgaccaacagaggcagcagcctgggcggcctgcagcagacagtgacagcctggacagccttcaacctgctgaatggcaagcccagcgtggcccccaagccagatgctgatggcttcatcatggtgtacctgcctgatggccagagccctgtgcctgtgcagagctacttcatcgtgatggtgcccctgaggaagagcagaggaggccagttcctgacccccctgggcagccctgaggacatggacctggaggagctgatccaggacatcagccggctgcagaggaggagcctgcggcacagccggcagctggaggtgccccggccctacatcgccgcccgcttctctgtgctgccccccaccttccaccctggggaccagaagcagtatggaggctttgacaacagaggcctggagcccggccacagatatgtgctgtttgtgctggccgtgctgcagaagtctgagcccacctttgctgccagccccttcagtgaccccttccagctggacaacccagacccccagcccatcgtggatggagaggagggcctcatctgggtgattggccctgtgctggccgtggtgttcatcatctgcatcgtcatcgccatcctgctgtacaagaacaagccagacagcaagaggaaggacagcgagcccaggaccaagtgcctgctgaacaatgctgacctggccccccaccaccccaaggaccctgtggagatgaggcgcatcaacttccagaccccagacagcggcctgcggagccccctgcgggagcccggcttccactttgagagcatgctgagccacccccccatccccatcgctgacatggccgagcacacagagcggctgaaggccaatgacagcctgaagctgagccaggagtatgagagcattgatcctggccagcagttcacctgggagcacagcaacctggaggtgaacaagcccaagaacagatatgccaacgtgattgcctatgaccacagcagggtcatcctgcagcccatcgagggcatcatgggcagtgactacatcaatgccaactacgtggatggctaccgctgccagaatgcctacatcgccacccagggccccctgcctgagacctttggagacttctggaggatggtgtgggagcagaggtctgccaccatcgtgatgatgacccggctggaggagaagagccgcatcaagtgtgaccagtactggcccaacagaggaacagagacctacggcttcatccaggtgaccctgctggacaccatcgagctggccaccttctgtgtgaggaccttcagcctgcacaagaatggcagcagcgagaagcgggaggtgcggcagttccagttcaccgcctggccagaccatggagtgcctgagtaccccacccccttcctggccttcctgcggcgggtgaagacctgcaaccccccagatgctggccccatcgtggtgcactgcagcgctggggtgggccgcacaggctgcttcatcgtgattgatgccatgctggagcgcatcaagccagagaagacagtggatgtgtatggccacgtgaccctgatgaggagccagaggaactacatggtgcagacagaggaccagtacagcttcatccacgaggccctgctggaggccgtgggctgcggcaacacagaggtgcctgcccggagcctgtatgcctacatccagaagctggcccaggtggagcccggggagcacgtgacaggcatggagctggagttcaagaggctggccaacagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagaacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagtctggagagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgaaggagtggtggacatcttccagacagtgaagatgctgcggacccagaggcctgccatggtgcagacagaagatgagtaccagttctgctaccaggccgccctggagtacctgggcagctttgaccactacgccacctag

SEQ ID NO: 166385 - DNA, 5847 bp, Artificial Sequence
  Description of Artificial Sequence: Synthetic coding sequence
atggcccccacctggggccctggcatggtgtctgtggtgggccccatgggcctgctggtggtgctgctggtgggcggctgtgccgctgaggagcccccacgcttcatcaaggagcccaaggaccagattggagtgtctgggggcgtggccagctttgtgtgccaggccactggagaccccaagccccgggtgacctggaacaagaagggcaagaaggtgaacagccagagatttgagaccattgaatttgatgagagcgctggagctgtgctgcgcatccagcccctgcggaccccaagagatgaaaatgtgtatgaatgtgtggcccagaacagcgtgggggagatcaccgtgcacgccaagctgactgtgctgcgggaggaccagctgcccagcggcttccccaacatcgacatgggcccccagctgaaggtggtggagaggaccaggacagccaccatgctgtgtgccgccagcggcaacccagaccctgagatcacctggttcaaggacttcctgcctgtggaccccagcgccagcaatggccgcatcaagcagctgcggtctgagacctttgagagcacccccatccggggggccctgcagatcgagagcagcgaggagacagaccagggcaagtatgaatgtgtggccaccaacagcgctggggtgcgctacagcagccctgccaacctgtatgtgcgggagctgcgggaggtgagaagagtggccccccgcttcagcatcctgcccatgagccatgagatcatgcctggaggaaatgtgaacatcacctgtgtggccgtgggcagccccatgccctacgtgaagtggatgcagggcgctgaggacctgaccccagaagatgacatgcctgtgggcagaaatgtgctggagctgacagatgtgaaggacagcgccaactacacctgtgtggccatgagcagcctgggcgtcatcgaggccgtggcccagatcaccgtgaagagcctgcccaaggcccctggcacccccatggtgacagagaacacagccaccagcatcaccatcacctgggacagcggcaacccagaccctgtgtcctactacgtgattgagtacaagagcaagagccaggacggcccctaccagatcaaggaggacatcaccaccacccgctacagcattggaggcctgagccccaacagtgaatatgagatctgggtgtctgctgtgaacagcatcggccagggcccccccagcgagagcgtggtgaccaggactggagagcaggccccagccagcgcccccagaaatgtgcaggccaggatgctgagcgccaccaccatgattgtgcagtgggaggagcctgtggagcccaacggcctcatccggggctacagagtgtactacaccatggagcctgagcaccctgtgggcaactggcagaagcacaacgtggatgacagcctgctgaccaccgtgggcagcctgctggaggatgagacctacacagtgcgggtgctggccttcacctctgtgggagatggccccctgagtgaccccatccaggtgaagacccagcagggcgtgcccggccagcccatgaacctgcgggcagaggcccggtctgagaccagcatcaccctgtcctggagccccccccggcaggagagcatcatcaagtatgagctgctcttccgggagggggaccacggccgggaggtgggccgcacctttgaccccaccaccagctatgtggtggaggacctgaagcccaacacagaatatgccttccggctggccgcccggagcccccagggcctgggcgccttcacccctgtggtgcggcagaggaccctgcagagcaagcccagcgccccaccccaggatgtgaagtgtgtgtctgtgcgcagcacagccatcctggtgtcctggaggcctcctcctcctgagacccacaacggggccctggtgggctacagcgtgcgctaccggcccctgggcagcgaggaccctgagcccaaggaggtgaatggcatcccccccaccaccacccagatcctgctggaggccctggagaagtggacccagtaccgcatcaccaccgtggcccacacagaggtgggccctggccctgagagcagccctgtggtggtgaggacagatgaagatgtgcccagcgccccacccaggaaggtggaggccgaggccctgaatgccacagccatccgggtgctgtggaggagccctgcccctggccggcagcacggccagatccggggctaccaggtgcactacgtgaggatggagggcgctgaggcccggggccccccacgcatcaaggatgtgatgctggctgatgcccagtgggagacagatgacacagcagaatatgagatggtgatcaccaacctgcagcctgagacagcctacagcatcaccgtggccgcctacaccatgaagggagatggagcccggagcaagcccaaggtggtggtgaccaagggagctgtgctgggccggcccaccctgtctgtgcagcagaccccagagggcagcctgctggcccgctgggagcccccagctggaacagctgaggaccaggtgctgggctaccgcctgcagtttggaagagaggacagcacccccctggccaccctggagttccccccatctgaagatcgctacacagccagcggcgtgcacaagggggccacctacgtgttccggctggccgcccggagcagaggaggcctgggggaggaggccgctgaggtgctgagcatccctgaggacaccccccggggccacccccagatcctggaggccgctggaaatgccagcgctggcaccgtgctgctgcgctggctgccccctgtgcctgctgagagaaatggagccatcgtgaagtacacagtggccgtgcgggaggccggggccctgggccctgcccgggagacagagctgcctgctgctgctgagcctggagcagaaaatgccctgaccctgcagggcctgaagccagacacagcctatgacctgcaggtgcgggcccacacccggcggggccctggccccttcagcccccctgtgcgctaccgcaccttcctgcgggaccaggtgagccccaagaacttcaaggtgaagatgatcatgaagacctctgtgctgctgtcctgggagttcccagacaactacaacagccccaccccctacaagatccagtacaacggcctgaccctggatgtggatggccgcaccaccaagaagctgatcacccacctgaagccccacaccttctacaactttgtgctgaccaacagaggcagcagcctgggcggcctgcagcagacagtgacagcctggacagccttcaacctgctgaatggcaagcccagcgtggcccccaagccagatgctgatggcttcatcatggtgtacctgcctgatggccagagccctgtgcctgtgcagagctacttcatcgtgatggtgcccctgaggaagagccggggcggccagttcctgacccccctgggcagccctgaggacatggacctggaggagctgatccaggacatcagccggctgcagaggaggagcctgcggcacagccggcagctggaggtgccccggccctacatcgccgcccgcttctctgtgctgccccccaccttccaccctggggaccagaagcagtatggaggctttgacaacagaggcctggagcccggccaccgctacgtgctgtttgtgctggccgtgctgcagaagtctgagcccacctttgctgccagccccttcagtgaccccttccagctggacaacccagacccccagcccatcgtggatggagaggagggcctcatctgggtgattggccctgtgctggccgtggtgttcatcatctgcatcgtgattgccatcctgctgtacaagaacaagccagacagcaagaggaaggacagcgagcccaggaccaagtgcctgctgaacaatgctgacctggccccccaccaccccaaggaccctgtggagatgaggcgcatcaacttccagaccccagattctggcctgcggagccccctgcgggagcccggcttccactttgagagcatgctgagccacccccccatccccatcgctgacatggccgagcacacagagcggctgaaggccaatgacagcctgaagctgagccaggagtatgagagcattgaccccggccagcagttcacctgggagcacagcaacctggaggtgaacaagcccaagaacagatatgccaacgtcatcgcctatgaccacagcagggtcatcctgcagcccatcgagggcatcatgggcagtgactacatcaatgccaactacgtggatggctaccgctgccagaatgcctacatcgccacccagggccccctgcctgagaccttcggggacttctggaggatggtgtgggagcagaggtctgccaccatcgtgatgatgacccggctggaggagaagagccgcatcaagtgtgaccagtactggcccaacagaggaacagagacctacggcttcatccaggtgaccctgctggacaccatcgagctggccaccttctgtgtgaggaccttcagcctgcacaagaatggcagcagcgagaagcgggaggtgcggcagttccagttcaccgcctggccagaccacggcgtgcctgagtaccccacccccttcctggccttcctgcggcgggtgaagacctgcaaccccccagatgctggccccatcgtggtgcactgcagcgctggggtgggccgcacaggctgcttcatcgtgattgatgccatgctggagcgcatcaagccagagaagacagtggatgtgtatggccacgtgaccctgatgaggagccagaggaactacatggtgcagacagaggaccagtacagcttcatccacgaggccctgctggaggccgtgggctgcggcaacacagaggtgcctgcccggagcctgtatgcctacatccagaagctggcccaggtggagcctggagagcacgtgacaggcatggagctggagttcaagaggctggccaacagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagaacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagagcggggagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgagggcgtggtggacatcttccagacagtgaagatgctgcggacccagaggcctgccatggtgcagacagaagatgagtaccagttctgctaccaggccgccctggagtacctgggcagctttgaccactacgccacctag

SEQ ID NO: 166386 - DNA, 5850 bp, Artificial Sequence
  Description of Artificial Sequence: Synthetic coding sequence
atggcccccacctggggccctggcatggtgtctgtggtgggccccatgggcctgctggtggtgctgctggtgggcggctgtgccgctgaggagcccccacgcttcatcaaggagcccaaggaccagattggagtgtctgggggcgtggccagctttgtgtgccaggccactggagaccccaagccccgggtgacctggaacaagaagggcaagaaggtgaacagccagagatttgagaccattgaatttgatgagagcgctggagctgtgctgcgcatccagcccctgcggaccccaagagatgaaaatgtgtatgaatgtgtggcccagaacagcgtgggggagatcaccgtgcacgccaagctgactgtgctgcgggaggaccagctgcccagcggcttccccaacatcgacatgggcccccagctgaaggtggtggagaggaccaggacagccaccatgctgtgtgccgccagcggcaacccagaccctgagatcacctggttcaaggacttcctgcctgtggaccccagcgccagcaatggccgcatcaagcagctgcggcgctctgagacctttgagagcacccccatccggggggccctgcagatcgagagcagcgaggagacagaccagggcaagtatgaatgtgtggccaccaacagcgctggggtgcgctacagcagccctgccaacctgtatgtgcgggagctgcgggaggtgcggcgggtggccccccgcttcagcatcctgcccatgagccatgagatcatgcctggaggaaatgtgaacatcacctgtgtggccgtgggcagccccatgccctacgtgaagtggatgcagggcgctgaggacctgaccccagaagatgacatgcctgtgggcagaaatgtgctggagctgacagatgtgaaggacagcgccaactacacctgtgtggccatgagcagcctgggcgtgattgaagctgtggcccagatcaccgtgaagagcctgcccaaggcccctggcacccccatggtgacagaaaatacagccaccagcatcaccatcacctgggacagcggcaacccagaccctgtgtcctactacgtgattgagtacaagagcaagagccaggacggcccctaccagatcaaggaggacatcaccaccacccgctacagcatcggcggcctgagccccaacagtgaatatgagatctgggtgtctgctgtgaacagcatcggccagggccccccatctgagagcgtggtgaccaggactggagagcaggccccagccagcgcccccagaaatgtgcaggccaggatgctgagcgccaccaccatgattgtgcagtgggaggagcctgtggagcccaacggcctcatccggggctacagagtgtactacaccatggagcctgagcaccctgtgggcaactggcagaagcacaacgtggatgacagcctgctgaccaccgtgggcagcctgctggaggatgagacctacacagtgcgggtgctggccttcacctctgtgggagatggccccctgagtgaccccatccaggtgaagacccagcagggcgtgcccggccagcccatgaacctgcgggcagaggcccggtctgagaccagcatcaccctgtcctggagccccccccggcaggagagcatcatcaagtatgagctgctcttccgggagggggaccacggccgggaggtgggccgcacctttgaccccaccaccagctatgtggtggaggacctgaagcccaacacagaatatgccttccggctggccgcccggagcccccagggcctgggcgccttcacccctgtggtgcggcagaggaccctgcagagcaagcccagcgccccaccccaggatgtgaagtgtgtgtctgtgcgcagcacagccatcctggtgtcctggaggcctcctcctcctgagacccacaatggagccctggtgggctacagcgtgcgctaccggcccctgggctctgaagatcctgagcccaaggaggtgaatggcatcccccccaccaccacccagatcctgctggaggccctggagaagtggacccagtaccgcatcaccaccgtggcccacacagaggtgggccctggccctgagagcagccctgtggtggtgaggacagatgaagatgtgcccagcgccccacccaggaaggtggaggccgaggccctgaatgccacagccatccgggtgctgtggaggagccctgcccctggccggcagcacggccagatccggggctaccaggtgcactacgtgaggatggagggcgctgaggcccggggccccccacgcatcaaggatgtgatgctggctgatgcccagtgggagacagatgacacagcagaatatgagatggtgatcaccaacctgcagcctgagacagcctacagcatcaccgtggccgcctacaccatgaagggagatggagcccggagcaagcccaaggtggtggtgaccaagggagctgtgctgggccggcccaccctgtctgtgcagcagaccccagagggcagcctgctggcccgctgggagcccccagctggaacagctgaggaccaggtgctgggctaccgcctgcagtttggccgggaggacagcacccccctggccaccctggagttccccccatctgaggaccgctacacagccagcggcgtgcacaagggggccacctacgtgttccggctggccgcccggagccggggcggcctgggggaggaggccgctgaggtgctgagcatccctgaggacaccccccggggccacccccagatcctggaggccgctggaaatgccagcgctggcaccgtgctgctgcgctggctgccccctgtgcctgctgagagaaatggagccatcgtgaagtacacagtggccgtgcgggaggccggggccctgggccctgcccgggagacagagctgcctgctgctgctgagcccggggctgaaaatgccctgaccctgcagggcctgaagccagacacagcctatgacctgcaggtgcgggcccacacccggcggggccctggccccttcagcccccctgtgcgctaccgcaccttcctgcgggaccaggtgagccccaagaacttcaaggtgaagatgatcatgaagacctctgtgctgctgtcctgggagttcccagacaactacaacagccccaccccctacaagatccagtacaacggcctgaccctggatgtggatggccgcaccaccaagaagctgatcacccacctgaagccccacaccttctacaactttgtgctgaccaacagaggcagcagcctgggcggcctgcagcagacagtgacagcctggacagccttcaacctgctgaatggcaagcccagcgtggcccccaagccagatgctgatggcttcatcatggtgtacctgcctgatggccagagccctgtgcctgtgcagagctacttcatcgtgatggtgcccctgaggaagagcagaggaggccagttcctgacccccctgggcagccctgaggacatggacctggaggagctgatccaggacatcagccggctgcagaggaggagcctgcggcacagccggcagctggaggtgccccggccctacatcgccgcccgcttctctgtgctgccccccaccttccaccctggggaccagaagcagtatggaggctttgacaacagaggcctggagcccggccacagatatgtgctgtttgtgctggccgtgctgcagaagtctgagcccacctttgctgccagccccttcagtgaccccttccagctggacaacccagacccccagcccatcgtggatggagaggagggcctcatctgggtgattggccctgtgctggccgtggtgttcatcatctgcatcgtcatcgccatcctgctgtacaagaagaagccccacagcaagaggaaggacagcgagcccaggaccaagtgcctgctgaacaatgctgacctggccccccaccaccccaaggaccctgtggagatgaggcgcatcaacttccagaccccagacagcggcctgcggagccccctgcgggagcccggcttccactttgagagcatgctgagccacccccccatccccatcgctgacatggccgagcacacagagcggctgaaggccaatgacagcctgaagctgagccaggagtatgagagcattgatcctggccagcagttcacctgggagcacagcaacctggaggtgaacaagcccaagaacagatatgccaacgtgattgcctatgaccacagcagggtcatcctgcagcccatcgagggcatcatgggcagtgactacatcaatgccaactacgtggatggctaccgctgccagaatgcctacatcgccacccagggccccctgcctgagacctttggagacttctggaggatggtgtgggagcagaggtctgccaccatcgtgatgatgacccggctggaggagaagagccgcatcaagtgtgaccagtactggcccaacagaggaacagagacctacggcttcatccaggtgaccctgctggacaccatcgagctggccaccttctgtgtgaggaccttcagcctgcacaagaatggcagcagcgagaagcgggaggtgcggcagttccagttcaccgcctggccagaccatggagtgcctgagtaccccacccccttcctggccttcctgcggcgggtgaagacctgcaaccccccagatgctggccccatcgtggtgcactgcagcgctggggtgggccgcacaggctgcttcatcgtgattgatgccatgctggagcgcatcaagccagagaagacagtggatgtgtatggccacgtgaccctgatgaggagccagaggaactacatggtgcagacagaggaccagtacagcttcatccacgaggccctgctggaggccgtgggctgcggcaacacagaggtgcctgcccggagcctgtatgcctacatccagaagctggcccaggtggagcccggggagcacgtgacaggcatggagctggagttcaagaggctggccaacagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagaacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagtctggagagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgaaggagtggtggacatcttccagacagtgaagatgctgcggacccagaggcctgccatggtgcagacagaagatgagtaccagttctgctaccaggccgccctggagtacctgggcagctttgaccactacgccacctag

SEQ ID NO: 166387 - DNA, 4683 bp, Artificial Sequence
  Description of Artificial Sequence: Synthetic coding sequence
cgcagcgcccggggcctgtctgtgcgggacagaggagccatccccctgcagggcggggacagaagaagcctgcccagcatggcccccacctggggccctggcatggtgtctgtggtgggccccatgggcctgctggtggtgctgctggtgggcggctgtgccgctgaggagcccccacgcttcatcaaggagcccaaggaccagattggagtgtctgggggcgtggccagctttgtgtgccaggccactggagaccccaagccccgggtgacctggaacaagaagggcaagaaggtgaacagccagagatttgagaccattgaatttgatgagagcgctggagctgtgctgcgcatccagcccctgcggaccccaagagatgaaaatgtgtatgaatgtgtggcccagaacagcgtgggggagatcaccgtgcacgccaagctgactgtgctgcgggaggaccagctgcccagcggcttccccaacatcgacatgggcccccagctgaaggtggtggagaggaccaggacagccaccatgctgtgtgccgccagcggcaacccagaccctgagatcacctggttcaaggacttcctgcctgtggaccccagcgccagcaatggccgcatcaagcagctgcggagcggggccctgcagatcgagagcagcgaggagacagaccagggcaagtatgaatgtgtggccaccaacagcgctggggtgcgctacagcagccctgccaacctgtatgtgcgggtgcggcgggtggccccccgcttcagcatcctgcccatgagccatgagatcatgcctggaggaaatgtgaacatcacctgtgtggccgtgggcagccccatgccctacgtgaagtggatgcagggcgctgaggacctgaccccagaagatgacatgcctgtgggcagaaatgtgctggagctgacagatgtgaaggacagcgccaactacacctgtgtggccatgagcagcctgggcgtgattgaagctgtggcccagatcaccgtgaagagcctgcccaaggcccctggcacccccatggtgacagaaaatacagccaccagcatcaccatcacctgggacagcggcaacccagaccctgtgtcctactacgtgattgagtacaagagcaagagccaggacggcccctaccagatcaaggaggacatcaccaccacccgctacagcatcggcggcctgagccccaacagtgaatatgagatctgggtgtctgctgtgaacagcatcggccagggccccccatctgagagcgtggtgaccaggactggagagcaggccccagccagcgcccccagaaatgtgcaggccaggatgctgagcgccaccaccatgattgtgcagtgggaggagcctgtggagcccaacggcctcatccggggctacagagtgtactacaccatggagcctgagcaccctgtgggcaactggcagaagcacaacgtggatgacagcctgctgaccaccgtgggcagcctgctggaggatgagacctacacagtgcgggtgctggccttcacctctgtgggagatggccccctgagtgaccccatccaggtgaagacccagcagggcgtgcccggccagcccatgaacctgcgggcagaggcccggtctgagaccagcatcaccctgtcctggagccccccccggcaggagagcatcatcaagtatgagctgctcttccgggagggggaccacggccgggaggtgggccgcacctttgaccccaccaccagctatgtggtggaggacctgaagcccaacacagaatatgccttccggctggccgcccggagcccccagggcctgggcgccttcacccctgtggtgcggcagaggaccctgcagagcatcagccccaagaacttcaaggtgaagatgatcatgaagacctctgtgctgctgtcctgggagttcccagacaactacaacagccccaccccctacaagatccagtacaacggcctgaccctggatgtggatggccgcaccaccaagaagctgatcacccacctgaagccccacaccttctacaactttgtgctgaccaacagaggcagcagcctgggcggcctgcagcagacagtgacagcctggacagccttcaacctgctgaatggcaagcccagcgtggcccccaagccagatgctgatggcttcatcatggtgtacctgcctgatggccagagccctgtgcctgtgcagagctacttcatcgtgatggtgcccctgaggaagagcagaggaggccagttcctgacccccctgggcagccctgaggacatggacctggaggagctgatccaggacatcagccggctgcagaggaggagcctgcggcacagccggcagctggaggtgccccggccctacatcgccgcccgcttctctgtgctgccccccaccttccaccctggggaccagaagcagtatggaggctttgacaacagaggcctggagcccggccacagatatgtgctgtttgtgctggccgtgctgcagaagtctgagcccacctttgctgccagccccttcagtgaccccttccagctggacaacccagacccccagcccatcgtggatggagaggagggcctcatctgggtgattggccctgtgctggccgtggtgttcatcatctgcatcgtcatcgccatcctgctgtacaagaacaagccagacagcaagaggaaggacagcgagcccaggaccaagtgcctgctgaacaatgctgacctggccccccaccaccccaaggaccctgtggagatgaggcgcatcaacttccagaccccagacagcggcctgcggagccccctgcgggagcccggcttccactttgagagcatgctgagccacccccccatccccatcgctgacatggccgagcacacagagcggctgaaggccaatgacagcctgaagctgagccaggagtatgagagcattgatcctggccagcagttcacctgggagcacagcaacctggaggtgaacaagcccaagaacagatatgccaacgtgattgcctatgaccacagcagggtcatcctgcagcccatcgagggcatcatgggcagtgactacatcaatgccaactacgtggatggctaccgctgccagaatgcctacatcgccacccagggccccctgcctgagacctttggagacttctggaggatggtgtgggagcagaggtctgccaccatcgtgatgatgacccggctggaggagaagagccgcatcaagtgtgaccagtactggcccaacagaggaacagagacctacggcttcatccaggtgaccctgctggacaccatcgagctggccaccttctgtgtgaggaccttcagcctgcacaagaatggcagcagcgagaagcgggaggtgcggcagttccagttcaccgcctggccagaccatggagtgcctgagtaccccacccccttcctggccttcctgcggcgggtgaagacctgcaaccccccagatgctggccccatcgtggtgcactgcagcgctggggtgggccgcacaggctgcttcatcgtgattgatgccatgctggagcgcatcaagccagagaagacagtggatgtgtatggccacgtgaccctgatgaggagccagaggaactacatggtgcagacagaggaccagtacagcttcatccacgaggccctgctggaggccgtgggctgcggcaacacagaggtgcctgcccggagcctgtatgcctacatccagaagctggcccaggtggagcccggggagcacgtgacaggcatggagctggagttcaagaggctggccaacagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagaacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagtctggagagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgaaggagtggtggacatcttccagacagtgaagatgctgcggacccagaggcctgccatggtgcagacagaaacagagagccggcccggctggagcgctgtggcccagagccggctgacagccagcagcgcctcctggattcatgccatcctgctgccccagcccccagagtggctgggcctgcaggtgtag

SEQ ID NO: 166388 - DNA, 4518 bp, Artificial Sequence
  Description of Artificial Sequence: Synthetic coding sequence
atggcccccacctggggccctggcatggtgtctgtggtgggccccatgggcctgctggtggtgctgctggtgggcggctgtgccgctgaggagcccccacgcttcatcaaggagcccaaggaccagattggagtgtctgggggcgtggccagctttgtgtgccaggccactggagaccccaagccccgggtgacctggaacaagaagggcaagaaggtgaacagccagagatttgagaccattgaatttgatgagagcgctggagctgtgctgcgcatccagcccctgcggaccccaagagatgaaaatgtgtatgaatgtgtggcccagaacagcgtgggggagatcaccgtgcacgccaagctgactgtgctgcgggaggaccagctgcccagcggcttccccaacatcgacatgggcccccagctgaaggtggtggagaggaccaggacagccaccatgctgtgtgccgccagcggcaacccagaccctgagatcacctggttcaaggacttcctgcctgtggaccccagcgccagcaatggccgcatcaagcagctgcggagcggggccctgcagatcgagagcagcgaggagacagaccagggcaagtatgaatgtgtggccaccaacagcgctggggtgcgctacagcagccctgccaacctgtatgtgcgggccctgcgggaggtgcggcgggtggccccccgcttcagcatcctgcccatgagccatgagatcatgcctggaggaaatgtgaacatcacctgtgtggccgtgggcagccccatgccctacgtgaagtggatgcagggcgctgaggacctgaccccagaagatgacatgcctgtgggcagaaatgtgctggagctgacagatgtgaaggacagcgccaactacacctgtgtggccatgagcagcctgggcgtgattgaagctgtggcccagatcaccgtgaagagcctgcccaaggcccctggcacccccatggtgacagaaaatacagccaccagcatcaccatcacctgggacagcggcaacccagaccctgtgtcctactacgtgattgagtacaagagcaagagccaggacggcccctaccagatcaaggaggacatcaccaccacccgctacagcatcggcggcctgagccccaacagtgaatatgagatctgggtgtctgctgtgaacagcatcggccagggccccccatctgagagcgtggtgaccaggactggagagcaggccccagccagcgcccccagaaatgtgcaggccaggatgctgagcgccaccaccatgattgtgcagtgggaggagcctgtggagcccaacggcctcatccggggctacagagtgtactacaccatggagcctgagcaccctgtgggcaactggcagaagcacaacgtggatgacagcctgctgaccaccgtgggcagcctgctggaggatgagacctacacagtgcgggtgctggccttcacctctgtgggagatggccccctgagtgaccccatccaggtgaagacccagcagggcgtgcccggccagcccatgaacctgcgggcagaggcccggtctgagaccagcatcaccctgtcctggagccccccccggcaggagagcatcatcaagtatgagctgctcttccgggagggggaccacggccgggaggtgggccgcacctttgaccccaccaccagctatgtggtggaggacctgaagcccaacacagaatatgccttccggctggccgcccggagcccccagggcctgggcgccttcacccctgtggtgcggcagaggaccctgcagagcatcagccccaagaacttcaaggtgaagatgatcatgaagacctctgtgctgctgtcctgggagttcccagacaactacaacagccccaccccctacaagatccagtacaacggcctgaccctggatgtggatggccgcaccaccaagaagctgatcacccacctgaagccccacaccttctacaactttgtgctgaccaacagaggcagcagcctgggcggcctgcagcagacagtgacagcctggacagccttcaacctgctgaatggcaagcccagcgtggcccccaagccagatgctgatggcttcatcatggtgtacctgcctgatggccagagccctgtgcctgtgcagagctacttcatcgtgatggtgcccctgaggaagagcagaggaggccagttcctgacccccctgggcagccctgaggacatggacctggaggagctgatccaggacatcagccggctgcagaggaggagcctgcggcacagccggcagctggaggtgccccggccctacatcgccgcccgcttctctgtgctgccccccaccttccaccctggggaccagaagcagtatggaggctttgacaacagaggcctggagcccggccacagatatgtgctgtttgtgctggccgtgctgcagaagtctgagcccacctttgctgccagccccttcagtgaccccttccagctggacaacccagacccccagcccatcgtggatggagaggagggcctcatctgggtgattggccctgtgctggccgtggtgttcatcatctgcatcgtcatcgccatcctgctgtacaagaacaagccagacagcaagaggaaggacagcgagcccaggaccaagtgcctgctgaacaatgctgacctggccccccaccaccccaaggaccctgtggagatgaggcgcatcaacttccagaccccaggcatgctgagccacccccccatccccatcgctgacatggccgagcacacagagcggctgaaggccaatgacagcctgaagctgagccaggagtatgagagcattgatcctggccagcagttcacctgggagcacagcaacctggaggtgaacaagcccaagaacagatatgccaacgtgattgcctatgaccacagcagggtcatcctgcagcccatcgagggcatcatgggcagtgactacatcaatgccaactacgtggatggctaccgctgccagaatgcctacatcgccacccagggccccctgcctgagacctttggagacttctggaggatggtgtgggagcagaggtctgccaccatcgtgatgatgacccggctggaggagaagagccgcatcaagtgtgaccagtactggcccaacagaggaacagagacctacggcttcatccaggtgaccctgctggacaccatcgagctggccaccttctgtgtgaggaccttcagcctgcacaagaatggcagcagcgagaagcgggaggtgcggcagttccagttcaccgcctggccagaccatggagtgcctgagtaccccacccccttcctggccttcctgcggcgggtgaagacctgcaaccccccagatgctggccccatcgtggtgcactgcagcgctggggtgggccgcacaggctgcttcatcgtgattgatgccatgctggagcgcatcaagccagagaagacagtggatgtgtatggccacgtgaccctgatgaggagccagaggaactacatggtgcagacagaggaccagtacagcttcatccacgaggccctgctggaggccgtgggctgcggcaacacagaggtgcctgcccggagcctgtatgcctacatccagaagctggcccaggtggagcccggggagcacgtgacaggcatggagctggagttcaagaggctggccaacagcaaggcccacaccagccgcttcatcagcgccaacctgccctgcaacaagttcaagaaccggctggtgaacatcatgccctatgagagcaccagggtgtgcctgcagcccatccggggcgtggagggcagtgactacatcaatgccagcttcattgatggctaccggcagcagaaggcctacatcgccacccagggccccctggccgagaccacagaggacttctggaggatgctgtgggagaacaacagcaccatcgtggtgatgctgaccaagctgcgggagatgggccgggagaagtgccaccagtactggccagctgagaggtctgcccgctaccagtactttgtggtggaccccatggccgagtacaacatgccccagtacatcctgcgggagttcaaggtgacagatgccagagatggccagagcaggacagtgcggcagttccagttcacagactggccagagcagggcgtgcccaagtctggagagggcttcatcgacttcatcggccaggtgcacaagaccaaggagcagtttggccaggacggccccatctctgtgcactgcagcgctggggtgggccgcactggagtcttcatcaccctgagcatcgtgctggagaggatgagatatgaaggagtggtggacatcttccagacagtgaagatgctgcggacccagaggcctgccatggtgcagacagaagatgagtaccagttctgctaccaggccgccctggagtacctgggcagctttgaccactacgccacctag

SEQ ID NO: 166389 - DNA, 4329 bp, Artificial Sequence
  Description of Artificial Sequence: Synthetic coding sequence
atggcccgggcccaggccctggtgctggccctgaccttccagctgtgtgcccctgagacagagaccccagctgctggctgcacctttgaggaggccagtgaccctgctgtgccctgtgagtacagccaggcccagtatgatgacttccagtgggagcaggtgcgcatccaccctggcacccgggccccagctgacctgccccacggcagctacctgatggtgaacaccagccagcacgcccctggccagagggcccacgtgatcttccagagcctgtctgaaaatgacacccactgtgtgcagttctcctacttcctgtacagcagagatggccacagccctggcaccctgggcgtgtatgtgcgggtgaatggaggccccctgggcagcgctgtgtggaacatgacaggcagccacggccggcagtggcaccaggccgagctggccgtgtccaccttctggcccaatgagtaccaggtgctgtttgaggccctgatcagcccagaccggcggggctacatgggcctggatgacatcctgctgctgagctacccctgtgccaaggccccccacttcagccggctgggagatgtggaggtgaatgccggccagaatgccagcttccagtgcatggctgctggccgggctgctgaggccgagcgcttcctgctgcagaggcagagcggggccctggtgcctgctgctggggtgcgccacatcagccaccggcgcttcctggccaccttccccctggccgctgtgtccagagctgagcaggacctgtaccgctgtgtgtcccaggcccccaggggggccggcgtgagcaactttgctgagctgattgtgaaggagccccccacccccatcgccccaccccagctgctgcgggccggccccacctacctgatcatccagctgaacaccaacagcatcattggagatggccccatcgtgaggaaggagattgagtacaggatggcccggggcccctgggccgaggtgcatgctgtgtccctgcagacctacaagctgtggcacctggaccctgacacagaatatgagatctctgtgctgctgaccaggcctggagatggcggcaccggccggcccggccccccactcatcagcaggaccaagtgtgccgagcccatgagggcccccaagggcctggcctttgctgagatccaggcccggcagctgaccctgcagtgggagcccctgggctacaacgtgacccgctgccacacctacacagtgtccctgtgctaccactacaccctgggcagcagccacaaccagaccatcagagaatgtgtgaagacagagcagggcgtgagccgctacaccatcaagaacctgctgccctacagaaatgtgcacgtgcggctggtgctgaccaaccctgagggcaggaaggagggcaaggaggtgaccttccagacagatgaagatgtgcccagcggcattgctgctgagagcctgaccttcacccccctggaggacatgatcttcctgaagtgggaggagccccaggagcccaacggcctcatcacccagtatgagatctcctaccagagcattgagagcagtgaccctgctgtgaatgtgcccggccccaggaggaccatcagcaagctgagaaatgagacctaccacgtgttcagcaacctgcaccctggcaccacctacctgttctctgtgcgggccaggactggaaaaggatttggccaggccgccctgacagagatcaccaccaacatcagcgcccccagctttgattatgctgacatgcccagccccctgggggagagcgagaacaccatcaccgtgctgctgcggcctgcccagggccgcggggcccccatctctgtgtaccaggtgattgtggaggaggagcgggcccggcggctgcggcgggagcccggcggccaggactgcttccctgtgcccctgacctttgaagctgccctggcccggggcctggtgcactactttggagctgagctggccgccagcagcctgcctgaggccatgcccttcaccgtgggggacaaccagacctaccggggcttctggaacccccccctggagcccaggaaggcctacctgatctacttccaggccgccagccacctgaagggggagacccggctgaactgcatcagaattgccaggaaggccgcctgcaaggagagcaagaggcccctggaggtgtcccagaggtctgaggagatgggcctcatcctgggcatctgtgccggcggcctggccgtgctgatcctgctgctgggcgccatcatcgtcatcatcaggaagggcaagcctgtgaacatgaccaaggccaccgtgaactaccggcaggagaagacccacatgatgtctgctgtggaccgctccttcacagaccagagcaccctgcaggaggatgagcggctgggcctgtccttcatggacacccacggctacagcaccaggggggaccagaggtctgggggcgtgacagaggccagcagcctgctgggcggcagcccccggcggccctgtggcaggaagggcagcccctaccacacaggccagctgcaccctgctgtgcgggtggccgacctgctgcagcacatcaaccagatgaagacagctgagggctacggcttcaagcaggagtatgagagcttctttgagggctgggatgccaccaagaagaaggacaaggtgaagggcagccggcaggagcccatgcctgcctatgacagacaccgggtgaagctgcaccccatgctgggggaccccaatgctgactacatcaatgccaactacatcgacctgcggggcggccgcacaggctaccacaggagcaaccacttcatcgccacccagggccccaagccagagatggtgtatgacttctggaggatggtgtggcaggagcactgcagcagcatcgtgatgatcaccaagctggtggaggtgggccgggtgaagtgcagccgctactggccagaggacagcgacacctatggagacatcaagatcatgctggtgaagacagagaccctggccgagtatgtggtgaggacctttgccctggagcggcggggctacagcgcccggcatgaggtgcggcagttccacttcaccgcctggccagagcacggcgtgccctaccacgccaccggcctgctggccttcatccggcgggtgaaggccagcaccccaccagatgctggccccatcgtcatccactgcagcgctggcactggaagaacaggctgctacatcgtgctggatgtgatgctggacatggccgagtgtgaaggagtggtggacatctacaactgtgtgaagaccctgtgcagcagaagagtgaacatgatccagacagaggagcagtacatcttcatccatgatgccatcctggaggcctgcctgtgtggggagaccaccatccctgtgtctgagttcaaggccacctacaaggagatgatcagaattgacccccagagcaacagcagccagctgcgggaggagttccagaccctgaacagcgtgaccccacccctggatgtggaggagtgcagcatcgccctgctgcccaggaacagagacaagaacagatccatggatgtgctgcccccagaccgctgcctgcccttcctgatcagcacagatggagacagcaacaactacatcaatgctgccctgacagacagctacaccaggtctgctgccttcatcgtgaccctgcaccccctgcagagcaccaccccagacttctggaggctggtgtatgactatggctgcaccagcatcgtgatgctgaaccagctgaaccagagcaacagcgcctggccctgcctgcagtactggccagagcccggccggcagcagtatggcctgatggaggtggagttcatgtctggaacagcagatgaggacctggtggcccgggtcttccgggtgcagaacatcagccggctgcaggagggccacctgctggtgcgccacttccagttcctgcgctggagcgcctacagagacaccccagacagcaagaaggccttcctgcacctgctggccgaggtggacaagtggcaggccgagagcggagatggccgcaccatcgtgcactgcctgaatggaggcggccgcagcggcaccttctgtgcctgtgccaccgtgctggagatgatccgctgccacaacctggtggatgtgttctttgctgccaagaccctgaggaactacaagcccaacatggtggagaccatggaccagtaccacttctgctatgatgtggccctggagtacctggagggcctggagagcaggtag

SEQ ID NO: 166390 - DNA, 4341 bp, Artificial Sequence
  Description of Artificial Sequence: Synthetic coding sequence
atggcccgggcccaggccctggtgctggccctgaccttccagctgtgtgcccctgagacagagaccccagctgctggctgcacctttgaggaggccagtgaccctgctgtgccctgtgagtacagccaggcccagtatgatgacttccagtgggagcaggtgcgcatccaccctggcacccgggccccagctgacctgccccacggcagctacctgatggtgaacaccagccagcacgcccctggccagagggcccacgtgatcttccagagcctgtctgaaaatgacacccactgtgtgcagttctcctacttcctgtacagcagagatggccacagccctggcaccctgggcgtgtatgtgcgggtgaatggaggccccctgggcagcgctgtgtggaacatgacaggcagccacggccggcagtggcaccaggccgagctggccgtgtccaccttctggcccaatgagtaccaggtgctgtttgaggccctgatcagcccagaccggcggggctacatgggcctggatgacatcctgctgctgagctacccctgtgccaaggccccccacttcagccggctgggagatgtggaggtgaatgccggccagaatgccagcttccagtgcatggctgctggccgggctgctgaggccgagcgcttcctgctgcagaggcagagcggggccctggtgcctgctgctggggtgcgccacatcagccaccggcgcttcctggccaccttccccctggccgctgtgtccagagctgagcaggacctgtaccgctgtgtgtcccaggcccccaggggggccggcgtgagcaactttgctgagctgattgtgaaggagccccccacccccatcgccccaccccagctgctgcgggccggccccacctacctgatcatccagctgaacaccaacagcatcattggagatggccccatcgtgaggaaggagattgagtacaggatggcccggggcccctgggccgaggtgcatgctgtgtccctgcagacctacaagctgtggcacctggaccctgacacagaatatgagatctctgtgctgctgaccaggcctggagatggcggcaccggccggcccggccccccactcatcagcaggaccaagtgtgccgagcccatgagggcccccaagggcctggcctttgctgagatccaggcccggcagctgaccctgcagtgggagcccctgggctacaacgtgacccgctgccacacctacacagtgtccctgtgctaccactacaccctgggcagcagccacaaccagaccatcagagaatgtgtgaagacagagcagggcgtgagccgctacaccatcaagaacctgctgccctacagaaatgtgcacgtgcggctggtgctgaccaaccctgagggcaggaaggagggcaaggaggtgaccttccagacagatgaagatgtgcccagcggcattgctgctgagagcctgaccttcacccccctggaggacatgatcttcctgaagtgggaggagccccaggagcccaacggcctcatcacccagtatgagatctcctaccagagcattgagagcagtgaccctgctgtgaatgtgcccggccccaggaggaccatcagcaagctgagaaatgagacctaccacgtgttcagcaacctgcaccctggcaccacctacctgttctctgtgcgggccaggactggaaaaggatttggccaggccgccctgacagagatcaccaccaacatcagcgcccccagctttgattatgctgacatgcccagccccctgggggagagcgagaacaccatcaccgtgctgctgcggcctgcccagggccgcggggcccccatctctgtgtaccaggtgattgtggaggaggagcgggcccggcggctgcggcgggagcccggcggccaggactgcttccctgtgcccctgacctttgaagctgccctggcccggggcctggtgcactactttggagctgagctggccgccagcagcctgcctgaggccatgcccttcaccgtgggggacaaccagacctaccggggcttctggaacccccccctggagcccaggaaggcctacctgatctacttccaggccgccagccacctgaagggggagacccggctgaactgcatcagaattgccaggaaggccgcctgcaaggagagcaagaggcccctggaggtgtcccagaggtctgaggagatgggcctcatcctgggcatctgtgccggcggcctggccgtgctgatcctgctgctgggcgccatcatcgtcatcatcaggaagggccgggaccactacgcctacagctactaccccaagcctgtgaacatgaccaaggccaccgtgaactaccggcaggagaagacccacatgatgtctgctgtggaccgctccttcacagaccagagcaccctgcaggaggatgagcggctgggcctgtccttcatggacacccacggctacagcaccaggggggaccagaggtctgggggcgtgacagaggccagcagcctgctgggcggcagcccccggcggccctgtggcaggaagggcagcccctaccacacaggccagctgcaccctgctgtgcgggtggccgacctgctgcagcacatcaaccagatgaagacagctgagggctacggcttcaagcaggagtatgagagcttctttgagggctgggatgccaccaagaagaaggacaaggtgaagggcagccggcaggagcccatgcctgcctatgacagacaccgggtgaagctgcaccccatgctgggggaccccaatgctgactacatcaatgccaactacattgatggctaccacaggagcaaccacttcatcgccacccagggccccaagccagagatggtgtatgacttctggaggatggtgtggcaggagcactgcagcagcatcgtgatgatcaccaagctggtggaggtgggccgggtgaagtgcagccgctactggccagaggacagcgacacctatggagacatcaagatcatgctggtgaagacagagaccctggccgagtatgtggtgaggacctttgccctggagcggcggggctacagcgcccggcatgaggtgcggcagttccacttcaccgcctggccagagcacggcgtgccctaccacgccaccggcctgctggccttcatccggcgggtgaaggccagcaccccaccagatgctggccccatcgtcatccactgcagcgctggcactggaagaacaggctgctacatcgtgctggatgtgatgctggacatggccgagtgtgaaggagtggtggacatctacaactgtgtgaagaccctgtgcagcagaagagtgaacatgatccagacagaggagcagtacatcttcatccatgatgccatcctggaggcctgcctgtgtggggagaccaccatccctgtgtctgagttcaaggccacctacaaggagatgatcagaattgacccccagagcaacagcagccagctgcgggaggagttccagaccctgaacagcgtgaccccacccctggatgtggaggagtgcagcatcgccctgctgcccaggaacagagacaagaacagatccatggatgtgctgcccccagaccgctgcctgcccttcctgatcagcacagatggagacagcaacaactacatcaatgctgccctgacagacagctacaccaggtctgctgccttcatcgtgaccctgcaccccctgcagagcaccaccccagacttctggaggctggtgtatgactatggctgcaccagcatcgtgatgctgaaccagctgaaccagagcaacagcgcctggccctgcctgcagtactggccagagcccggccggcagcagtatggcctgatggaggtggagttcatgtctggaacagcagatgaggacctggtggcccgggtcttccgggtgcagaacatcagccggctgcaggagggccacctgctggtgcgccacttccagttcctgcgctggagcgcctacagagacaccccagacagcaagaaggccttcctgcacctgctggccgaggtggacaagtggcaggccgagagcggagatggccgcaccatcgtgcactgcctgaatggaggcggccgcagcggcaccttctgtgcctgtgccaccgtgctggagatgatccgctgccacaacctggtggatgtgttctttgctgccaagaccctgaggaactacaagcccaacatggtggagaccatggaccagtaccacttctgctatgatgtggccctggagtacctggagggcctggagagcaggtag

SEQ ID NO: 166391 - DNA, 4329 bp, Artificial Sequence
  Description of Artificial Sequence: Synthetic coding sequence
atggcccgggcccaggccctggtgctggccctgaccttccagctgtgtgcccctgagacagagaccccagctgctggctgcacctttgaggaggccagtgaccctgctgtgccctgtgagtacagccaggcccagtatgatgacttccagtgggagcaggtgcgcatccaccctggcacccgggccccagctgacctgccccacggcagctacctgatggtgaacaccagccagcacgcccctggccagagggcccacgtgatcttccagagcctgtctgaaaatgacacccactgtgtgcagttctcctacttcctgtacagcagagatggccacagccctggcaccctgggcgtgtatgtgcgggtgaatggaggccccctgggcagcgctgtgtggaacatgacaggcagccacggccggcagtggcaccaggccgagctggccgtgtccaccttctggcccaatgagtaccaggtgctgtttgaggccctgatcagcccagaccggcggggctacatgggcctggatgacatcctgctgctgagctacccctgtgccaaggccccccacttcagccggctgggagatgtggaggtgaatgccggccagaatgccagcttccagtgcatggctgctggccgggctgctgaggccgagcgcttcctgctgcagaggcagagcggggccctggtgcctgctgctggggtgcgccacatcagccaccggcgcttcctggccaccttccccctggccgctgtgtccagagctgagcaggacctgtaccgctgtgtgtcccaggcccccaggggggccggcgtgagcaactttgctgagctgattgtgaaggagccccccacccccatcgccccaccccagctgctgcgggccggccccacctacctgatcatccagctgaacaccaacagcatcattggagatggccccatcgtgaggaaggagattgagtacaggatggcccggggcccctgggccgaggtgcatgctgtgtccctgcagacctacaagctgtggcacctggaccctgacacagaatatgagatctctgtgctgctgaccaggcctggagatggcggcaccggccggcccggccccccactcatcagcaggaccaagtgtgccgagcccatgagggcccccaagggcctggcctttgctgagatccaggcccggcagctgaccctgcagtgggagcccctgggctacaacgtgacccgctgccacacctacacagtgtccctgtgctaccactacaccctgggcagcagccacaaccagaccatcagagaatgtgtgaagacagagcagggcgtgagccgctacaccatcaagaacctgctgccctacagaaatgtgcacgtgcggctggtgctgaccaaccctgagggcaggaaggagggcaaggaggtgaccttccagacagatgaagatgtgcccagcggcattgctgctgagagcctgaccttcacccccctggaggacatgatcttcctgaagtgggaggagccccaggagcccaacggcctcatcacccagtatgagatctcctaccagagcattgagagcagtgaccctgctgtgaatgtgcccggccccaggaggaccatcagcaagctgagaaatgagacctaccacgtgttcagcaacctgcaccctggcaccacctacctgttctctgtgcgggccaggactggaaaaggatttggccaggccgccctgacagagatcaccaccaacatcagcgcccccagctttgattatgctgacatgcccagccccctgggggagagcgagaacaccatcaccgtgctgctgcggcctgcccagggccgcggggcccccatctctgtgtaccaggtgattgtggaggaggagcgggcccggcggctgcggcgggagcccggcggccaggactgcttccctgtgcccctgacctttgaagctgccctggcccggggcctggtgcactactttggagctgagctggccgccagcagcctgcctgaggccatgcccttcaccgtgggggacaaccagacctaccggggcttctggaacccccccctggagcccaggaaggcctacctgatctacttccaggccgccagccacctgaagggggagacccggctgaactgcatcagaattgccaggaaggccgcctgcaaggagagcaagaggcccctggaggtgtcccagaggtctgaggagatgggcctcatcctgggcatctgtgccggcggcctggccgtgctgatcctgctgctgggcgccatcatcgtcatcatcaggaagggcaagcctgtgaacatgaccaaggccaccgtgaactaccggcaggagaagacccacatgatgtctgctgtggaccgctccttcacagaccagagcaccctgcaggaggatgagcggctgggcctgtccttcatggacacccacggctacagcaccaggggggaccagaggtctgggggcgtgacagaggccagcagcctgctgggcggcagcccccggcggccctgtggcaggaagggcagcccctaccacacaggccagctgcaccctgctgtgcgggtggccgacctgctgcagcacatcaaccagatgaagacagctgagggctacggcttcaagcaggagtatgagagcttctttgagggctgggatgccaccaagaagaaggacaaggtgaagggcagccggcaggagcccatgcctgcctatgacagacaccgggtgaagctgcaccccatgctgggggaccccaatgctgactacatcaatgccaactacatcgacatccgcatcaaccgggagggctaccacaggagcaaccacttcatcgccacccagggccccaagccagagatggtgtatgacttctggaggatggtgtggcaggagcactgcagcagcatcgtgatgatcaccaagctggtggaggtgggccgggtgaagtgcagccgctactggccagaggacagcgacacctatggagacatcaagatcatgctggtgaagacagagaccctggccgagtatgtggtgaggacctttgccctggagcggcggggctacagcgcccggcatgaggtgcggcagttccacttcaccgcctggccagagcacggcgtgccctaccacgccaccggcctgctggccttcatccggcgggtgaaggccagcaccccaccagatgctggccccatcgtcatccactgcagcgctggcactggaagaacaggctgctacatcgtgctggatgtgatgctggacatggccgagtgtgaaggagtggtggacatctacaactgtgtgaagaccctgtgcagcagaagagtgaacatgatccagacagaggagcagtacatcttcatccatgatgccatcctggaggcctgcctgtgtggggagaccaccatccctgtgtctgagttcaaggccacctacaaggagatgatcagaattgacccccagagcaacagcagccagctgcgggaggagttccagaccctgaacagcgtgaccccacccctggatgtggaggagtgcagcatcgccctgctgcccaggaacagagacaagaacagatccatggatgtgctgcccccagaccgctgcctgcccttcctgatcagcacagatggagacagcaacaactacatcaatgctgccctgacagacagctacaccaggtctgctgccttcatcgtgaccctgcaccccctgcagagcaccaccccagacttctggaggctggtgtatgactatggctgcaccagcatcgtgatgctgaaccagctgaaccagagcaacagcgcctggccctgcctgcagtactggccagagcccggccggcagcagtatggcctgatggaggtggagttcatgtctggaacagcagatgaggacctggtggcccgggtcttccgggtgcagaacatcagccggctgcaggagggccacctgctggtgcgccacttccagttcctgcgctggagcgcctacagagacaccccagacagcaagaaggccttcctgcacctgctggccgaggtggacaagtggcaggccgagagcggagatggccgcaccatcgtgcactgcctgaatggaggcggccgcagcggcaccttctgtgcctgtgccaccgtgctggagatgatccgctgccacaacctggtggatgtgttctttgctgccaagaccctgaggaactacaagcccaacatggtggagaccatggaccagtaccacttctgctatgatgtggccctggagtacctggagggcctggagagcaggtag

SEQ ID NO: 166392 - DNA, 4311 bp, Artificial Sequence
  Description of Artificial Sequence: Synthetic coding sequence
atggcccgggcccaggccctggtgctggccctgaccttccagctgtgtgcccctgagacagagaccccagctgctggctgcacctttgaggaggccagtgaccctgctgtgccctgtgagtacagccaggcccagtatgatgacttccagtgggagcaggtgcgcatccaccctggcacccgggccccagctgacctgccccacggcagctacctgatggtgaacaccagccagcacgcccctggccagagggcccacgtgatcttccagagcctgtctgaaaatgacacccactgtgtgcagttctcctacttcctgtacagcagagatggccacagccctggcaccctgggcgtgtatgtgcgggtgaatggaggccccctgggcagcgctgtgtggaacatgacaggcagccacggccggcagtggcaccaggccgagctggccgtgtccaccttctggcccaatgagtaccaggtgctgtttgaggccctgatcagcccagaccggcggggctacatgggcctggatgacatcctgctgctgagctacccctgtgccaaggccccccacttcagccggctgggagatgtggaggtgaatgccggccagaatgccagcttccagtgcatggctgctggccgggctgctgaggccgagcgcttcctgctgcagaggcagagcggggccctggtgcctgctgctggggtgcgccacatcagccaccggcgcttcctggccaccttccccctggccgctgtgtccagagctgagcaggacctgtaccgctgtgtgtcccaggcccccaggggggccggcgtgagcaactttgctgagctgattgtgaaggagccccccacccccatcgccccaccccagctgctgcgggccggccccacctacctgatcatccagctgaacaccaacagcatcattggagatggccccatcgtgaggaaggagattgagtacaggatggcccggggcccctgggccgaggtgcatgctgtgtccctgcagacctacaagctgtggcacctggaccctgacacagaatatgagatctctgtgctgctgaccaggcctggagatggcggcaccggccggcccggccccccactcatcagcaggaccaagtgtgccgagcccatgagggcccccaagggcctggcctttgctgagatccaggcccggcagctgaccctgcagtgggagcccctgggctacaacgtgacccgctgccacacctacacagtgtccctgtgctaccactacaccctgggcagcagccacaaccagaccatcagagaatgtgtgaagacagagcagggcgtgagccgctacaccatcaagaacctgctgccctacagaaatgtgcacgtgcggctggtgctgaccaaccctgagggcaggaaggagggcaaggaggtgaccttccagacagatgaagatgtgcccagcggcattgctgctgagagcctgaccttcacccccctggaggacatgatcttcctgaagtgggaggagccccaggagcccaacggcctcatcacccagtatgagatctcctaccagagcattgagagcagtgaccctgctgtgaatgtgcccggccccaggaggaccatcagcaagctgagaaatgagacctaccacgtgttcagcaacctgcaccctggcaccacctacctgttctctgtgcgggccaggactggaaaaggatttggccaggccgccctgacagagatcaccaccaacatcagcgcccccagctttgattatgctgacatgcccagccccctgggggagagcgagaacaccatcaccgtgctgctgcggcctgcccagggccgcggggcccccatctctgtgtaccaggtgattgtggaggaggagcgggcccggcggctgcggcgggagcccggcggccaggactgcttccctgtgcccctgacctttgaagctgccctggcccggggcctggtgcactactttggagctgagctggccgccagcagcctgcctgaggccatgcccttcaccgtgggggacaaccagacctaccggggcttctggaacccccccctggagcccaggaaggcctacctgatctacttccaggccgccagccacctgaagggggagacccggctgaactgcatcagaattgccaggaaggccgcctgcaaggagagcaagaggcccctggaggtgtcccagaggtctgaggagatgggcctcatcctgggcatctgtgccggcggcctggccgtgctgatcctgctgctgggcgccatcatcgtcatcatcaggaagggcaagcctgtgaacatgaccaaggccaccgtgaactaccggcaggagaagacccacatgatgtctgctgtggaccgctccttcacagaccagagcaccctgcaggaggatgagcggctgggcctgtccttcatggacacccacggctacagcaccaggggggaccagaggtctgggggcgtgacagaggccagcagcctgctgggcggcagcccccggcggccctgtggcaggaagggcagcccctaccacacaggccagctgcaccctgctgtgcgggtggccgacctgctgcagcacatcaaccagatgaagacagctgagggctacggcttcaagcaggagtatgagagcttctttgagggctgggatgccaccaagaagaaggacaaggtgaagggcagccggcaggagcccatgcctgcctatgacagacaccgggtgaagctgcaccccatgctgggggaccccaatgctgactacatcaatgccaactacattgatggctaccacaggagcaaccacttcatcgccacccagggccccaagccagagatggtgtatgacttctggaggatggtgtggcaggagcactgcagcagcatcgtgatgatcaccaagctggtggaggtgggccgggtgaagtgcagccgctactggccagaggacagcgacacctatggagacatcaagatcatgctggtgaagacagagaccctggccgagtatgtggtgaggacctttgccctggagcggcggggctacagcgcccggcatgaggtgcggcagttccacttcaccgcctggccagagcacggcgtgccctaccacgccaccggcctgctggccttcatccggcgggtgaaggccagcaccccaccagatgctggccccatcgtcatccactgcagcgctggcactggaagaacaggctgctacatcgtgctggatgtgatgctggacatggccgagtgtgaaggagtggtggacatctacaactgtgtgaagaccctgtgcagcagaagagtgaacatgatccagacagaggagcagtacatcttcatccatgatgccatcctggaggcctgcctgtgtggggagaccaccatccctgtgtctgagttcaaggccacctacaaggagatgatcagaattgacccccagagcaacagcagccagctgcgggaggagttccagaccctgaacagcgtgaccccacccctggatgtggaggagtgcagcatcgccctgctgcccaggaacagagacaagaacagatccatggatgtgctgcccccagaccgctgcctgcccttcctgatcagcacagatggagacagcaacaactacatcaatgctgccctgacagacagctacaccaggtctgctgccttcatcgtgaccctgcaccccctgcagagcaccaccccagacttctggaggctggtgtatgactatggctgcaccagcatcgtgatgctgaaccagctgaaccagagcaacagcgcctggccctgcctgcagtactggccagagcccggccggcagcagtatggcctgatggaggtggagttcatgtctggaacagcagatgaggacctggtggcccgggtcttccgggtgcagaacatcagccggctgcaggagggccacctgctggtgcgccacttccagttcctgcgctggagcgcctacagagacaccccagacagcaagaaggccttcctgcacctgctggccgaggtggacaagtggcaggccgagagcggagatggccgcaccatcgtgcactgcctgaatggaggcggccgcagcggcaccttctgtgcctgtgccaccgtgctggagatgatccgctgccacaacctggtggatgtgttctttgctgccaagaccctgaggaactacaagcccaacatggtggagaccatggaccagtaccacttctgctatgatgtggccctggagtacctggagggcctggagagcaggtag

SEQ ID NO: 166393 - DNA, 4302 bp, Artificial Sequence
  Description of Artificial Sequence: Synthetic coding sequence
atggcccgggcccaggccctggtgctggccctgaccttccagctgtgtgcccctgagacagagaccccagctgctggctgcacctttgaggaggccagtgaccctgctgtgccctgtgagtacagccaggcccagtatgatgacttccagtgggagcaggtgcgcatccaccctggcacccgggccccagctgacctgccccacggcagctacctgatggtgaacaccagccagcacgcccctggccagagggcccacgtgatcttccagagcctgtctgaaaatgacacccactgtgtgcagttctcctacttcctgtacagcagagatggccacagccctggcaccctgggcgtgtatgtgcgggtgaatggaggccccctgggcagcgctgtgtggaacatgacaggcagccacggccggcagtggcaccaggccgagctggccgtgtccaccttctggcccaatgagtaccaggtgctgtttgaggccctgatcagcccagaccggcggggctacatgggcctggatgacatcctgctgctgagctacccctgtgccaaggccccccacttcagccggctgggagatgtggaggtgaatgccggccagaatgccagcttccagtgcatggctgctggccgggctgctgaggccgagcgcttcctgctgcagaggcagagcggggccctggtgcctgctgctggggtgcgccacatcagccaccggcgcttcctggccaccttccccctggccgctgtgtccagagctgagcaggacctgtaccgctgtgtgtcccaggcccccaggggggccggcgtgagcaactttgctgagctgattgtgaaggagccccccacccccatcgccccaccccagctgctgcgggccggccccacctacctgatcatccagctgaacaccaacagcatcattggagatggccccatcgtgaggaaggagattgagtacaggatggcccggggcccctgggccgaggtgcatgctgtgtccctgcagacctacaagctgtggcacctggaccctgacacagaatatgagatctctgtgctgctgaccaggcctggagatggcggcaccggccggcccggccccccactcatcagcaggaccaagtgtgccgagcccatgagggcccccaagggcctggcctttgctgagatccaggcccggcagctgaccctgcagtgggagcccctgggctacaacgtgacccgctgccacacctacacagtgtccctgtgctaccactacaccctgggcagcagccacaaccagaccatcagagaatgtgtgaagacagagcagggcgtgagccgctacaccatcaagaacctgctgccctacagaaatgtgcacgtgcggctggtgctgaccaaccctgagggcaggaaggagggcaaggaggtgaccttccagacagatgaagatgtgcccagcggcattgctgctgagagcctgaccttcacccccctggaggacatgatcttcctgaagtgggaggagccccaggagcccaacggcctcatcacccagtatgagatctcctaccagagcattgagagcagtgaccctgctgtgaatgtgcccggccccaggaggaccatcagcaagctgagaaatgagacctaccacgtgttcagcaacctgcaccctggcaccacctacctgttctctgtgcgggccaggactggaaaaggatttggccaggccgccctgacagagatcaccaccaacatcagcgcccccagctttgattatgctgacatgcccagccccctgggggagagcgagaacaccatcaccgtgctgctgcggcctgcccagggccgcggggcccccatctctgtgtaccaggtgattgtggaggaggagcgggcccggcggctgcggcgggagcccggcggccaggactgcttccctgtgcccctgacctttgaagctgccctggcccggggcctggtgcactactttggagctgagctggccgccagcagcctgcctgaggccatgcccttcaccgtgggggacaaccagacctaccggggcttctggaacccccccctggagcccaggaaggcctacctgatctacttccaggccgccagccacctgaagggggagacccggctgaactgcatcagaattgccaggaaggccgcctgcaaggagagcaagaggcccctggaggtgtcccagaggtctgaggagatgggcctcatcctgggcatctgtgccggcggcctggccgtgctgatcctgctgctgggcgccatcatcgtcatcatcaggaagggcaagcctgtgaacatgaccaaggccaccgtgaactaccggcaggagaagacccacatgatgtctgctgtggaccgctccttcacagaccagagcaccctgcaggaggatgagcggctgggcctgtccttcatggacacccacggctacagcaccaggggggaccagaggtctgggggcgtgacagaggccagcagcctgctgggcggcagcccccggcggccctgtggcaggaagggcagcccctaccacacaggccagctgcaccctgctgtgcgggtggccgacctgctgcagcacatcaaccagatgaagacagctgagggctacggcttcaagcaggagtatgagagcttctttgagggctgggatgccaccaagaagaaggacaaggtgaagggcagccggcaggagcccatgcctgcctatgacagacaccgggtgaagctgcaccccatgctgggggaccccaatgctgactacatcaatgccaactacattgatggctaccacaggagcaaccacttcatcgccacccagggccccaagccagagatggtgtatgacttctggaggatggtgtggcaggagcactgcagcagcatcgtgatgatcaccaagctggtggaggtgaagtgcagccgctactggccagaagattctgacacctacggggacatcaagatcatgctggtgaagacagagaccctggccgagtatgtggtgaggacctttgccctggagcggcggggctacagcgcccggcatgaggtgcggcagttccacttcaccgcctggccagagcacggcgtgccctaccacgccaccggcctgctggccttcatcagaagagtgaaggccagcaccccaccagatgctggccccatcgtcatccactgcagcgctggcaccggccgcacaggctgctacatcgtgctggatgtgatgctggacatggctgaatgtgagggcgtggtggacatctacaactgtgtgaagaccctgtgcagccggcgggtgaacatgatccagacagaggagcagtacatcttcatccatgatgccatcctggaggcctgcctgtgtggggagaccaccatccctgtgtctgagttcaaggccacctacaaggagatgatcagaattgacccccagagcaacagcagccagctgcgggaggagttccagaccctgaacagcgtgaccccacccctggatgtggaggagtgcagcatcgccctgctgcccaggaacagagacaagaacagatccatggatgtgctgcccccagaccgctgcctgcccttcctgatcagcacagatggagacagcaacaactacatcaatgctgccctgacagacagctacaccaggtctgctgccttcatcgtgaccctgcaccccctgcagagcaccaccccagacttctggaggctggtgtatgactatggctgcaccagcatcgtgatgctgaaccagctgaaccagagcaacagcgcctggccctgcctgcagtactggccagagcccggccggcagcagtatggcctgatggaggtggagttcatgagcggcacagcagatgaggacctggtggcccgggtcttccgggtgcagaacatcagccggctgcaggagggccacctgctggtgcgccacttccagttcctgcgctggagcgcctacagagacaccccagacagcaagaaggccttcctgcacctgctggccgaggtggacaagtggcaggccgagagcggagatggccgcaccatcgtgcactgcctgaatggaggcggccgcagcggcaccttctgtgcctgtgccaccgtgctggagatgatccgctgccacaacctggtggatgtgttctttgctgccaagaccctgaggaactacaagcccaacatggtggagaccatggaccagtaccacttctgctatgatgtggccctggagtacctggagggcctggagagcaggtag

SEQ ID NO: 166394 - DNA, 6948 bp, Artificial Sequence
  Description of Artificial Sequence: Synthetic coding sequence
atgaggatcctgaagcgcttcctggcctgcatccagctgctgtgtgtgtgccgcctggactgggccaacggctactaccggcagcagaggaagctggtggaggagatcggctggagctacacaggagccctgaaccagaagaactggggcaagaagtaccccacctgcaacagccccaagcagagccccatcaacattgatgaggacctgacccaggtgaatgtgaacctgaagaagctgaagttccagggctgggacaagaccagcctggagaacaccttcatccacaacacaggcaagacagtggagatcaacctgaccaatgactacagagtgtctggaggagtgtctgagatggtgttcaaggccagcaagatcaccttccactggggcaagtgcaacatgagcagtgatggcagcgagcacagcctggagggccagaagttccccctggagatgcagatctactgctttgatgctgaccgcttcagcagctttgaggaggccgtgaagggcaagggcaagctgcgggccctgagcatcctgtttgaggtgggcacagaggagaacctggacttcaaggccatcattgatggagtggagagcgtgtccagatttgggaagcaggccgccctggaccccttcatcctgctgaacctgctgcccaacagcacagacaagtactacatctacaacggcagcctgaccagccccccctgcacagacacagtggactggatcgtgttcaaggacacagtgtccatcagcgagagccagctggccgtgttctgtgaggtgctgaccatgcagcagagcggctacgtgatgctgatggactacctgcagaacaacttccgggagcagcagtacaagttcagccggcaggtgttcagcagctacacaggcaaggaggagatccatgaagctgtgtgcagcagcgagccagaaaatgtgcaggccgaccctgagaactacaccagcctgctggtgacctgggagcggccccgggtggtgtatgacaccatgattgagaagtttgctgtgctgtaccagcagctggatggagaggaccagaccaagcatgagttcctgacagatggctaccaggacctgggcgccatcctgaacaacctgctgcccaacatgtcctatgtgctgcagatcgtggccatctgcaccaacggcctgtatggcaagtacagcgaccagctgattgtggacatgcccacagacaaccctgagctggacctcttccctgagctgattggaacagaggagatcatcaaggaggaggaggagggcaaggacatcgaggagggcgccatcgtgaaccctggccgggacagcgccaccaaccagatcaggaagaaggagccccagatcagcaccaccacccactacaaccgcatcggcaccaagtacaatgaggccaagaccaacagaagccccacccggggcagcgagttcagcgggaaaggagatgtgcccaacaccagcctgaacagcaccagccagcctgtgaccaagctggccacagagaaggacatcagcctgaccagccagacagtgacagagctgcccccccacacagtggagggcaccagcgccagcctgaatgatggcagcaagacagtgctgcggagcccccacatgaacctgagcggcacagctgagagcctgaacacagtgtccatcacagaatatgaggaggagagcctgctgaccagcttcaagctggacacaggagctgaggacagcagcggcagcagccctgccaccagcgccatccccttcatcagcgagaacatcagccagggctacatcttcagcagcgagaaccctgagaccatcacctatgatgtgctgatccctgagagcgccagaaatgccagcgaggacagcaccagcagcggcagcgaggagagcctgaaggaccccagcatggagggcaatgtgtggttccccagcagcacagacatcacagcccagccagatgtgggcagcggccgggagagcttcctgcagaccaactacacagagatccgggtggatgagagcgagaagaccaccaagagcttctctgctggccctgtgatgagccagggccccagcgtgacagacctggagatgccccactacagcacctttgcctacttccccacagaggtgaccccccacgccttcacccccagcagccggcagcaggacctggtgtccacagtgaatgtggtgtacagccagaccacccagcctgtgtacaacggggagacccccctgcagcccagctacagcagcgaggtgttccccctggtgacccccctgctgctggacaaccagatcctgaacaccaccccagctgccagcagcagtgacagcgccctgcacgccacccctgtgttccccagcgtggatgtgtcctttgagagcatcctgagcagctatgatggagcccccctgctgcccttcagcagcgccagcttcagcagcgagctgttccgccacctgcacacagtgtcccagatcctgccccaggtgaccagcgccacagaaagtgacaaggtgcccctgcacgccagcctgcctgtggccggcggggacctgctgctggagcccagcctggcccagtacagtgatgtgctgagcaccacccatgctgccagcgagaccctggagtttggcagcgagagcggcgtgctgtacaagaccctgatgttcagccaggtggagccccccagcagtgatgccatgatgcacgcccggagcagcggccctgagcccagctatgccctgagtgacaatgaaggcagccagcacatcttcaccgtgtcctacagcagcgccatccctgtgcatgattctgtgggcgtgacctaccagggcagcctcttcagcggccccagccacatccccatccccaagagcagcctcatcacccccacagccagcctgctgcagcccacccacgccctgtctggagatggagagtggagcggggccagcagtgacagcgagttcctgctgcctgacacagatggcctgacagccctgaacatcagcagccctgtgtctgtggccgagttcacctacaccacctctgtgtttggagatgacaacaaggccctgagcaagtctgagatcatctatggaaatgaaacagagctgcagatccccagcttcaatgagatggtgtaccccagcgagagcacagtgatgcccaacatgtatgacaacgtgaacaagctgaatgccagcctgcaggagacctctgtgtccatcagcagcaccaagggcatgtttcctggcagcctggcccacaccaccaccaaggtgtttgaccacgagatcagccaggtgcctgagaacaacttctctgtgcagcccacccacacagtgtcccaggccagcggggacaccagcctgaagcctgtgctgagcgccaacagcgagcccgccagcagtgaccctgccagcagcgagatgctgagccccagcacccagctgctcttctatgagaccagcgccagcttcagcacagaggtgctgctgcagcccagcttccaggccagtgatgtggacaccctgctgaagacagtgctgcctgctgtgcccagcgaccccatcctggtggagacccccaaggtggacaagatcagcagcaccatgctgcacctgattgtgagcaacagcgccagcagcgagaacatgctgcacagcacctctgtgcctgtgtttgatgtgagccccaccagccacatgcacagcgccagcctgcagggcctgaccatctcctatgccagcgagaagtatgagcctgtgctgctgaagtctgagagcagccaccaggtggtgcccagcctgtacagcaatgatgagctgttccagacagccaacctggagatcaaccaggcccacccccccaagggccgccacgtgtttgccacccctgtgctgagcattgatgagcccctgaacaccctcatcaacaagctgatccacagtgatgagatcctgaccagcaccaagagctctgtgacaggcaaggtgtttgctggcatccccaccgtggccagtgacacctttgtgtccacagaccacagcgtgcccatcggaaatggacatgtggccatcacagctgtgagcccccacagagatggctctgtgaccagcaccaagctgctcttccccagcaaggccaccagcgagctgagccacagcgccaagagtgatgctggcctggtgggcggcggagaagatggagacacagatgatgatggagatgatgatgatgatgaccggggcagtgatggcctgagcatccacaagtgcatgagctgcagcagctaccgggagagccaggagaaggtgatgaatgacagcgacacccatgagaacagcctgatggaccagaacaaccccatctcctacagcctgtctgaaaattctgaggaggacaacagagtgacctctgtgtccagtgacagccagacaggcatggacaggagccctgggaagagccccagcgccaacggcctgagccagaagcacaatgatggcaaggaggagaatgacatccagacaggcagcgccctgctgcccctgagccctgagagcaaggcctgggccgtgctgaccagtgatgaggagagcggcagcggccagggcaccagtgacagcctgaatgaaaatgagaccagcacagacttctcctttgctgacaccaatgagaaggatgctgatggcatcctggccgccggggacagcgagatcaccccaggcttcccccagagccccaccagctctgtgaccagcgagaacagcgaggtgttccacgtgtctgaggccgaggccagcaacagcagccatgagagcagaattggcctggccgagggcctggagagcgagaagaaggctgtgatccccctggtgattgtgtctgccctgaccttcatctgcctggtggtgctggtgggcatcctgatctactggaggaagtgcttccagacagcccacttctacctggaggacagcaccagccccagggtcatcagcaccccacccacccccatcttccccatcagtgatgatgtgggcgccatccccatcaagcacttccccaagcacgtggccgacctgcacgccagcagcggcttcacagaggagtttgagaccctgaaggagttctaccaggaggtgcagagctgcaccgtggacctgggcatcacagctgacagcagcaaccacccagacaacaagcacaagaaccgctacatcaacatcgtggcctatgaccacagccgggtgaagctggcccagctggccgagaaggatggcaagctgacagactacatcaatgccaactacgtggatggctacaaccggcccaaggcctacatcgccgcccagggccccctgaagagcacagctgaggacttctggaggatgatctgggagcacaacgtggaggtgattgtgatgatcaccaacctggtggagaagggccgcaggaaatgtgaccagtactggccagcagatggcagcgaggagtatggcaacttcctggtgacccagaagtctgtgcaggtgctggcctactacacagtgaggaacttcaccctgaggaacaccaagatcaagaagggcagccagaagggccggcccagcggccgggtggtgacccagtaccactacacccagtggccagacatgggcgtgcctgagtacagcctgcctgtgctgacctttgtgaggaaggccgcctatgccaagagacatgctgtgggccctgtggtggtgcactgcagcgctggggtgggccgcacaggcacctacatcgtgctggacagcatgctgcagcagatccagcacgagggcaccgtgaacatcttcggcttcctgaagcacatccgcagccagaggaactacctggtgcagacagaggagcagtatgtgttcatccatgacaccctggtggaggccatcctgagcaaggagacagaggtgctggacagccacatccacgcctacgtgaatgccctgctgatccctggccctgctgggaagaccaagctggagaagcagttccagctgctgagccagagcaacatccagcagagcgactacagcgctgccctgaagcagtgcaaccgggagaagaacagaaccagcagcatcatccctgtggagaggagccgggtgggcatcagcagcctgtctggagagggcacagactacatcaatgccagctacatcatgggctactaccagagcaatgagttcatcatcacccagcaccccctgctgcacaccatcaaggacttctggaggatgatctgggaccacaatgcccagctggtggtgatgatcccagatggccagaacatggctgaagatgaatttgtgtactggcccaacaaggatgagcccatcaactgtgagagcttcaaggtgaccctgatggccgaggagcacaagtgcctgagcaatgaggagaagctgatcatccaggacttcatcctggaggccacccaggatgattatgtgctggaggtgcgccacttccagtgccccaagtggcccaacccagacagccccatcagcaagacctttgagctgatcagcgtcatcaaggaggaggccgccaacagagatggccccatgattgtgcatgatgaacatggaggagtgacagctggcaccttctgtgccctgaccaccctgatgcaccagctggagaaggagaacagcgtggatgtgtaccaggtggccaagatgatcaacctgatgaggcctggggtgtttgctgacatcgagcagtaccagttcctgtacaaggtgatcctgagcctggtgtccacccggcaggaggagaaccccagcaccagcctggacagcaatggagctgccctgcctgatggcaacattgctgagagcctggagagcctggtgtag

SEQ ID NO: 166395 - DNA, 474 bp, Artificial Sequence
  Description of Artificial Sequence: Synthetic coding sequence
atgggccgcctgacagaagctgctgctgctggcagcggcagcagagctgctggctgggccggcagcccccccaccctgctgcccctgagccccaccagcccccgctgtgccgccaccatggccagcagtgatgaagatggcaccaatggaggagccagcgaggccggagaagatcgggaggcccctggagagcggcggcggctgggcgtgctggccacagcctggctgaccttctatgacatcgccatgacagctggccgcctcatcctgagcccccggctggagtgcattggagccatcagcgcccactgccagccccagcccccagagttcaagcgcttcagctgcctgggcctgcggagctcctgggactacaagaggggccccccccggcccatcaacttctgcatcttcggccgggacagagtgagcccctgctggccaggctggagcaggaccccagacctgaagtag

SEQ ID NO: 166396 - DNA, 867 bp, Artificial Sequence
  Description of Artificial Sequence: Synthetic coding sequence
atgggccgcctgacagaagctgctgctgctggcagcggcagcagagctgctggctgggccggcagcccccccaccctgctgcccctgagccccaccagcccccgctgtgccgccaccatggccagcagtgatgaagatggcaccaatggaggagccagcgaggccggagaagatcgggaggcccctggagagcggcggcggctgggcgtgctggccacagcctggctgaccttctatgacatcgccatgacagctggctggctggtgctggccatcgccatggtgcgcttctacatggagaagggcacccaccggggcctgtacaagagcatccagaagaccctgaagttcttccagacctttgccctgctggagatcgtgcactgcctgattggaattgtgcccacctctgtgattgtgactggagtgcaggtgagcagccgcatcttcatggtgtggctgatcacccacagcatcaagcccatccagaatgaggagagcgtggtgctcttcctggtggcctggacagtgacagagatcacccgctacagcttctacaccttcagcctgctggaccacctgccctacttcatcaagtgggcccgctacaacttcttcatcatcctgtaccctgtgggcgtggccggggagctgctgaccatctatgctgccctgccccacgtgaagaagacaggcatgttcagcatccggctgcccaacaagtacaacgtgtcctttgactactactacttcctgctgatcaccatggccagctacatccccctcttcccccagctgtacttccacatgctgcggcagaggaggaaggtgctgcatggagaggtgattgtggagaaggatgactag

SEQ ID NO: 166397 - DNA, 1269 bp, Artificial Sequence
  Description of Artificial Sequence: Synthetic coding sequence
atggccggctgtgtgcccctgctgcagggcctggtgctggtgctggccctgcaccgggtggagcccagcgccaccagcctgaaggagagacatggcctgcacagcgacagcgcctgcaccggggtgcaggagagcctcttcctgcctgccagcaaggccaatgatgtgctggtgcgctggaagagagctggcagctacctgctggaggagctgtttgagggcaacctggagaaggaatgttatgaggagatctgtgtgtatgaggaggcccgggaggtgtttgaaaatgaggtggtgacagatgagttctggaggcgctacaagggcggcagcccctgcatcagccagccctgcctgcacaacggcagctgccaggacagcatctggggctacacctgcacctgcagccctggctatgagggcagcaactgtgagctggccaagaatgaatgccaccctgagaggacagatggctgccagcacttctgcctgcccggccaggagagctacacctgcagctgtgcccagggctaccgcctgggggaggaccacaagcagtgtgtgccccatgaccagtgtgcctgtggggtgctgaccagcgagaagagggccccagacctgcaggacctgccctggcaggtgaagctgaccaacagcgagggcaaggacttctgtggcggcgtcatcatccgggagaactttgtgctgaccacagccaagtgcagcctgctgcacaggaacatcaccgtgaagacctacttcaacagaaccagccaggaccccctgatgatcaagatcacccacgtgcacgtgcacatgagatatgatgctgatgctggagaaaatgacctgagcctgctggagctggagtggcccatccagtgccctggggccggcctgcctgtgtgcaccccagagaaggactttgctgagcacctgctgatccccaggacccggggcctgctgagcggctgggccagaaatggaacagacctgggcaacagcctgaccaccaggcctgtgaccctggtggagggggaggagtgtggccaggtgctgaatgtgacagtgaccaccaggacctactgtgagaggagctctgtggccgccatgcactggatggatggctctgtggtgacccgggagcaccggggctcctggttcctgactggagtgctgggcagccagcctgtgggcggccaggcccacatggtgctggtgaccaaggtgagccgctacagcctgtggttcaagcagatcatgaactag

SEQ ID NO: 166398 - DNA, 1203 bp, Artificial Sequence
  Description of Artificial Sequence: Synthetic coding sequence
atggccggctgtgtgcccctgctgcagggcctggtgctggtgctggccctgcaccgggtggagcccagcgtcttcctgcctgccagcaaggccaatgatgtgctggtgcgctggaagagagctggcagctacctgctggaggagctgtttgagggcaacctggagaaggaatgttatgaggagatctgtgtgtatgaggaggcccgggaggtgtttgaaaatgaggtggtgacagatgagttctggaggcgctacaagggcggcagcccctgcatcagccagccctgcctgcacaacggcagctgccaggacagcatctggggctacacctgcacctgcagccctggctatgagggcagcaactgtgagctggccaagaatgaatgccaccctgagaggacagatggctgccagcacttctgcctgcccggccaggagagctacacctgcagctgtgcccagggctaccgcctgggggaggaccacaagcagtgtgtgccccatgaccagtgtgcctgtggggtgctgaccagcgagaagagggccccagacctgcaggacctgccctggcaggtgaagctgaccaacagcgagggcaaggacttctgtggcggcgtcatcatccgggagaactttgtgctgaccacagccaagtgcagcctgctgcacaggaacatcaccgtgaagacctacttcaacagaaccagccaggaccccctgatgatcaagatcacccacgtgcacgtgcacatgagatatgatgctgatgctggagaaaatgacctgagcctgctggagctggagtggcccatccagtgccctggggccggcctgcctgtgtgcaccccagagaaggactttgctgagcacctgctgatccccaggacccggggcctgctgagcggctgggccagaaatggaacagacctgggcaacagcctgaccaccaggcctgtgaccctggtggagggggaggagtgtggccaggtgctgaatgtgacagtgaccaccaggacctactgtgagaggagctctgtggccgccatgcactggatggatggctctgtggtgacccgggagcaccggggctcctggttcctgactggagtgctgggcagccagcctgtgggcggccaggcccacatggtgctggtgaccaaggtgagccgctacagcctgtggttcaagcagatcatgaactag

SEQ ID NO: 166399 - DNA, 1053 bp, Artificial Sequence
  Description of Artificial Sequence: Synthetic coding sequence
atggagcccaagaggatccgggagggctacctggtgaagaagggcagcgtcttcaacacctggaagcccatgtgggtggtgctgctggaggatggcatcgagttctacaagaagaagagtgacaacagccccaagggcatgatccccctgaagggcagcaccctgaccagcccctgccaggactttgggaagaggatgtttgtgttcaagatcaccaccaccaagcagcaggaccacttcttccaggccgccttcctggaggagagagatgcctgggtgcgggacatcaagaaggccatcaagtgcattgaaggaggccagaagtttgccaggaagagcaccaggaggagcatccggctgcctgagaccatcgacctgggcgccctgtacctgtccatgaaggacacagagaagggcatcaaggagctgaacctggagaaggacaagaagatcttcaaccactgcttcaccggcaactgtgtgattgactggctggtgagcaaccagagcgtgaggaaccggcaggagggcctgatgattgccagcagcctgctgaatgaaggctacctgcagcctgctggggacatgagcaagtctgctgtggatggaacagctgagaaccccttcctggacaacccagatgccttctactacttcccagacagcggcttcttctgtgaggagaacagcagtgatgatgatgtgatcctgaaggaggagttccggggcgtcatcatcaagcagggctgcctgctgaagcagggccacaggaggaagaactggaaggtgaggaagttcatcctgcgggaggaccctgcctacctgcactactatgaccctgctggagctgaggaccccctgggcgccatccacctgcggggctgtgtggtgacctctgtggagagcaacagcaatggaaggaagtctgaggaggagaacctgtttgagatcatcacagcagatgaggtgcactacttcctgcaggccgccacccccaaggagaggacagagtggatccgggccatccagatggccagcaggacaggcaagtag

SEQ ID NO: 166400 - DNA, 648 bp, Artificial Sequence
  Description of Artificial Sequence: Synthetic coding sequence
atggccagcctgcagatgaggggcaaccctggcagccacttctgtggcggcaccctcatccaccccagctttgtgctgacagctgcccactgcctgcgggacatcccccagaggctggtgaatgtggtgctgggcgcccacaacgtgaggacccaggagcccacccagcagcacttctctgtggcccaggtgttcctgaacaactatgatgctgagaacaagctgaatgatgtgctgctgatccagctgagcagccctgccaacctgagcgcctctgtggccaccgtgcagctgccccagcaggaccagcctgtgccccacggcacccagtgcctggccatgggctggggccgggtgggcgcccatgaccccccagcccaggtgctgcaggagctgaatgtgacagtggtgaccttcttctgccggccccacaacatctgcacctttgtgcccaggaggaaggccggcatctgctttggagacagcggcggccccctcatctgtgatggcatcatccagggcatcgacagctttgtgatctggggctgtgccaccaggctcttcccagacttcttcaccagggtggccctgtatgtggactggatccgcagcaccctgcggcgggtggaggccaagggccggccctag

SEQ ID NO: 166401 - DNA, 858 bp, Artificial Sequence
  Description of Artificial Sequence: Synthetic coding sequence
atgcctggggcccggagcggcggcagcggaggagatggcagcaacagcggcagctacagcggagatgccagcggggctgtgacagtgtgggaggtggtgtccctgctgggcaagctgctgggcaccgtggtggccctgaaggtggtgctgtacctgctgcgggtgtgcctggccatggcctggaagtctggaggagccagccacagcgagctgatccacaacctgaggaagaatggcatcatcaagacagacaaggtgtttgaggtgatgctggccacagacaggagccactacgccaagtgcaacccctacatggacagcccccagagcatcggcttccaggccaccatcagcgccccccacatgcacgcctatgccctggagctgctgtttgaccagctgcatgaaggagccaaggccctggatgtgggcagcggcagcggcatcctgacagcctgctttgccaggatggtgggctgcaccgggaaggtgattggaattgaccacatcaaggagctggtggatgattctgtgaacaacgtgaggaaggatgaccccaccctgctgagcagcggccgggtgcagctggtggtgggagatggccgcatgggctacgccgaggaggccccctatgatgccatccacgtgggcgctgctgcccctgtggtgccccaggccctgattgaccagctgaagccaggcggccgcctcatcctgcctgtgggccctgctgggggcaaccagatgctggagcagtatgacaagctgcaggacggcagcatcaagatgaagcccctgatgggcgtcatctacgtgcccctgacagacaaggagaagcagtggagccgctggaagtag

SEQ ID NO: 166402 - DNA, 684 bp, Artificial Sequence
  Description of Artificial Sequence: Synthetic coding sequence
atggcctggaagtctggaggagccagccacagcgagctgatccacaacctgaggaagaatggcatcatcaagacagacaaggtgtttgaggtgatgctggccacagacaggagccactacgccaagtgcaacccctacatggacagcccccagagcatcggcttccaggccaccatcagcgccccccacatgcacgcctatgccctggagctgctgtttgaccagctgcatgaaggagccaaggccctggatgtgggcagcggcagcggcatcctgacagcctgctttgccaggatggtgggctgcaccgggaaggtgattggaattgaccacatcaaggagctggtggatgattctgtgaacaacgtgaggaaggatgaccccaccctgctgagcagcggccgggtgcagctggtggtgggagatggccgcatgggctacgccgaggaggccccctatgatgccatccacgtgggcgctgctgcccctgtggtgccccaggccctgattgaccagctgaagccaggcggccgcctcatcctgcctgtgggccctgctgggggcaaccagatgctggagcagtatgacaagctgcaggacggcagcatcaagatgaagcccctgatgggcgtcatctacgtgcccctgacagacaaggagaagcagtggagccgctggaagtag

SEQ ID NO: 166403 - DNA, 861 bp, Artificial Sequence
  Description of Artificial Sequence: Synthetic coding sequence
atgcctggggcccggagcggcggcagcggaggagatggcagcaacagcggcagctacagcggagatgccagcggggctgtgacagtgtgggaggtggtgtccctgctgggcaagctgctgggcaccgtggtggccctgaaggtggtgctgtacctgctgcgggtgtgcctggccatggcctggaagtctggaggagccagccacagcgagctgatccacaacctgaggaagaatggcatcatcaagacagacaaggtgtttgaggtgatgctggccacagacaggagccactacgccaagtgcaacccctacatggacagcccccagagcatcggcttccaggccaccatcagcgccccccacatgcacgcctatgccctggagctgctgtttgaccagctgcatgaaggagccaaggccctggatgtgggcagcggcagcggcatcctgacagcctgctttgccaggatggtgggctgcaccgggaaggtgattggaattgaccacatcaaggagctggtggatgattctgtgaacaacgtgaggaaggatgaccccaccctgctgagcagcggccgggtgcagctggtggtgggagatggccgcatgggctacgccgaggaggccccctatgatgccatccacgtgggcgctgctgcccctgtggtgccccaggccctgattgaccagctgaagccaggcggccgcctcatcctgcctgtgggccctgctgggggcaaccagatgctggagcagtatgacaagctgcaggacggcagcatcaagatgaagcccctgatgggcgtcatctacgtgcccctgacagacaaggagaagcagtggagcagagatgagctgtag

SEQ ID NO: 166404 - DNA, 858 bp, Artificial Sequence; identical to SEQ ID NO: 166401
  Description of Artificial Sequence: Synthetic coding sequence

SEQ ID NO: 166405 - DNA, 579 bp, Artificial Sequence
  Description of Artificial Sequence: Synthetic coding sequence
atggcctggaagtctggaggagccagccacagcgagctgatccacaacctgcgctccttccaggccaccatcagcgccccccacatgcacgcctatgccctggagctgctgtttgaccagctgcacgagggcgccaaggccctggatgtgggcagcggcagcggcatcctgacagcctgctttgccaggatggtgggctgcaccgggaaggtgattggcatcgaccacatcaaggagctggtggatgacagcgtgaacaacgtgaggaaggatgaccccaccctgctgagcagcggccgggtgcagctggtggtgggagatggccgcatgggctatgcagaggaggccccctatgatgccatccacgtgggcgccgccgcccctgtggtgccccaggccctgattgaccagctgaagccaggcggccgcctcatcctgcctgtgggccctgctgggggcaaccagatgctggagcagtatgacaagctgcaggacggcagcatcaagatgaagcccctgatgggcgtcatctacgtgcccctgacagacaaggagaagcagtggagccgctggaagtag

SEQ ID NO: 166406 - DNA, 2016 bp, Artificial Sequence
  Description of Artificial Sequence: Synthetic coding sequence
atgaagcagatcttcttcctggatgacagcggcccccccttcggccacatggtgctggccctgggcggctacctgggcggctttgatggcaacttcctgtggaacagaattggagctgagtacagcagcaatgtgcctgtgtggagcctgcggctgctgcctgccctggccggggccctgtctgtgcccatggcctaccagatcgtgctggagctgcacttcagccactgtgccgccatgggcgccgccctgctgatgctgattgaaaatgccctgatcacccagagccggctgatgctgctggagagcgtgctgatcttcttcaacctgctggccgtgctgagctacctgaagttcttcaactgccagaagcacagccccttcagcctgtcctggtggttctggctgaccctgactggagtggcctgcagctgtgctgtgggcatcaagtacatgggcgtcttcacctacgtgctggtgctgggcgtggccgctgtgcacgcctggcacctgctgggggaccagaccctgagcaatgtgtgtgtgttctgccacctgctggcccgggctgtggccctgctggtgattcctgtggtgctgtacctgctcttcttctacgtgcacctgatcctggtgttccgcagcggcccccatgaccagatcatgagcagcgccttccaggccagcctggagggcggcctggcccgcatcacccagggccagcccctggaggtggccttcggcagccaggtgaccctgagaaatgtgtttgggaagcctgtgccctgctggctgcacagccaccaggacacctaccccatgatctatgaaaatggccggggcagcagccaccagcagcaggtgacctgctaccccttcaaggatgtgaacaactggtggatcgtgaaggacccccggcggcaccagctggtggtgagcagcccccccaggcctgtgagacatggagacatggtgcagctggtgcacggcatgaccaccaggagcctgaacacccatgatgtggccgcccccctgagcccccacagccaggaggtgtcctgctacatcgactacaacatctccatgcctgcccagaacctgtggaggctggagatcgtgaacagaggaagtgacacagatgtgtggaagaccatcctgtctgaggtgcgctttgtgcacgtgaacaccagcgctgtgctgaagctgagcggggcccacctgcctgactggggctaccggcagctggagatcgtgggggagaagctgagccggggctaccacggcagcacagtgtggaatgtggaggagcacagatatggagccagccaggagcagcgggagcgggagcgggagctgcacagccctgcccaggtggatgtgtccaggaacctgtccttcatggcccgcttcagcgagctgcagtggaggatgctggccctgcggagtgatgattctgagcacaagtacagcagcagccccctggagtgggtgaccctggacaccaacatcgcctactggctgcaccccaggaccagcgcccagatccacctgctgggcaacatcgtcatctgggtgtctggcagcctggccctggccatctatgccctgctgagcctgtggtacctgctgcggaggagaagaaatgtgcatgacctgccccaggatgcctggctgcgctgggtgctggccggggccctgtgtgccggcggctgggccgtgaactacctgcccttcttcctgatggagaagaccctcttcctgtaccactacctgcctgccctgaccttccagatcctgctgctgcctgtggtgctgcagcacatcagtgaccacctgtgccgcagccagctgcagaggagcatcttcagcgccctggtggtggcctggtacagcagcgcctgccacgtgagcaacaccctgcggcccctgacctatggagacaagagcctgagcccccatgagctgaaggccctgcgctggaaggacagctgggacatcctgatcaggaagcactag

SEQ ID NO: 166407 - DNA, 2088 bp, Artificial Sequence
  Description of Artificial Sequence: Synthetic coding sequence
atgtggggcttcctgaagaggcctgtggtggtgacagctgacatcaacctgagcctggtggccctgaccggcatgggcctgctgagccggctgtggaggctgacctaccccagggctgtggtgctcttccgccgcatccgctggcagttctttgtggagcagaactggagctctgtggtggccttccctgagtacagcagcaatgtgcctgtgtggagcctgcggctgctgcctgccctggccggggccctgtctgtgcccatggcctaccagatcgtgctggagctgcacttcagccactgtgccgccatgggcgccgccctgctgatgctgattgaaaatgccctgatcacccagagccggctgatgctgctggagagcgtgctgatcttcttcaacctgctggccgtgctgagctacctgaagttcttcaactgccagaagcacagccccttcagcctgtcctggtggttctggctgaccctgactggagtggcctgcagctgtgctgtgggcatcaagtacatgggcgtcttcacctacgtgctggtgctgggcgtggccgctgtgcacgcctggcacctgctgggggaccagaccctgagcaatgtgtgtgtgttctgccacctgctggcccgggctgtggccctgctggtgattcctgtggtgctgtacctgctcttcttctacgtgcacctgatcctggtgttccgcagcggcccccatgaccagatcatgagcagcgccttccaggccagcctggagggcggcctggcccgcatcacccagggccagcccctggaggtggccttcggcagccaggtgaccctgagaaatgtgtttgggaagcctgtgccctgctggctgcacagccaccaggacacctaccccatgatctatgaaaatggccggggcagcagccaccagcagcaggtgacctgctaccccttcaaggatgtgaacaactggtggatcgtgaaggacccccggcggcaccagctggtggtgagcagcccccccaggcctgtgagacatggagacatggtgcagctggtgcacggcatgaccaccaggagcctgaacacccatgatgtggccgcccccctgagcccccacagccaggaggtgtcctgctacatcgactacaacatctccatgcctgcccagaacctgtggaggctggagatcgtgaacagaggaagtgacacagatgtgtggaagaccatcctgtctgaggtgcgctttgtgcacgtgaacaccagcgctgtgctgaagctgagcggggcccacctgcctgactggggctaccggcagctggagatcgtgggggagaagctgagccggggctaccacggcagcacagtgtggaatgtggaggagcacagatatggagccagccaggagcagcgggagcgggagcgggagctgcacagccctgcccaggtggatgtgtccaggaacctgtccttcatggcccgcttcagcgagctgcagtggaggatgctggccctgcggagtgatgattctgagcacaagtacagcagcagccccctggagtgggtgaccctggacaccaacatcgcctactggctgcaccccaggaccagcgcccagatccacctgctgggcaacatcgtcatctgggtgtctggcagcctggccctggccatctatgccctgctgagcctgtggtacctgctgcggaggagaagaaatgtgcatgacctgccccaggatgcctggctgcgctgggtgctggccggggccctgtgtgccggcggctgggccgtgaactacctgcccttcttcctgatggagaagaccctcttcctgtaccactacctgcctgccctgaccttccagatcctgctgctgcctgtggtgctgcagcacatcagtgaccacctgtgccgcagccagctgcagaggagcatcttcagcgccctggtggtggcctggtacagcagcgcctgccacgtgagcaacaccctgcggcccctgacctatggagacaagagcctgagcccccatgagctgaaggccctgcgctggaaggacagctgggacatcctgatcaggaagcactag

SEQ ID NO: 166408 - DNA, 1041 bp, Artificial Sequence
  Description of Artificial Sequence: Synthetic coding sequence
tggaggggcggcggctgcaccagccctgccaccctgggcgccgcccggggagctgtgggcatcggcaaggagggccagtaccagcccctgattgccagcctgacctggggcctggtgcccctgagccaggcccaggagatcgtgaacagaggaagtgacacagatgtgtggaagaccatcctgtctgaggtgcgctttgtgcacgtgaacaccagcgctgtgctgaagctgagcggggcccacctgcctgactggggctaccggcagctggagatcgtgggggagaagctgagccggggctaccacggcagcacagtgtggaatgtggaggagcaccgctacggggccagccaggagcagcgggagcgggagcgggagctgcacagccctgcccaggtggatgtgtccaggaacctgtccttcatggcccgcttcagcgagctgcagtggaggatgctggccctgcggagtgatgacagcgagcacaagtacagcagcagccccctggagtgggtgaccctggacaccaacatcgcctactggctgcaccccaggaccagcgcccagatccacctgctgggcaacatcgtcatctgggtgtctggcagcctggccctggccatctatgccctgctgagcctgtggtacctgctgcggaggagaagaaatgtgcatgacctgccccaggatgcctggctgcgctgggtgctggccggggccctgtgtgccggcggctgggccgtgaactacctgcccttcttcctgatggagaagaccctcttcctgtaccactacctgcctgccctgaccttccagatcctgctgctgcctgtggtgctgcagcacatcagtgaccacctgtgccgcagccagctgcagaggagcatcttcagcgccctggtggtggcctggtacagcagcgcctgccacgtgagcaacaccctgcggcccctgacctacggggacaagagcctgagcccccatgagctgaaggccctgcgctggaaggacagctgggacatcctgatcaggaagcactag

SEQ ID NO: 166409 - DNA, 471 bp, Artificial Sequence
  Description of Artificial Sequence: Synthetic coding sequence
atggcctaccagatcgtgctggagctgcacttcagccactgtgccgccatgggcgccgccctgctgatgctgattgaaaatgccctgatcacccagagccggctgatgctgctggagagcgtgctgatcttcttcaacctgctggccgtgctgagctacctgaagttcttcaactgccagaagcacagcctgcccctgtgggccccccggcccaaccacgtgcagtgcctgcccggccagctgcggggccgcaccagcagtgaccacagcggcagcgccaccggcggcggcctgtgggtgcccggccacagcgaggagcggctgtgggagacctgtgccctgctggccagcttccccccaggccacctgccccatgatgtgcgctatgaaaatggccggggcagcagccaccagcagcaggtgacctgctaccccttcaaggatgtgaacaactggtggatcgtgaagtag

SEQ ID NO: 166410 - DNA, 2244 bp, Artificial Sequence
  Description of Artificial Sequence: Synthetic coding sequence
atgtggggcttcctgaagaggcctgtggtggtgacagctgacatcaacctgagcctggtggccctgaccggcatgggcctgctgagccggctgtggaggctgacctaccccagggctgtggtgtttgatgaggtgtactacggccagtacatctccttctacatgaagcagatcttcttcctggatgacagcggcccccccttcggccacatggtgctggccctgggcggctacctgggcggctttgatggcaacttcctgtggaacagaattggagctgagtacagcagcaatgtgcctgtgtggagcctgcggctgctgcctgccctggccggggccctgtctgtgcccatggcctaccagatcgtgctggagctgcacttcagccactgtgccgccatgggcgccgccctgctgatgctgattgaaaatgccctgatcacccagagccggctgatgctgctggagagcgtgctgatcttcttcaacctgctggccgtgctgagctacctgaagttcttcaactgccagaagcacagccccttcagcctgtcctggtggttctggctgaccctgactggagtggcctgcagctgtgctgtgggcatcaagtacatgggcgtcttcacctacgtgctggtgctgggcgtggccgctgtgcacgcctggcacctgctgggggaccagaccctgagcaatgtgggcgcagatgtgcagtgctgcatgaggcctgcctgcatgggccagatgcagatgagccagggcgtgtgtgtgttctgccacctgctggcccgggctgtggccctgctggtgattcctgtggtgctgtacctgctcttcttctacgtgcacctgatcctggtgttccgcagcggcccccatgaccagatcatgagcagcgccttccaggccagcctggagggcggcctggcccgcatcacccagggccagcccctggaggtggccttcggcagccaggtgaccctgagaaatgtgtttgggaagcctgtgccctgctggctgcacagccaccaggacacctaccccatgatctatgaaaatggccggggcagcagccaccagcagcaggtgacctgctaccccttcaaggatgtgaacaactggtggatcgtgaaggacccccggcggcaccagctggtggtgagcagcccccccaggcctgtgagacatggagacatggtgcagctggtgcacggcatgaccaccaggagcctgaacacccatgatgtggccgcccccctgagcccccacagccaggaggtgtcctgctacatcgactacaacatctccatgcctgcccagaacctgtggaggctggagatcgtgaacagaggaagtgacacagatgtgtggaagaccatcctgtctgaggtgcgctttgtgcacgtgaacaccagcgctgtgctgaagctgagcggggcccacctgcctgactggggctaccggcagctggagatcgtgggggagaagctgagccggggctaccacggcagcacagtgtggaatgtggaggagcacagatatggagccagccaggagcagcgggagcgggagcgggagctgcacagccctgcccaggtggatgtgtccaggaacctgtccttcatggcccgcttcagcgagctgcagtggaggatgctggccctgcggagtgatgattctgagcacaagtacagcagcagccccctggagtgggtgaccctggacaccaacatcgcctactggctgcaccccaggaccagcgcccagatccacctgctgggcaacatcgtcatctgggtgtctggcagcctggccctggccatctatgccctgctgagcctgtggtacctgctgcggaggagaagaaatgtgcatgacctgccccaggatgcctggctgcgctgggtgctggccggggccctgtgtgccggcggctgggccgtgaactacctgcccttcttcctgatggagaagaccctcttcctgtaccactacctgcctgccctgaccttccagatcctgctgctgcctgtggtgctgcagcacatcagtgaccacctgtgccgcagccagctgcagaggagcatcttcagcgccctggtggtggcctggtacagcagcgcctgccacgtgagcaacaccctgcggcccctgacctatggagacaagagcctgagcccccatgagctgaaggccctgcgctggaaggacagctgggacatcctgatcaggaagcactag

SEQ ID NO: 166411 - DNA, 2178 bp, Artificial Sequence
  Description of Artificial Sequence: Synthetic coding sequence
atgtggggcttcctgaagaggcctgtggtggtgacagctgacatcaacctgagcctggtggccctgaccggcatgggcctgctgagccggctgtggaggctgacctaccccagggctgtggtgtttgatgaggtgtactacggccagtacatctccttctacatgaagcagatcttcttcctggatgacagcggcccccccttcggccacatggtgctggccctgggcggctacctgggcggctttgatggcaacttcctgtggaacagaattggagctgagtacagcagcaatgtgcctgtgtggagcctgcggctgctgcctgccctggccggggccctgtctgtgcccatggcctaccagatcgtgctggagctgcacttcagccactgtgccgccatgggcgccgccctgctgatgctgattgaaaatgccctgatcacccagagccggctgatgctgctggagagcgtgctgatcttcttcaacctgctggccgtgctgagctacctgaagttcttcaactgccagaagcacagccccttcagcctgtcctggtggttctggctgaccctgactggagtggcctgcagctgtgctgtgggcatcaagtacatgggcgtcttcacctacgtgctggtgctgggcgtggccgctgtgcacgcctggcacctgctgggggaccagaccctgagcaatgtgtgtgtgttctgccacctgctggcccgggctgtggccctgctggtgattcctgtggtgctgtacctgctcttcttctacgtgcacctgatcctggtgttccgcagcggcccccatgaccagatcatgagcagcgccttccaggccagcctggagggcggcctggcccgcatcacccagggccagcccctggaggtggccttcggcagccaggtgaccctgagaaatgtgtttgggaagcctgtgccctgctggctgcacagccaccaggacacctaccccatgatctatgaaaatggccggggcagcagccaccagcagcaggtgacctgctaccccttcaaggatgtgaacaactggtggatcgtgaaggacccccggcggcaccagctggtggtgagcagcccccccaggcctgtgagacatggagacatggtgcagctggtgcacggcatgaccaccaggagcctgaacacccatgatgtggccgcccccctgagcccccacagccaggaggtgtcctgctacatcgactacaacatctccatgcctgcccagaacctgtggaggctggagatcgtgaacagaggaagtgacacagatgtgtggaagaccatcctgtctgaggtgcgctttgtgcacgtgaacaccagcgctgtgctgaagctgagcggggcccacctgcctgactggggctaccggcagctggagatcgtgggggagaagctgagccggggctaccacggcagcacagtgtggaatgtggaggagcacagatatggagccagccaggagcagcgggagcgggagcgggagctgcacagccctgcccaggtggatgtgtccaggaacctgtccttcatggcccgcttcagcgagctgcagtggaggatgctggccctgcggagtgatgattctgagcacaagtacagcagcagccccctggagtgggtgaccctggacaccaacatcgcctactggctgcaccccaggaccagcgcccagatccacctgctgggcaacatcgtcatctgggtgtctggcagcctggccctggccatctatgccctgctgagcctgtggtacctgctgcggaggagaagaaatgtgcatgacctgccccaggatgcctggctgcgctgggtgctggccggggccctgtgtgccggcggctgggccgtgaactacctgcccttcttcctgatggagaagaccctcttcctgtaccactacctgcctgccctgaccttccagatcctgctgctgcctgtggtgctgcagcacatcagtgaccacctgtgccgcagccagctgcagaggagcatcttcagcgccctggtggtggcctggtacagcagcgcctgccacgtgagcaacaccctgcggcccctgacctatggagacaagagcctgagcccccatgagctgaaggccctgcgctggaaggacagctgggacatcctgatcaggaagcactag

SEQ ID NO: 166412 - DNA, 1827 bp, Artificial Sequence
  Description of Artificial Sequence: Synthetic coding sequence
atggcctaccagatcgtgctggagctgcacttcagccactgtgccgccatgggcgccgccctgctgatgctgattgaaaatgccctgatcacccagagccggctgatgctgctggagagcgtgctgatcttcttcaacctgctggccgtgctgagctacctgaagttcttcaactgccagaagcacagccccttcagcctgtcctggtggttctggctgaccctgactggagtggcctgcagctgtgctgtgggcatcaagtacatgggcgtcttcacctacgtgctggtgctgggcgtggccgctgtgcacgcctggcacctgctgggggaccagaccctgagcaatgtgtgtgtgttctgccacctgctggcccgggctgtggccctgctggtgattcctgtggtgctgtacctgctcttcttctacgtgcacctgatcctggtgttccgcagcggcccccatgaccagatcatgagcagcgccttccaggccagcctggagggcggcctggcccgcatcacccagggccagcccctggaggtggccttcggcagccaggtgaccctgagaaatgtgtttgggaagcctgtgccctgctggctgcacagccaccaggacacctaccccatgatctatgaaaatggccggggcagcagccaccagcagcaggtgacctgctaccccttcaaggatgtgaacaactggtggatcgtgaaggaccccaggaggcaccagctggtggtgagcagcccccccaggcctgtgcgccacggggacatggtgcagctggtgcacggcatgaccaccaggagcctgaacacccatgatgtggccgcccccctgagcccccacagccaggaggtgtcctgctacatcgactacaacatctccatgcctgcccagaacctgtggaggctggagatcgtgaacagaggaagtgacacagatgtgtggaagaccatcctgtctgaggtgcgctttgtgcacgtgaacaccagcgctgtgctgaagctgagcggggcccacctgcctgactggggctaccggcagctggagatcgtgggggagaagctgagccggggctaccacggcagcacagtgtggaatgtggaggagcaccgctacggggccagccaggagcagcgggagcgggagcgggagctgcacagccctgcccaggtggatgtgtccaggaacctgtccttcatggcccgcttcagcgagctgcagtggaggatgctggccctgcggagtgatgacagcgagcacaagtacagcagcagccccctggagtgggtgaccctggacaccaacatcgcctactggctgcaccccaggaccagcgcccagatccacctgctgggcaacatcgtcatctgggtgtctggcagcctggccctggccatctatgccctgctgagcctgtggtacctgctgcggaggagaagaaatgtgcatgacctgccccaggatgcctggctgcgctgggtgctggccggggccctgtgtgccggcggctgggccgtgaactacctgcccttcttcctgatggagaagaccctcttcctgtaccactacctgcctgccctgaccttccagatcctgctgctgcctgtggtgctgcagcacatcagtgaccacctgtgccgcagccagctgcagaggagcatcttcagcgccctggtggtggcctggtacagcagcgcctgccacgtgagcaacaccctgcggcccctgacctacggggacaagagcctgagcccccatgagctgaaggccctgcgctggaaggacagctgggacatcctgatcaggaagcactag

SEQ ID NO: 166413 - DNA, 471 bp, Artificial Sequence; identical to SEQ ID NO: 166409
  Description of Artificial Sequence: Synthetic coding sequence

SEQ ID NO: 166414 - DNA, 429 bp, Artificial Sequence
  Description of Artificial Sequence: Synthetic coding sequence
atgtggggcttcctgaagaggcctgtggtggtgacagctgacatcaacctgagcctggtggccctgaccggcatgggcctgctgagccggctgtggaggctgacctaccccagggctgtggtgtttgatgaggtgtactacggccagtacatctccttctacatgaagcagatcttcttcctggatgacagcggcccccccttcggccacatggtgctggccctgggcggctacctgggcggctttgatggcaacttcctgtggaacagaattggagctgagtacagcagcaatgtgcctgtgtggagcctgcggctgctgcctgccctggccggggccctgtctgtgcccatggcctaccagatcgtgctggagctgcacttcagccactgtgccgccatgggcgccgccctgctgatgctgatctag

SEQ ID NO: 166415 - DNA, 1722 bp, Artificial Sequence
  Description of Artificial Sequence: Synthetic coding sequence
atgctgctggagagcgtgctgatcttcttcaacctgctggccgtgctgagctacctgaagttcttcaactgccagaagcacagccccttcagcctgtcctggtggttctggctgaccctgactggagtggcctgcagctgtgctgtgggcatcaagtacatgggcgtcttcacctacgtgctggtgctgggcgtggccgctgtgcacgcctggcacctgctgggggaccagaccctgagcaatgtgtgtgtgttctgccacctgctggcccgggctgtggccctgctggtgattcctgtggtgctgtacctgctcttcttctacgtgcacctgatcctggtgttccgcagcggcccccatgaccagatcatgagcagcgccttccaggccagcctggagggcggcctggcccgcatcacccagggccagcccctggaggtggccttcggcagccaggtgaccctgagaaatgtgtttgggaagcctgtgccctgctggctgcacagccaccaggacacctaccccatgatctatgaaaatggccggggcagcagccaccagcagcaggtgacctgctaccccttcaaggatgtgaacaactggtggatcgtgaaggacccccggcggcaccagctggtggtgagcagcccccccaggcctgtgagacatggagacatggtgcagctggtgcacggcatgaccaccaggagcctgaacacccatgatgtggccgcccccctgagcccccacagccaggaggtgtcctgctacatcgactacaacatctccatgcctgcccagaacctgtggaggctggagatcgtgaacagaggaagtgacacagatgtgtggaagaccatcctgtctgaggtgcgctttgtgcacgtgaacaccagcgctgtgctgaagctgagcggggcccacctgcctgactggggctaccggcagctggagatcgtgggggagaagctgagccggggctaccacggcagcacagtgtggaatgtggaggagcacagatatggagccagccaggagcagcgggagcgggagcgggagctgcacagccctgcccaggtggatgtgtccaggaacctgtccttcatggcccgcttcagcgagctgcagtggaggatgctggccctgcggagtgatgattctgagcacaagtacagcagcagccccctggagtgggtgaccctggacaccaacatcgcctactggctgcaccccaggaccagcgcccagatccacctgctgggcaacatcgtcatctgggtgtctggcagcctggccctggccatctatgccctgctgagcctgtggtacctgctgcggaggagaagaaatgtgcatgacctgccccaggatgcctggctgcgctgggtgctggccggggccctgtgtgccggcggctgggccgtgaactacctgcccttcttcctgatggagaagaccctcttcctgtaccactacctgcctgccctgaccttccagatcctgctgctgcctgtggtgctgcagcacatcagtgaccacctgtgccgcagccagctgcagaggagcatcttcagcgccctggtggtggcctggtacagcagcgcctgccacgtgagcaacaccctgcggcccctgacctatggagacaagagcctgagcccccatgagctgaaggccctgcgctggaaggacagctgggacatcctgatcaggaagcactag

SEQ ID NO: 166416 - DNA, 2178 bp, Artificial Sequence; identical to SEQ ID NO: 166411
  Description of Artificial Sequence: Synthetic coding sequence

SEQ ID NO: 166417 - DNA, 507 bp, Artificial Sequence
  Description of Artificial Sequence: Synthetic coding sequence
atggcctaccagatcgtgctggagctgcacttcagccactgtgccgccatgggcgccgccctgctgatgctgattgaaaatgccctgatcacccagagccggctgatgctgctggagagcgtgctgatcttcttcaacctgctggccgtgctgagctacctgaagttcttcaactgccagaagcacagccccttcagcctgtcctggtggttctggctgaccctgactggagtggcctgcagctgtgctgtgggcatcaagtacatgggcgtcttcacctacgtgctggtgctgggcgtggccgctgtgcacgcctggcacctgctgggggaccagaccctgagcaatgtgtgtgtgttctgccacctgctggcccgggctgtggccctgctggtgattcctgtggtgctgtacctgctcttcttctacgtgcacctgatcctggtgttccgcagcggcccccatgaccagatcatgagcagcgccttccaggccagcctggagtag

SEQ ID NO: 166418 - DNA, 894 bp, Artificial Sequence
  Description of Artificial Sequence: Synthetic coding sequence
atggcctaccagatcgtgctggagctgcacttcagccactgtgccgccatgggcgccgccctgctgatgctgattgaaaatgccctgatcacccagagccggctgatgctgctggagagcgtgctgatcttcttcaacctgctggccgtgctgagctacctgaagttcttcaactgccagaagcacagccccttcagcctgtcctggtggttctggctgaccctgactggagtggcctgcagctgtgctgtgggcatcaagtacatgggcgtcttcacctacgtgctggtgctgggcgtggccgctgtgcacgcctggcacctgctgggggaccagaccctgagcaatgtgggcgcagatgtgcagtgctgcatgaggcctgcctgcatgggccagatgcagatgagccagggcgtgtgtgtgttctgccacctgctggcccgggctgtggccctgctggtgattcctgtggtgctgtacctgctcttcttctacgtgcacctgatcctggtgttccgcagcggcccccatgaccagatcatgagcagcgccttccaggccagcctggagggcggcctggcccgcatcacccagggccagcccctggaggtggccttcggcagccaggtgaccctgagaaatgtgtttgggaagcctgtgccctgctggctgcacagccaccaggacacctaccccatgatctatgaaaatggccggggcagcagccaccagcagcaggtgacctgctaccccttcaaggatgtgaacaactggtggatcgtgaaggaccccaggaggcaccagctggtggtgagcagcccccccaggcctgtgcgccacggggacatggtgcagctggtgcacggcatgaccaccaggagcctgaacacctag

SEQ ID NO: 166419 - DNA, 657 bp, Artificial Sequence
  Description of Artificial Sequence: Synthetic coding sequence
atgaagcagatcttcttcctggatgacagcggcccccccttcggccacatggtgctggccctgggcggctacctgggcggctttgatggcaacttcctgtggaacagaattggagctgagtacagcagcaatgtgcctgtgtggagcctgcggctgctgcctgccctggccggggccctgtctgtgcccatggcctaccagatcgtgctggagctgcacttcagccactgtgccgccatgggcgccgccctgctgatgctgattgaaaatgccctgatcacccagagccggctgatgctgctggagagcgtgctgatcttcttcaacctgctggccgtgctgagctacctgaagttcttcaactgccagaagcacagccccttcagcctgtcctggtggttctggctgaccctgactggagtggcctgcagctgtgctgtgggcatcaagtacatgggcgtcttcacctacgtgctggtgctgggcgtggccgctgtgcacgcctggcacctgctgggggaccagaccctgagcaatgtgggcgcagatgtgcagtgctgcatgaggcctgcctgcatgggccagatgcagatgagccagggcgtgtgtgtgttctgccacctgctggcccgggctgtggccctgctggtgatctag

SEQ ID NO: 166420 - DNA, 1398 bp, Artificial Sequence
  Description of Artificial Sequence: Synthetic coding sequence
atggccatcttctgtggcacagagctggagcaggtgtgtgtgttctgccacctgctggcccgggctgtggccctgctggtgattcctgtggtgctgtacctgctcttcttctacgtgcacctgatcctggtgttccgcagcggcccccatgaccagatcatgagcagcgccttccaggccagcctggagggcggcctggcccgcatcacccagggccagcccctggaggtggccttcggcagccaggtgaccctgagaaatgtgtttgggaagcctgtgccctgctggctgcacagccaccaggacacctaccccatgatctatgaaaatggccggggcagcagccaccagcagcaggtgacctgctaccccttcaaggatgtgaacaactggtggatcgtgaaggacccccggcggcaccagctggtggtgagcagcccccccaggcctgtgagacatggagacatggtgcagctggtgcacggcatgaccaccaggagcctgaacacccatgatgtggccgcccccctgagcccccacagccaggaggtgtcctgctacatcgactacaacatctccatgcctgcccagaacctgtggaggctggagatcgtgaacagaggaagtgacacagatgtgtggaagaccatcctgtctgaggtgcgctttgtgcacgtgaacaccagcgctgtgctgaagctgagcggggcccacctgcctgactggggctaccggcagctggagatcgtgggggagaagctgagccggggctaccacggcagcacagtgtggaatgtggaggagcacagatatggagccagccaggagcagcgggagcgggagcgggagctgcacagccctgcccaggtggatgtgtccaggaacctgtccttcatggcccgcttcagcgagctgcaggcccagatccacctgctgggcaacatcgtcatctgggtgtctggcagcctggccctggccatctatgccctgctgagcctgtggtacctgctgcggaggagaagaaatgtgcatgacctgccccaggatgcctggctgcgctgggtgctggccggggccctgtgtgccggcggctgggccgtgaactacctgcccttcttcctgatggagaagaccctcttcctgtaccactacctgcctgccctgaccttccagatcctgctgctgcctgtggtgctgcagcacatcagtgaccacctgtgccgcagccagctgcagaggagcatcttcagcgccctggtggtggcctggtacagcagcgcctgccacgtgagcaacaccctgcggcccctgacctatggagacaagagcctgagcccccatgagctgaaggccctgcgctggaaggacagctgggacatcctgatcaggaagcactag

SEQ ID NO: 166421 - DNA, 2253 bp, Artificial Sequence
  Description of Artificial Sequence: Synthetic coding sequence
atgcccccagccactggaggcggcctggccgagagcgagctgcggccccggcggggccgctgtggcccccaggccgcccgggctgctggaagagatgtggccgctgaggccgtggcccggagccccaagaggcctgcctggggcagccgccgctttgaggccgtgggctggtgggccctgctggccctggtgaccctgctgagctttgccacccgcttccaccggctggatgagcccccccacatctgctgggatgagacccactttgggaagatgggcagctactacatcaacagaaccttcttctttgatgtgcacccccccctgggcaagatgctgattggcctggccggctacctgagcggctatgatggcaccttcctgttccagaagccaggggacaagtatgagcaccacagctacatgggcatgaggggcttctgtgccttcctgggctcctggctggtgccctttgcctacctgactgtgctggacctgagcaagagcctgtctgctgccctgctgacagctgccctgctgacctttgacaccggctgcctgaccctgagccagtacatcctgctggaccccatcctgatgttcttcatcatggccgccatgctgtccatggtgaagtacaacagctgtgccgaccggcccttcagcgccccctggtggttctggctgagcctgactggagtgtccctggccggggccctgggcgtgaagtttgtgggcctcttcatcatcctgcaggtgggcctgaacaccatcgctgacctgtggtacctgtttggagacctgagcctgagcctggtgacagtgggcaagcacctgacagcccgggtgctgtgcctgattgtgctgcccctggccctgtacacagccacctttgctgtgcacttcatggtgctgagcaagagcggccctggagatggcttcttcagcagcgccttccaggcccggctgagcggcaacaacctgcacaatgccagcatccctgagcacctggcctacggcagcgtcatcaccgtgaagaacctgaggatggccatcggctacctgcacagccaccgccacctgtacccagagggcatcggggcccggcagcagcaggtgaccacctacctgcacaaggactacaacaacctgtggatcatcaagaagcacaacaccaacagcgaccccctggaccccagcttccctgtggagtttgtgcgccacggggacatcatccggctggagcacaaggagaccagcaggaacctgcacagccactaccacgaggcccccatgaccaggaagcactaccaggtgacaggctacggcatcaatggaactggagacagcaatgacttctggagaattgaggtggtgaacaggaagtttggaaaccgcatcaaggtgctgcggagccgcatccgcttcatccacctggtgacaggctgtgtgctgggcagcagcggcaaggtgctgcccaagtggggctgggagcagctggaggtgacctgcaccccctacctgaaggagaccctgaacagcatctggaatgtggaggaccacatcaaccccaagctgcccaacatcagcctggatgtgctgcagcccagcttccctgagatcctgctggagagccacatggtgatgatccggggcaacagcggcctgaagcccaaggacaatgagttcaccagcaagccctggcactggcccatcaactaccagggcctgcgcttcagcggcgtgaatgacacagacttccgggtgtacctgctgggcaaccctgtggtgtggtggctgaacctgctgagcatcgccctgtacctgctgagcggcagcatcatcgctgtggccatgcagagaggagcccggctgcctgctgaggtggccggcctgagccaggtgctgctgcggggcggcggccaggtgctgctgggctggaccctgcactacttccccttcttcctgatgggccgggtgctgtacttccaccactacttccctgccatgctgttcagctccatgctgaccggcatcctgtgggacaccctgctgcggctgtgtgcctggggcctggcctcctggcccctggcccggggcatccacgtggccggcatcctgagcctgctgctgggcacagcctacagcttctacctgttccaccccctggcctacggcatggtgggccccctggcccaggacccccagagccccatggccggcctgcgctggctggacagctgggacttctag

SEQ ID NO: 166422 - DNA, 669 bp, Artificial Sequence
  Description of Artificial Sequence: Synthetic coding sequence
atgaagctgcccctgctgctggccctgctgtttggagctgtgtctgccctgcacctgcggtctgagaccagcacctttgagacccccctgggcgccaagaccctgcctgaagatgaggagaccccagagcaggagatggaggagaccccctgccgggagctggaggaggaggaggagtggggcagcggctctgaagatgccagcaagaaggatggagctgtggagagcatctctgtgcctgacatggtggacaagaacctgacctgcccagaggaggaggacacagtgaaggtggtgggcatccctggctgccagacctgccgctacctgctggtgcgcagcctgcagaccttcagccaggcctggttcacctgccgccgctgctaccggggcaacctggtgtccatccacaacttcaacatcaactaccgcatccagtgcagcgtgtctgccctgaaccagggccaggtgtggattggaggccgcatcaccggcagcggccgctgccgccgcttccagtgggtggatggcagccgctggaactttgcctactgggccgcccaccagccctggagccggggcggccactgtgtggccctgtgcacccggggcggccactggaggcgggcccactgcctgcggcggctgcccttcatctgcagctactag

SEQ ID NO: 166423 - DNA, 669 bp, Artificial Sequence; identical to SEQ ID NO: 166422
  Description of Artificial Sequence: Synthetic coding sequence

SEQ ID NO: 166424 - DNA, 636 bp, Artificial Sequence
  Description of Artificial Sequence: Synthetic coding sequence
atgaagctgcccctgctgctggccctgctgtttggagctgtgtctgccctgcacctgcggtctgagaccagcacctttgagacccccctgggcgccaagaccctgcctgaagatgaggagaccccagagcaggagatggaggagaccccctgccgggagctggaggaggaggaggagtggggcagcggctctgaagatgccagcaagaaggatggagctgtggagagcatctctgtgcctgacatggtggacaagaacctgacctgcccagaggaggaggacacagtgaaggtggtgggcatccctggctgccagacctgccgctacctgctcttcacctgccgccgctgctaccggggcaacctggtgtccatccacaacttcaacatcaactaccgcatccagtgcagcgtgtctgccctgaaccagggccaggtgtggattggaggccgcatcactggaagtggccgctgccgccgcttccagtgggtggatggcagccgctggaactttgcctactgggccgcccaccagccctggagcagaggaggccactgtgtggccctgtgcacccggggcggccactggaggcgggcccactgcctgcggcggctgcccttcatctgcagctactag

SEQ ID NO: 166425 - DNA, 678 bp, Artificial Sequence
  Description of Artificial Sequence: Synthetic coding sequence
atgcagtgcctgctgctgctgcccttcctgctgctgggcaccgtgtctgccctgcacctggagaatgatgccccccacctggagagcctggagacccaggccgacctgggccaggacctggacagcagcaaggagcaggagcgggacctggccctgacagaggaggtgatccaggccgagggggaggaggtgaaggccagcgcctgccaggacaactttgaagatgaggaggccatggagagtgaccctgctgccctggacaaggacttccagtgcccccgggaggaggacatcgtggaggtgcagggcagcccccgctgcaagatctgccgctacctgctggtgaggacccccaagacctttgctgaggcccagaatgtgtgcagccgctgctacggcggcaacctggtgtccatccatgacttcaacttcaactaccgcatccagtgctgcaccagcacagtgaaccaggcccaggtgtggattggaggcaacctgcggggctggttcctgtggaagcgcttctgctggacagatggcagccactggaactttgcctactggagccctggccagcctggaaatggccagggcagctgtgtggccctgtgcaccaagggcggctactggaggcgggcccagtgtgacaagcagctgccctttgtgtgcagcttctag

SEQ ID NO: 166426 - DNA, 4092 bp, Artificial Sequence
  Description of Artificial Sequence: Synthetic coding sequence
atggcctggaagaccctgcccatctacctgctgctgctgctgtctgtgtttgtgatccagcaggtgagcagccaggagctgagctgcaagggccgctgctttgagagctttgagcggggccgggagtgtgactgtgatgcccagtgcaagaagtatgacaagtgctgcccagactatgagagcttctgtgccgaggtgcacaaccccaccagcccccccagcagcaagaaggcccccccacccagcggggccagccagaccatcaagagcaccaccaagaggagccccaagccacccaacaagaagaagaccaagaaggtgattgagagcgaggagatcacagaggagcacagcgtgtctgagaaccaggagagcagcagcagcagcagcagcagcagcagcagcagcaccatcaggaagatcaagagcagcaagaacagcgctgccaaccgggagctgcagaagaagctgaaggtgaaggacaacaagaagaacagaaccaagaagaagcccacccccaagccccctgtggtggatgaagctggcagcggcctggacaatggagacttcaaggtgaccaccccagacaccagcaccacccagcacaacaaggtgtccaccagccccaagatcaccacagccaagcccatcaacccccggcccagcctgccccccaacagcgacaccagcaaggagaccagcctgactgtgaacaaggagaccaccgtggagaccaaggagaccaccaccaccaacaagcagaccagcacagatggcaaggagaagaccaccagcgccaaggagacccagagcattgagaagaccagcgccaaggacctggcccccaccagcaaggtgctggccaagcccacccccaaggccgagaccaccaccaagggccctgccctgaccacccccaaggagcccacccccaccacccccaaggagcccgccagcaccacccccaaggagcccacccccaccaccatcaagagcgcccccaccacccccaaggagcccgcccccaccaccaccaagagcgcccccaccacccccaaggagcccgcccccaccaccaccaaggagcccgcccccaccacccccaaggagcccgcccccaccaccaccaaggagcccgcccccaccaccaccaagagcgcccccaccacccccaaggagcccgcccccaccacccccaagaagccagcccccaccacccccaaggagcccgcccccaccacccccaaggagcccacccccaccacccccaaggagcccgcccccaccaccaaggagcccgcccccaccacccccaaggagcccgcccccacagcccccaagaagccagcccccaccacccccaaggagcccgcccccaccacccccaaggagcccgcccccaccaccaccaaggagcccagccccaccacccccaaggagcccgcccccaccaccaccaagagcgcccccaccaccaccaaggagcccgcccccaccaccaccaagagcgcccccaccacccccaaggagcccagccccaccaccaccaaggagcccgcccccaccacccccaaggagcccgcccccaccacccccaagaagccagcccccaccacccccaaggagcccgcccccaccacccccaaggagcccgcccccaccaccaccaagaagccagcccccaccacccccaaggagcccgcccccaccacccccaaggagacagcccccaccacccccaagaagctgacccccaccaccccagagaagctggcccccaccaccccagagaagccagcccccaccaccccagaggagctggcccccaccaccccagaggagcccacccccaccaccccagaggagcccgcccccaccacccccaaggctgctgcccccaacacccccaaggagcccgcccccaccacccccaaggagcccgcccccaccacccccaaggagcccgcccccaccacccccaaggagacagcccccaccacccccaagggcacagcccccaccaccctgaaggagcccgcccccaccacccccaagaagccagcccccaaggagctggcccccaccaccaccaaggagcccaccagcaccacctgtgacaagccagcccccaccacccccaagggcacagcccccaccacccccaaggagcccgcccccaccacccccaaggagcccgcccccaccacccccaagggcacagcccccaccaccctgaaggagcccgcccccaccacccccaagaagccagcccccaaggagctggcccccaccaccaccaagggccccaccagcaccaccagtgacaagccagcccccaccacccccaaggagacagcccccaccacccccaaggagcccgcccccaccacccccaagaagccagcccccaccaccccagagaccccaccacccaccaccagcgaggtgtccacccccaccaccaccaaggagcccaccaccatccacaagagcccagatgagagcaccccagagctgtctgctgagcccacccccaaggccctggagaacagccccaaggagcccggggtgcccaccaccaagaccccagctgccaccaagccagagatgaccaccacagccaaggacaagaccacagagcgggacctgcggaccaccccagagaccaccacagctgcccccaagatgaccaaggagacagccaccaccacagagaagaccacagagagcaagatcacagccaccaccacccaggtgaccagcaccaccacccaggacaccacccccttcaagatcaccaccctgaagaccaccaccctggcccccaaggtgaccaccaccaagaagaccatcaccaccacagagatcatgaacaagccagaggagacagccaagcccaaggaccgggccaccaacagcaaggccaccacccccaagccccagaagcccaccaaggcccccaagaagcccaccagcaccaagaagcccaagaccatgccccgggtgaggaagcccaagaccacccccacccccaggaagatgaccagcaccatgcctgagctgaaccccaccagcagaattgctgaggccatgctgcagaccaccacccggcccaaccagacccccaacagcaagctggtggaggtgaaccccaagtcagaagatgctgggggcgctgagggggagaccccccacatgctgctgcggccccacgtgttcatgcctgaggtgaccccagacatggactacctgccccgggtgcccaaccagggcatcatcatcaaccccatgctgagtgatgagaccaacatctgcaatggcaagcctgtggatggcctgaccaccctgagaaatggcaccctggtggccttccggggccactacttctggatgctgagccccttcagcccccccagccctgcccggcgcatcacagaggtgtggggcatccccagccccatcgacaccgtcttcacccgctgcaactgtgagggcaagaccttcttcttcaaggacagccagtactggaggttcaccaatgacatcaaggatgctggctaccccaagcccatcttcaagggctttggaggcctgaccggccagatcgtggccgccctgagcacagccaagtacaagaactggccagagagcgtgtacttcttcaagaggggcggcagcatccagcagtacatctacaagcaggagcctgtgcagaagtgccctggaagaagacctgccctgaactaccctgtgtatggagagaccacccaggtgagaagaagaagatttgagcgggccatcggccccagccagacccacaccatccgcatccagtacagccctgcccggctggcctaccaggacaagggcgtgctgcacaatgaggtgaaggtgtccatcctgtggaggggcctgcccaacgtggtgaccagcgccatcagcctgcccaacatcaggaagccagatggctatgactactatgccttcagcaaggaccagtactacaacattgatgtgcccagcaggacagcccgggccatcaccaccaggagcggccagaccctgagcaaggtgtggtacaactgcccctag

SEQ ID NO: 166427 - DNA, 2802 bp, Artificial Sequence
  Description of Artificial Sequence: Synthetic coding sequence
atggcctggaagaccctgcccatctacctgctgctgctgctgtctgtgtttgtgatccagcaggtgagcagccaggagctgagctgcaagggccgctgctttgagagctttgagcggggccgggagtgtgactgtgatgcccagtgcaagaagtatgacaagtgctgcccagactatgagagcttctgtgccgaggtgcacaaccccaccagcccccccagcagcaagaaggcccccccacccagcggggccagccagaccatcaagagcaccaccaagaggagccccaagccacccaacaagaagaagaccaagaaggtgattgagagcgaggagatcacagaggagcacagcgtgtctgagaaccaggagagcagcagcagcagcagcagcagcagcagcagcagcaccatcaggaagatcaagagcagcaagaacagcgctgccaaccgggagctgcagaagaagctgaaggtgaaggacaacaagaagaacagaaccaagaagaagcccacccccaagccccctgtggtggatgaagctggcagcggcctggacaatggagacttcaaggtgaccaccccagacaccagcaccacccagcacaacaaggtgtccaccagccccaagatcaccacagccaagcccatcaacccccggcccagcctgccccccaacagcgacaccagcaaggagaccagcctgactgtgaacaaggagaccaccgtggagaccaaggagaccaccaccaccaacaagcagaccagcacagatggcaaggagaagaccaccagcgccaaggagacccagagcattgagaagaccagcgccaaggacctggcccccaccagcaaggtgctggccaagcccacccccaaggccgagaccaccaccaagggccctgccctgaccacccccaaggagcccacccccaccacccccaaggagcccgccagcaccacccccaaggagcccacccccaccaccatcaagagcgcccccaccacccccaaggagcccgcccccaccaccaccaagagcgcccccaccacccccaaggagcccgcccccaccaccaccaaggagcccgcccccaccacccccaagaagccagcccccaccaccccagagaccccaccacccaccaccagcgaggtgtccacccccaccaccaccaaggagcccaccaccatccacaagagcccagatgagagcaccccagagctgtctgctgagcccacccccaaggccctggagaacagccccaaggagcccggggtgcccaccaccaagaccccagctgccaccaagccagagatgaccaccacagccaaggacaagaccacagagcgggacctgcggaccaccccagagaccaccacagctgcccccaagatgaccaaggagacagccaccaccacagagaagaccacagagagcaagatcacagccaccaccacccaggtgaccagcaccaccacccaggacaccacccccttcaagatcaccaccctgaagaccaccaccctggcccccaaggtgaccaccaccaagaagaccatcaccaccacagagatcatgaacaagccagaggagacagccaagcccaaggaccgggccaccaacagcaaggccaccacccccaagccccagaagcccaccaaggcccccaagaagcccaccagcaccaagaagcccaagaccatgccccgggtgaggaagcccaagaccacccccacccccaggaagatgaccagcaccatgcctgagctgaaccccaccagcagaattgctgaggccatgctgcagaccaccacccggcccaaccagacccccaacagcaagctggtggaggtgaaccccaagtcagaagatgctgggggcgctgagggggagaccccccacatgctgctgcggccccacgtgttcatgcctgaggtgaccccagacatggactacctgccccgggtgcccaaccagggcatcatcatcaaccccatgctgagtgatgagaccaacatctgcaatggcaagcctgtggatggcctgaccaccctgagaaatggcaccctggtggccttccggggccactacttctggatgctgagccccttcagcccccccagccctgcccggcgcatcacagaggtgtggggcatccccagccccatcgacaccgtcttcacccgctgcaactgtgagggcaagaccttcttcttcaaggacagccagtactggaggttcaccaatgacatcaaggatgctggctaccccaagcccatcttcaagggctttggaggcctgaccggccagatcgtggccgccctgagcacagccaagtacaagaactggccagagagcgtgtacttcttcaagaggggcggcagcatccagcagtacatctacaagcaggagcctgtgcagaagtgccctggaagaagacctgccctgaactaccctgtgtatggagagaccacccaggtgagaagaagaagatttgagcgggccatcggccccagccagacccacaccatccgcatccagtacagccctgcccggctggcctaccaggacaagggcgtgctgcacaatgaggtgaaggtgtccatcctgtggaggggcctgcccaacgtggtgaccagcgccatcagcctgcccaacatcaggaagccagatggctatgactactatgccttcagcaaggaccagtactacaacattgatgtgcccagcaggacagcccgggccatcaccaccaggagcggccagaccctgagcaaggtgtggtacaactgcccctag

SEQ ID NO: 166428 - DNA, 3936 bp, Artificial Sequence
  Description of Artificial Sequence: Synthetic coding sequence
atggcctggaagaccctgcccatctacctgctgctgctgctgtctgtgtttgtgatccagcaggtgagcagccaggacctgagcagctgtgccggccgctgtggggagggctacagcagagatgccacctgcaactgtgactacaactgccagcactacatggagtgctgcccagacttcaagagggtgtgcacagctgagctgagctgcaagggccgctgctttgagagctttgagcggggcagagaatgtgactgtgatgcccagtgcaagaagtatgacaagtgctgcccagactatgagagcttctgtgccgaggtgaaggacaacaagaagaacagaaccaagaagaagcccacccccaagccccctgtggtggatgaagctggcagcggcctggacaatggagacttcaaggtgaccaccccagacaccagcaccacccagcacaacaaggtgtccaccagccccaagatcaccacagccaagcccatcaacccccggcccagcctgccccccaacagcgacaccagcaaggagaccagcctgactgtgaacaaggagaccaccgtggagaccaaggagaccaccaccaccaacaagcagaccagcacagatggcaaggagaagaccaccagcgccaaggagacccagagcattgagaagaccagcgccaaggacctggcccccaccagcaaggtgctggccaagcccacccccaaggccgagaccaccaccaagggccctgccctgaccacccccaaggagcccacccccaccacccccaaggagcccgccagcaccacccccaaggagcccacccccaccaccatcaagagcgcccccaccacccccaaggagcccgcccccaccaccaccaagagcgcccccaccacccccaaggagcccgcccccaccaccaccaaggagcccgcccccaccacccccaaggagcccgcccccaccaccaccaaggagcccgcccccaccaccaccaagagcgcccccaccacccccaaggagcccgcccccaccacccccaagaagccagcccccaccacccccaaggagcccgcccccaccacccccaaggagcccacccccaccacccccaaggagcccgcccccaccaccaaggagcccgcccccaccacccccaaggagcccgcccccacagcccccaagaagccagcccccaccacccccaaggagcccgcccccaccacccccaaggagcccgcccccaccaccaccaaggagcccagccccaccacccccaaggagcccgcccccaccaccaccaagagcgcccccaccaccaccaaggagcccgcccccaccaccaccaagagcgcccccaccacccccaaggagcccagccccaccaccaccaaggagcccgcccccaccacccccaaggagcccgcccccaccacccccaagaagccagcccccaccacccccaaggagcccgcccccaccacccccaaggagcccgcccccaccaccaccaagaagccagcccccaccacccccaaggagcccgcccccaccacccccaaggagacagcccccaccacccccaagaagctgacccccaccaccccagagaagctggcccccaccaccccagagaagccagcccccaccaccccagaggagctggcccccaccaccccagaggagcccacccccaccaccccagaggagcccgcccccaccacccccaaggctgctgcccccaacacccccaaggagcccgcccccaccacccccaaggagcccgcccccaccacccccaaggagcccgcccccaccacccccaaggagacagcccccaccacccccaagggcacagcccccaccaccctgaaggagcccgcccccaccacccccaagaagccagcccccaaggagctggcccccaccaccaccaaggagcccaccagcaccacctgtgacaagccagcccccaccacccccaagggcacagcccccaccacccccaaggagcccgcccccaccacccccaaggagcccgcccccaccacccccaagggcacagcccccaccaccctgaaggagcccgcccccaccacccccaagaagccagcccccaaggagctggcccccaccaccaccaagggccccaccagcaccaccagtgacaagccagcccccaccacccccaaggagacagcccccaccacccccaaggagcccgcccccaccacccccaagaagccagcccccaccaccccagagaccccaccacccaccaccagcgaggtgtccacccccaccaccaccaaggagcccaccaccatccacaagagcccagatgagagcaccccagagctgtctgctgagcccacccccaaggccctggagaacagccccaaggagcccggggtgcccaccaccaagaccccagctgccaccaagccagagatgaccaccacagccaaggacaagaccacagagcgggacctgcggaccaccccagagaccaccacagctgcccccaagatgaccaaggagacagccaccaccacagagaagaccacagagagcaagatcacagccaccaccacccaggtgaccagcaccaccacccaggacaccacccccttcaagatcaccaccctgaagaccaccaccctggcccccaaggtgaccaccaccaagaagaccatcaccaccacagagatcatgaacaagccagaggagacagccaagcccaaggaccgggccaccaacagcaaggccaccacccccaagccccagaagcccaccaaggcccccaagaagcccaccagcaccaagaagcccaagaccatgccccgggtgaggaagcccaagaccacccccacccccaggaagatgaccagcaccatgcctgagctgaaccccaccagcagaattgctgaggccatgctgcagaccaccacccggcccaaccagacccccaacagcaagctggtggaggtgaaccccaagtcagaagatgctgggggcgctgagggggagaccccccacatgctgctgcggccccacgtgttcatgcctgaggtgaccccagacatggactacctgccccgggtgcccaaccagggcatcatcatcaaccccatgctgagtgatgagaccaacatctgcaatggcaagcctgtggatggcctgaccaccctgagaaatggcaccctggtggccttccggggccactacttctggatgctgagccccttcagcccccccagccctgcccggcgcatcacagaggtgtggggcatccccagccccatcgacaccgtcttcacccgctgcaactgtgagggcaagaccttcttcttcaaggacagccagtactggaggttcaccaatgacatcaaggatgctggctaccccaagcccatcttcaagggctttggaggcctgaccggccagatcgtggccgccctgagcacagccaagtacaagaactggccagagagcgtgtacttcttcaagaggggcggcagcatccagcagtacatctacaagcaggagcctgtgcagaagtgccctggaagaagacctgccctgaactaccctgtgtatggagagaccacccaggtgagaagaagaagatttgagcgggccatcggccccagccagacccacaccatccgcatccagtacagccctgcccggctggcctaccaggacaagggcgtgctgcacaatgaggtgaaggtgtccatcctgtggaggggcctgcccaacgtggtgaccagcgccatcagcctgcccaacatcaggaagccagatggctatgactactatgccttcagcaaggaccagtactacaacattgatgtgcccagcaggacagcccgggccatcaccaccaggagcggccagaccctgagcaaggtgtggtacaactgcccctag

SEQ ID NO: 166429 - DNA, 4086 bp, Artificial Sequence
  Description of Artificial Sequence: Synthetic coding sequence
atggcctggaagaccctgcccatctacctgctgctgctgctgtctgtgtttgtgatccagcaggtgagcagccaggacctgagcagctgtgccggccgctgtggggagggctacagcagagatgccacctgcaactgtgactacaactgccagcactacatggagtgctgcccagacttcaagagggtgtgcacagctgagctgagctgcaagggccgctgctttgagagctttgagcggggcagagaatgtgactgtgatgcccagtgcaagaagtatgacaagtgctgcccagactatgagagcttctgtgccgaggtgcacaaccccaccagcccccccagcagcaagaaggcccctcctccttctggggccagccagaccatcaagagcaccaccaagaggagccccaagccacccaacaagaagaagaccaagaaggtgattgaaagtgaggagatcacagaggtgaaggacaacaagaagaacagaaccaagaagaagcccacccccaagccccctgtggtggatgaagctggcagcggcctggacaatggagacttcaaggtgaccaccccagacaccagcaccacccagcacaacaaggtgtccaccagccccaagatcaccacagccaagcccatcaacccccggcccagcctgccccccaacagcgacaccagcaaggagaccagcctgactgtgaacaaggagaccaccgtggagaccaaggagaccaccaccaccaacaagcagaccagcacagatggcaaggagaagaccaccagcgccaaggagacccagagcattgagaagaccagcgccaaggacctggcccccaccagcaaggtgctggccaagcccacccccaaggccgagaccaccaccaagggccctgccctgaccacccccaaggagcccacccccaccacccccaaggagcccgccagcaccacccccaaggagcccacccccaccaccatcaagagcgcccccaccacccccaaggagcccgcccccaccaccaccaagagcgcccccaccacccccaaggagcccgcccccaccaccaccaaggagcccgcccccaccacccccaaggagcccgcccccaccaccaccaaggagcccgcccccaccaccaccaagagcgcccccaccacccccaaggagcccgcccccaccacccccaagaagccagcccccaccacccccaaggagcccgcccccaccacccccaaggagcccacccccaccacccccaaggagcccgcccccaccaccaaggagcccgcccccaccacccccaaggagcccgcccccacagcccccaagaagccagcccccaccacccccaaggagcccgcccccaccacccccaaggagcccgcccccaccaccaccaaggagcccagccccaccacccccaaggagcccgcccccaccaccaccaagagcgcccccaccaccaccaaggagcccgcccccaccaccaccaagagcgcccccaccacccccaaggagcccagccccaccaccaccaaggagcccgcccccaccacccccaaggagcccgcccccaccacccccaagaagccagcccccaccacccccaaggagcccgcccccaccacccccaaggagcccgcccccaccaccaccaagaagccagcccccaccacccccaaggagcccgcccccaccacccccaaggagacagcccccaccacccccaagaagctgacccccaccaccccagagaagctggcccccaccaccccagagaagccagcccccaccaccccagaggagctggcccccaccaccccagaggagcccacccccaccaccccagaggagcccgcccccaccacccccaaggctgctgcccccaacacccccaaggagcccgcccccaccacccccaaggagcccgcccccaccacccccaaggagcccgcccccaccacccccaaggagacagcccccaccacccccaagggcacagcccccaccaccctgaaggagcccgcccccaccacccccaagaagccagcccccaaggagctggcccccaccaccaccaaggagcccaccagcaccacctgtgacaagccagcccccaccacccccaagggcacagcccccaccacccccaaggagcccgcccccaccacccccaaggagcccgcccccaccacccccaagggcacagcccccaccaccctgaaggagcccgcccccaccacccccaagaagccagcccccaaggagctggcccccaccaccaccaagggccccaccagcaccaccagtgacaagccagcccccaccacccccaaggagacagcccccaccacccccaaggagcccgcccccaccacccccaagaagccagcccccaccaccccagagaccccaccacccaccaccagcgaggtgtccacccccaccaccaccaaggagcccaccaccatccacaagagcccagatgagagcaccccagagctgtctgctgagcccacccccaaggccctggagaacagccccaaggagcccggggtgcccaccaccaagaccccagctgccaccaagccagagatgaccaccacagccaaggacaagaccacagagcgggacctgcggaccaccccagagaccaccacagctgcccccaagatgaccaaggagacagccaccaccacagagaagaccacagagagcaagatcacagccaccaccacccaggtgaccagcaccaccacccaggacaccacccccttcaagatcaccaccctgaagaccaccaccctggcccccaaggtgaccaccaccaagaagaccatcaccaccacagagatcatgaacaagccagaggagacagccaagcccaaggaccgggccaccaacagcaaggccaccacccccaagccccagaagcccaccaaggcccccaagaagcccaccagcaccaagaagcccaagaccatgccccgggtgaggaagcccaagaccacccccacccccaggaagatgaccagcaccatgcctgagctgaaccccaccagcagaattgctgaggccatgctgcagaccaccacccggcccaaccagacccccaacagcaagctggtggaggtgaaccccaagtcagaagatgctgggggcgctgagggggagaccccccacatgctgctgcggccccacgtgttcatgcctgaggtgaccccagacatggactacctgccccgggtgcccaaccagggcatcatcatcaaccccatgctgagtgatgagaccaacatctgcaatggcaagcctgtggatggcctgaccaccctgagaaatggcaccctggtggccttccggggccactacttctggatgctgagccccttcagcccccccagccctgcccggcgcatcacagaggtgtggggcatccccagccccatcgacaccgtcttcacccgctgcaactgtgagggcaagaccttcttcttcaaggacagccagtactggaggttcaccaatgacatcaaggatgctggctaccccaagcccatcttcaagggctttggaggcctgaccggccagatcgtggccgccctgagcacagccaagtacaagaactggccagagagcgtgtacttcttcaagaggggcggcagcatccagcagtacatctacaagcaggagcctgtgcagaagtgccctggaagaagacctgccctgaactaccctgtgtatggagagaccacccaggtgagaagaagaagatttgagcgggccatcggccccagccagacccacaccatccgcatccagtacagccctgcccggctggcctaccaggacaagggcgtgctgcacaatgaggtgaaggtgtccatcctgtggaggggcctgcccaacgtggtgaccagcgccatcagcctgcccaacatcaggaagccagatggctatgactactatgccttcagcaaggaccagtactacaacattgatgtgcccagcaggacagcccgggccatcaccaccaggagcggccagaccctgagcaaggtgtggtacaactgcccctag

SEQ ID NO: 166430 - DNA, 4215 bp, Artificial Sequence
  Description of Artificial Sequence: Synthetic coding sequence
atggcctggaagaccctgcccatctacctgctgctgctgctgtctgtgtttgtgatccagcaggtgagcagccaggacctgagcagctgtgccggccgctgtggggagggctacagcagagatgccacctgcaactgtgactacaactgccagcactacatggagtgctgcccagacttcaagagggtgtgcacagctgagctgagctgcaagggccgctgctttgagagctttgagcggggcagagaatgtgactgtgatgcccagtgcaagaagtatgacaagtgctgcccagactatgagagcttctgtgccgaggtgcacaaccccaccagcccccccagcagcaagaaggcccctcctccttctggggccagccagaccatcaagagcaccaccaagaggagccccaagccacccaacaagaagaagaccaagaaggtgattgaaagtgaggagatcacagaggagcacagcgtgtctgagaaccaggagagcagcagcagcagcagcagcagcagcagcagcagcaccatcaggaagatcaagagcagcaagaacagcgctgccaaccgggagctgcagaagaagctgaaggtgaaggacaacaagaagaacagaaccaagaagaagcccacccccaagccccctgtggtggatgaggccggcagcggcctggacaacggggacttcaaggtgaccaccccagacaccagcaccacccagcacaacaaggtgtccaccagccccaagatcaccacagccaagcccatcaacccccggcccagcctgccccccaacagcgacaccagcaaggagaccagcctgactgtgaacaaggagaccaccgtggagaccaaggagaccaccaccaccaacaagcagaccagcacagatggcaaggagaagaccaccagcgccaaggagacccagagcattgagaagaccagcgccaaggacctggcccccaccagcaaggtgctggccaagcccacccccaaggccgagaccaccaccaagggccctgccctgaccacccccaaggagcccacccccaccacccccaaggagcccgccagcaccacccccaaggagcccacccccaccaccatcaagagcgcccccaccacccccaaggagcccgcccccaccaccaccaagagcgcccccaccacccccaaggagcccgcccccaccaccaccaaggagcccgcccccaccacccccaaggagcccgcccccaccaccaccaaggagcccgcccccaccaccaccaagagcgcccccaccacccccaaggagcccgcccccaccacccccaagaagccagcccccaccacccccaaggagcccgcccccaccacccccaaggagcccacccccaccacccccaaggagcccgcccccaccaccaaggagcccgcccccaccacccccaaggagcccgcccccacagcccccaagaagccagcccccaccacccccaaggagcccgcccccaccacccccaaggagcccgcccccaccaccaccaaggagcccagccccaccacccccaaggagcccgcccccaccaccaccaagagcgcccccaccaccaccaaggagcccgcccccaccaccaccaagagcgcccccaccacccccaaggagcccagccccaccaccaccaaggagcccgcccccaccacccccaaggagcccgcccccaccacccccaagaagccagcccccaccacccccaaggagcccgcccccaccacccccaaggagcccgcccccaccaccaccaagaagccagcccccaccacccccaaggagcccgcccccaccacccccaaggagacagcccccaccacccccaagaagctgacccccaccaccccagagaagctggcccccaccaccccagagaagccagcccccaccaccccagaggagctggcccccaccaccccagaggagcccacccccaccaccccagaggagcccgcccccaccacccccaaggccgccgcccccaacacccccaaggagcccgcccccaccacccccaaggagcccgcccccaccacccccaaggagcccgcccccaccacccccaaggagacagcccccaccacccccaagggcacagcccccaccaccctgaaggagcccgcccccaccacccccaagaagccagcccccaaggagctggcccccaccaccaccaaggagcccaccagcaccacctgtgacaagccagcccccaccacccccaagggcacagcccccaccacccccaaggagcccgcccccaccacccccaaggagcccgcccccaccacccccaagggcacagcccccaccaccctgaaggagcccgcccccaccacccccaagaagccagcccccaaggagctggcccccaccaccaccaagggccccaccagcaccaccagtgacaagccagcccccaccacccccaaggagacagcccccaccacccccaaggagcccgcccccaccacccccaagaagccagcccccaccaccccagagaccccaccacccaccaccagcgaggtgtccacccccaccaccaccaaggagcccaccaccatccacaagagcccagatgagagcaccccagagctgtctgctgagcccacccccaaggccctggagaacagccccaaggagcccggggtgcccaccaccaagaccccagctgccaccaagccagagatgaccaccacagccaaggacaagaccacagagcgggacctgcggaccaccccagagaccaccacagctgcccccaagatgaccaaggagacagccaccaccacagagaagaccacagagagcaagatcacagccaccaccacccaggtgaccagcaccaccacccaggacaccacccccttcaagatcaccaccctgaagaccaccaccctggcccccaaggtgaccaccaccaagaagaccatcaccaccacagagatcatgaacaagccagaggagacagccaagcccaaggaccgggccaccaacagcaaggccaccacccccaagccccagaagcccaccaaggcccccaagaagcccaccagcaccaagaagcccaagaccatgccccgggtgaggaagcccaagaccacccccacccccaggaagatgaccagcaccatgcctgagctgaaccccaccagcagaattgctgaggccatgctgcagaccaccacccggcccaaccagacccccaacagcaagctggtggaggtgaaccccaagtcagaagatgctggaggagctgagggggagaccccccacatgctgctgcggccccacgtgttcatgcctgaggtgaccccagacatggactacctgccccgggtgcccaaccagggcatcatcatcaaccccatgctgagtgatgagaccaacatctgcaatggcaagcctgtggatggcctgaccaccctgagaaatggcaccctggtggccttccggggccactacttctggatgctgagccccttcagcccccccagccctgcccggcgcatcacagaggtgtggggcatccccagccccatcgacacagtgttcacccgctgcaactgtgagggcaagaccttcttcttcaaggacagccagtactggaggttcaccaatgacatcaaggatgctggctaccccaagcccatcttcaagggctttggaggcctgaccggccagatcgtggccgccctgagcacagccaagtacaagaactggccagagagcgtgtacttcttcaagagaggaggcagcatccagcagtacatctacaagcaggagcctgtgcagaagtgccccggccggcggcctgccctgaactaccctgtgtatggagagaccacccaggtgagaagaagaagatttgagcgggccatcggccccagccagacccacaccatccgcatccagtacagccctgcccggctggcctaccaggacaagggcgtgctgcacaatgaggtgaaggtgtccatcctgtggaggggcctgcccaacgtggtgaccagcgccatcagcctgcccaacatcaggaagccagatggctatgactactatgccttcagcaaggaccagtactacaacattgatgtgcccagcaggacagcccgggccatcaccaccaggagcggccagaccctgagcaaggtgtggtacaactgcccctag

SEQ ID NO: 166431 - DNA, 834 bp, Artificial Sequence
  Description of Artificial Sequence: Synthetic coding sequence
atgggcctgctggagtgctgtgcccgctgcctggtgggcgccccctttgccagcctggtggccaccggcctgtgcttctttggagtggccctcttctgtggctgcggccacgaggccctgactggaacagagaagctgattgagacctacttcagcaagaactaccaggactatgagtacctgatcaacgtcatccacgccttccagtatgtgatctatggaacagccagcttcttcttcctgtatggagccctgctgctggccgagggcttctacaccaccggggctgtgcggcagatctttggagactacaagaccaccatctgtgggaagggcctgagcgccaccgtgactggaggccagaagggccggggcagccggggccagcaccaggcccacagcctggagcgggtgtgccactgcctgggcaagtggctgggccacccagacaagtttgtgggcatcacctacgccctgactgtggtgtggctgctggtgtttgcctgcagcgctgtgcctgtgtacatctacttcaacacctggaccacctgccagagcatcgccttccccagcaagaccagcgccagcatcggcagcctgtgtgctgatgccaggatgtatggagtgctgccctggaatgccttccctgggaaggtgtgtggcagcaacctgctgagcatctgcaagacagctgagttccagatgaccttccacctgttcatcgccgcctttgtgggcgccgccgccaccctggtgtccctgctgaccttcatgattgctgccacctacaactttgctgtgctgaagctgatgggccggggcaccaagttctag

SEQ ID NO: 166432 - DNA, 729 bp, Artificial Sequence
  Description of Artificial Sequence: Synthetic coding sequence
atgggcctgctggagtgctgtgcccgctgcctggtgggcgccccctttgccagcctggtggccaccggcctgtgcttctttggagtggccctcttctgtggctgcggccacgaggccctgactggaacagagaagctgattgagacctacttcagcaagaactaccaggactatgagtacctgatcaacgtcatccacgccttccagtatgtgatctatggaacagccagcttcttcttcctgtatggagccctgctgctggccgagggcttctacaccaccggggctgtgcggcagatctttggagactacaagaccaccatctgtgggaagggcctgagcgccacctttgtgggcatcacctacgccctgactgtggtgtggctgctggtgtttgcctgcagcgctgtgcctgtgtacatctacttcaacacctggaccacctgccagagcatcgccttccccagcaagaccagcgccagcatcggcagcctgtgtgctgatgccaggatgtatggagtgctgccctggaatgccttccctgggaaggtgtgtggcagcaacctgctgagcatctgcaagacagctgagttccagatgaccttccacctgttcatcgccgcctttgtgggcgctgctgccaccctggtgtccctgctgaccttcatgattgctgccacctacaactttgctgtgctgaagctgatgggccggggcaccaagttctag

SEQ ID NO: 166433 - DNA, 834 bp, Artificial Sequence; identical to SEQ ID NO: 166431
  Description of Artificial Sequence: Synthetic coding sequence

SEQ ID NO: 166434 - DNA, 384 bp, Artificial Sequence
  Description of Artificial Sequence: Synthetic coding sequence
atgggcctgctggagtgctgtgcccgctgcctggtgggcgccccctttgccagcctggtggccaccggcctgtgcttctttggagtggccctcttctgtggctgcggccacgaggccctgactggaacagagaagctgattgagacctacttcagcaagaactaccaggactatgagtacctgatcaacgtcatccacgccttccagtatgtgatctatggaacagccagcttcttcttcctgtatggagccctgctgctggccgagggcttctacaccaccggggctgtgcggcagatctttggagactacaagaccaccatctgtgggaagggcctgagcgccaccgtgactggaggccagaagggccggggcagcaggtag

SEQ ID NO: 166435 - DNA, 768 bp, Artificial Sequence
  Description of Artificial Sequence: Synthetic coding sequence
atgggcctgctggagtgctgtgcccgctgcctggtgggcgccccctttgccagcctggtggccaccggcctgtgcttctttggagtggccctcttctgtggctgcggccacgaggccctgactggaacagagaagctgattgagacctacttcagcaagaactaccaggactatgagtacctgatcaacgtcatccacgccttccagtatgtgatctatggaacagccagcttcttcttcctgtatggagccctgctgctggccgagggcttctacaccaccggggctgtgcggcagaagggccggggcagccggggccagcaccaggcccacagcctggagcgggtgtgccactgcctgggcaagtggctgggccacccagacaagtttgtgggcatcacctacgccctgactgtggtgtggctgctggtgtttgcctgcagcgctgtgcctgtgtacatctacttcaacacctggaccacctgccagagcatcgccttccccagcaagaccagcgccagcatcggcagcctgtgtgctgatgccaggatgtatggagtgctgccctggaatgccttccctgggaaggtgtgtggcagcaacctgctgagcatctgcaagacagctgagttccagatgaccttccacctgttcatcgccgcctttgtgggcgccgccgccaccctggtgtccctgctgaccttcatgattgctgccacctacaactttgctgtgctgaagctgatgggccggggcaccaagttctag

SEQ ID NO: 166436 - DNA, 414 bp, Artificial Sequence
  Description of Artificial Sequence: Synthetic coding sequence
atgggcctgctggagtgctgtgcccgctgcctggtgggcgccccctttgccagcctggtggccaccggcctgtgcttctttggagtggccctcttctgtggctgcggccacgaggccctgactggaacagagaagctgattgagacctacttcagcaagaactaccaggactatgagtacctgatcaacgtcatccacgccttccagtatgtgatctatggaacagccagcttcttcttcctgtatggagccctgctgctggccgagggcttctacaccaccggggctgtgcggcagatctttggagactacaagaccaccatctgtgggaagggcctgagcgccaccgtgactggaggccagaagggccggggcagccggggccagcaccaggcccacagcctggagaggtag

SEQ ID NO: 166437 - DNA, 303 bp, Artificial Sequence
  Description of Artificial Sequence: Synthetic coding sequence
atgggcctgctggagtgctgtgcccgctgcctggtgggcgccccctttgccagcctggtggccaccggcctgtgcttctttggagtggccctcttctgtggctgcggccacgaggccctgactggaacagagaagctgattgagacctacttcagcaagaactaccaggactatgagtacctgatcaacgtcatccacgccttccagtatgtgatctatggaacagccagcttcttcttcctgtatggagccctgctgctggccgagggcttctacaccaccggggctgtgcggcagatctag

SEQ ID NO: 166438 - DNA, 372 bp, Artificial Sequence
  Description of Artificial Sequence: Synthetic coding sequence
atgggcctgctggagtgctgtgcccgctgcctggtgggcgccccctttgccagcctggtggccaccggcctgtgcttctttggagtggccctcttctgtggctgcggccacgaggccctgactggaacagagaagctgattgagacctacttcagcaagaactaccaggactatgagtacctgatcaacgtcatccacgccttccagtatgtgatctatggaacagccagcttcttcttcctgtatggagccctgctgctggccgagggcttctacaccaccggggctgtgcggcagatctttggagactacaagaccaccatctgtgggaagggcctgagcgccaccgtgactggaggccagaagggctag

SEQ ID NO: 166439 - DNA, 339 bp, Artificial Sequence
  Description of Artificial Sequence: Synthetic coding sequence
atgggcctgctggagtgctgtgcccgctgcctggtgggcgccccctttgccagcctggtggccaccggcctgtgcttctttggagtggccctcttctgtggctgcggccacgaggccctgactggaacagagaagctgattgagacctacttcagcaagaactaccaggactatgagtacctgatcaacgtcatccacgccttccagtatgtgatctatggaacagccagcttcttcttcctgtatggagccctgctgctggccgagggcttctacaccaccggggctgtgcggcagatctttggagactacaagaccaccatctgtgggaaaggatag

SEQ ID NO: 166440 - DNA, 411 bp, Artificial Sequence
  Description of Artificial Sequence: Synthetic coding sequence
atgggcctgctggagtgctgtgcccgctgcctggtgggcgccccctttgccagcctggtggccaccggcctgtgcttctttggagtggccctcttctgtggctgcggccacgaggccctgactggaacagagaagctgattgagacctacttcagcaagaactaccaggactatgagtacctgatcaacgtcatccacgccttccagtatgtgatctatggaacagccagcttcttcttcctgtatggagccctgctgctggccgagggcttctacaccaccggggctgtgcggcagatctttggagactacaagaccaccatctgtgggaagggcctgagcgccaccgtgactggaggccagaagggccggggcagccggggccagcaccaggcccacagcctggagtag

SEQ ID NO: 166441 - DNA, 438 bp, Artificial Sequence
  Description of Artificial Sequence: Synthetic coding sequence
atggctgacagcgagcggctgagcgcccctggctgctgggccgcctgcaccaacttcagcaggaccaggaagggcatcctgctgtttgctgagatcatcctgtgcctggtgatcctgatctgcttcagcgccagcaccccaggctacagcagcctgtctgtgattgagatgatcctggccgccatcttctttgtggtgtacatgtgtgacctgcacaccaagatccccttcatcaactggccctggagcgacttcttccgcaccctgattgctgccatcctgtacctgatcaccagcatcgtggtgctggtggagcggggcaaccacagcaagatcgtggccggcgtgaaggccatgggcgccgccctgaagcaccgggccaagggcctgcggagccagggccccttcctgcccctgctgctggccgagatcgtgtag

SEQ ID NO: 166442 - DNA, 459 bp, Artificial Sequence
  Description of Artificial Sequence: Synthetic coding sequence
atggctgacagcgagcggctgagcgcccctggctgctgggccgcctgcaccaacttcagcaggaccaggaagggcatcctgctgtttgctgagatcatcctgtgcctggtgatcctgatctgcttcagcgccagcaccccaggctacagcagcctgtctgtgattgagatgatcctggccgccatcttctttgtggtgtacatgtgtgacctgcacaccaagatccccttcatcaactggccctggagcgacttcttccgcaccctgattgctgccatcctgtacctgatcaccagcatcgtggtgctggtggagcggggcaaccacagcaagatcgtggccggcgtgctgggcctcatcgccacctgcctgtttggctatgatgcctacgtgaccttccctgtgcggcagcccaggcacacagctgcccccacagatcctgcagatggccctgtgtag

SEQ ID NO: 166443 - DNA, 336 bp, Artificial Sequence
  Description of Artificial Sequence: Synthetic coding sequence
atgtctgatgctgctgtggacaccagcagcgagatcaccaccaaggacctgaaggagaagaaggaggtggtggaggaggccgagaatggaagagatgccccagccaatggaaatgcagaaaatgaagaaaatggagagcaggaggccgacaatgaggtggatgaggaggaggaggagggcggggaggaggaggaggaggaggaggagggagatggagaggaggaggatggagatgaagatgaggaggccgagagcgccaccgggaagagagctgctgaagatgatgaagatgatgatgtggacaccaagaagcagaagacagatgaagatgactag

SEQ ID NO: 166444 - DNA, 408 bp, Artificial Sequence
  Description of Artificial Sequence: Synthetic coding sequence
atgcagaccttcggccctgctggggtggccgctgtgggccggcgggtggagagccctgctgaccggcgggccacccgggcctgccactgcaagctgtgcctgcctgctggcagcctgcagggcctgaagggggaggagggctctgtggaggaggctgaaaatggaagagatgccccagccaatggaaatgccaatgaagaaaatggagagcaggaggccgacaatgaggtggatgaggaggaggaggagggcggggaggaggaggaggaggaggaggagggagatggagaggaggaggatggagatgaagatgaggaggccgagagcgccaccgggaagagagctgctgaagatgatgaagatgatgatgtggacaccaagaagcagaagacagatgaagatgactag

SEQ ID NO: 166445 - DNA, 333 bp, Artificial Sequence
  Description of Artificial Sequence: Synthetic coding sequence
atgtctgatgctgctgtggacaccagcagcgagatcaccaccaaggacctgaaggagaagaaggaggtggtggaggaggccgagaatggaagagatgccccagccaatggaaatgccaatgaggagaatggagagcaggaggccgacaatgaggtggatgaggaggaggaggagggcggggaggaggaggaggaggaggaggagggagatggagaggaggaggatggagatgaagatgaggaggccgagagcgccaccgggaagagagctgctgaagatgatgaagatgatgatgtggacaccaagaagcagaagacagatgaagatgactag

SEQ ID NO: 166446 - DNA, 3714 bp, Artificial Sequence
  Description of Artificial Sequence: Synthetic coding sequence
atggattctggagctgggggccgccgctgcccagaggccgccctgctgatcctgggcccccccaggatggagcacctgcggcacagccctggccctgggggccagaggctgctgctgcccagcatgctgctggccctgctgctgctgctggcccccagccctggccacgccaccagggtggtgtacaaggtgcctgaggagcagccccccaacaccctcatcggcagcctggccgctgactatggcttcccagatgtgggccacctgtacaagctggaggtgggcgccccctacctgcgggtggatggcaagacaggagacatcttcaccacagagaccagcattgaccgggagggcctgcgggagtgccagaaccagctgcccggggacccctgcatcctggagtttgaggtgtccatcacagacctggtgcagaatggcagcccccggctgctggagggccagatcgaggtgcaggacatcaatgacaacacccccaactttgccagccctgtgatcaccctggccatccctgagaacaccaacatcggcagcctcttccccatccccctggccagtgacagagatgctggccccaacggggtggccagctatgagctgcaggccggccctgaggcccaggagctgtttggcctgcaggtggccgaggaccaggaggagaagcagccccagctgattgtgatgggcaacctggaccgggagcgctgggacagctatgacctgaccatcaaggtgcaggacggcggcagccccccccgggccagcagcgccctgctgcgggtgacagtgctggacaccaatgacaatgcccccaagtttgagcggcccagctatgaagctgagctgtctgagaacagccccatcggccacagcgtcatccaggtgaaggccaatgacagcgaccagggcgccaatgctgagattgagtacaccttccaccaggcccctgaggtggtgcggcggctgctgcggctggacaggaacacaggcctcatcaccgtgcagggccctgtggaccgggaggacctgagcaccctgcgcttctctgtgctggccaaggaccggggcaccaaccccaagagcgcccgggcccaggtggtggtgacagtgaaggacatgaatgacaatgcccccaccatcgagatccggggcatcggcctggtgacccaccaggacggcatggccaacatcagtgaagatgtggccgaggagacagctgtggccctggtgcaggtgtctgacagagatgaaggagaaaatgctgctgtgacctgtgtggtggccggagatgtgcccttccagctgcggcaggccagcgagaccggcagtgacagcaagaagaagtacttcctgcagaccaccacccccctggactatgagaaggtgaaggactacaccatcgagatcgtggccgtggacagcggcaacccccccctgagcagcaccaacagcctgaaggtgcaggtggtggatgtgaatgacaatgcccctgtgttcacccagagcgtgacagaggtggccttccctgagaacaacaagccaggagaggtgattgctgagatcacagccagtgatgctgacagcggcagcaatgctgagctggtgtacagcctggagcctgagcctgctgccaagggcctcttcaccatcagccctgagactggagagatccaggtgaagaccagcctggaccgggagcagcgggagagctatgagctgaaggtggtggccgctgaccggggcagccccagcctgcagggcacagccaccgtgctggtgaatgtgctggactgcaatgacaatgaccccaagttcatgctgagcggctacaacttctctgtgatggagaacatgcctgccctgagccctgtgggcatggtgacagtgattgatggagacaagggagaaaatgcccaggtgcagctgtctgtggagcaggacaatggagactttgtgatccagaatggcaccggcaccatcctgagcagcctgagctttgaccgggagcagcagagcacctacaccttccagctgaaggctgtggatggaggagtgcccccaagaagtgcctacgtgggcgtgaccatcaacgtgctggatgaaaatgacaatgccccctacatcacagcccccagcaacaccagccacaagctgctgaccccccagacccggctgggggagaccgtgtcccaggtggccgctgaggactttgacagcggcgtgaatgctgagctgatctacagcattgctgggggcaacccctacggcctcttccagatcggcagccacagcggggccatcaccctggagaaggagattgaaagaagacaccacggcctgcaccggctggtggtgaaggtgtctgaccggggcaagccacccaggtatggaacagccctggtgcacctgtatgtgaatgagaccctggccaacagaaccctgctggagaccctgctgggccacagcctggacacccccctggacatcgacattgctggggaccctgaatatgaaagaagcaagcagaggggcaacatcctgtttggagtggtggccggcgtggtggccgtggccctgctgattgccctggccgtgctggtgcgctactgccggcagcgggaggccaagagcggctaccaggccggcaagaaggagaccaaggacctgtatgcccccaagcccagcggcaaggccagcaaaggaaacaagagcaagggcaagaagagcaagagccccaagcctgtgaagcctgtggaggatgaagatgaagctggcctgcagaagagcctgaagttcaacctgatgtctgatgcccctggggacagcccccgcatccacctgcccctgaactacccacctggcagcccagacctgggccgccactaccgcagcaacagccccctgcccagcatccagctgcagccccagagccccagcgccagcaagaagcaccaggtggtgcaggacctgcccccagccaacacctttgtgggcaccggggacaccaccagcacaggcagcgagcagtacagcgactacagctaccgcaccaacccccccaagtaccccagcaagcagctgccccacagaagagtgaccttcagcgccaccagccaggcccaggagctgcaggaccccagccagcacagctactatgattctggcctggaggagagcgagacccccagcagcaagagcagcagcggcccccggctgggccccctggccctgcctgaggaccactatgaaagaaccaccccagatggcagcatcggggagatggagcacccagaaaatgacctgcggcccctgcctgatgtggccatgacaggcacctgcaccagagaatgttctgaatttggccacagcgacacctgctggatgcctggccagagcagccccagcaggaggaccaagagcagcgccctgaagctgagcacctttgtgccctaccaggaccggggcggccaggagcctgctggagctggcagccccagccccccagaggacaggaacaccaagacagcccctgtgcggctgctgcccagctacagcgccttcagccacagcagccatgacagctgcaaggacagcgccaccctggaggagatccccctgacccagaccagtgacttccccccagctgccaccccagccagcgcccagacagccaagcgggagatctacctgtag

SEQ ID NO: 166447 - DNA, 3183 bp, Artificial Sequence
  Description of Artificial Sequence: Synthetic coding sequence
atggattctggagctgggggccgccgctgcccagaggccgccctgctgatcctgggcccccccaggatggagcacctgcggcacagccctggccctgggggccagaggctgctgctgcccagcatgctgctggccctgctgctgctgctggcccccagccctggccacgccaccagggtggtgtacaaggtgcctgaggagcagccccccaacaccctcatcggcagcctggccgctgactatggcttcccagatgtgggccacctgtacaagctggaggtgggcgccccctacctgcgggtggatggcaagacaggagacatcttcaccacagagaccagcattgaccgggagggcctgcgggagtgccagaaccagctgcccggggacccctgcatcctggagtttgaggtgtccatcacagacctggtgcagaatggcagcccccggctgctggagggccagatcgaggtgcaggacatcaatgacaacacccccaactttgccagccctgtgatcaccctggccatccctgagaacaccaacatcggcagcctcttccccatccccctggccagtgacagagatgctggccccaacggggtggccagctatgagctgcaggccggccctgaggcccaggagctgtttggcctgcaggtggccgaggaccaggaggagaagcagccccagctgattgtgatgggcaacctggaccgggagcgctgggacagctatgacctgaccatcaaggtgcaggacggcggcagccccccccgggccagcagcgccctgctgcgggtgacagtgctggacaccaatgacaatgcccccaagtttgagcggcccagctatgaagctgagctgtctgagaacagccccatcggccacagcgtcatccaggtgaaggccaatgacagcgaccagggcgccaatgctgagattgagtacaccttccaccaggcccctgaggtggtgcggcggctgctgcggctggacaggaacacaggcctcatcaccgtgcagggccctgtggaccgggaggacctgagcaccctgcgcttctctgtgctggccaaggaccggggcaccaaccccaagagcgcccgggcccaggtggtggtgacagtgaaggacatgaatgacaatgcccccaccatcgagatccggggcatcggcctggtgacccaccaggacggcatggccaacatcagtgaagatgtggccgaggagacagctgtggccctggtgcaggtgtctgacagagatgaaggagaaaatgctgctgtgacctgtgtggtggccggagatgtgcccttccagctgcggcaggccagcgagaccggcagtgacagcaagaagaagtacttcctgcagaccaccacccccctggactatgagaaggtgaaggactacaccatcgagatcgtggccgtggacagcggcaacccccccctgagcagcaccaacagcctgaaggtgcaggtggtggatgtgaatgacaatgcccctgtgttcacccagagcgtgacagaggtggccttccctgagaacaacaagccaggagaggtgattgctgagatcacagccagtgatgctgacagcggcagcaatgctgagctggtgtacagcctggagcctgagcctgctgccaagggcctcttcaccatcagccctgagactggagagatccaggtgaagaccagcctggaccgggagcagcgggagagctatgagctgaaggtggtggccgctgaccggggcagccccagcctgcagggcacagccaccgtgctggtgaatgtgctggactgcaatgacaatgaccccaagttcatgctgagcggctacaacttctctgtgatggagaacatgcctgccctgagccctgtgggcatggtgacagtgattgatggagacaagggagaaaatgcccaggtgcagctgtctgtggagcaggacaatggagactttgtgatccagaatggcaccggcaccatcctgagcagcctgagctttgaccgggagcagcagagcacctacaccttccagctgaaggctgtggatggaggagtgcccccaagaagtgcctacgtgggcgtgaccatcaacgtgctggatgaaaatgacaatgccccctacatcacagcccccagcaacaccagccacaagctgctgaccccccagacccggctgggggagaccgtgtcccaggtggccgctgaggactttgacagcggcgtgaatgctgagctgatctacagcattgctgggggcaacccctacggcctcttccagatcggcagccacagcggggccatcaccctggagaaggagattgaaagaagacaccacggcctgcaccggctggtggtgaaggtgtctgaccggggcaagccacccaggtatggaacagccctggtgcacctgtatgtgaatgagaccctggccaacagaaccctgctggagaccctgctgggccacagcctggacacccccctggacatcgacattgctggggaccctgaatatgaaagaagcaagcagaggggcaacatcctgtttggagtggtggccggcgtggtggccgtggccctgctgattgccctggccgtgctggtgcgctactgccggcagcgggaggccaagagcggctaccaggccggcaagaaggagaccaaggacctgtatgcccccaagcccagcggcaaggccagcaaaggaaacaagagcaagggcaagaagagcaagagccccaagcctgtgaagcctgtggaggatgaagatgaagctggcctgcagaagagcctgaagttcaacctgatgtctgatgcccctggggacagcccccgcatccacctgcccctgaactacccacctggcagcccagacctgggccgccactaccgcagcaacagccccctgcccagcatccagctgcagccccagagccccagcgccagcaagaagcaccaggtggtgcaggacctgcccccagccaacacctttgtgggcaccggggacaccaccagcacaggcagcgagcagtacagcgactacagctaccgcaccaacccccccaagtaccccagcaagcaggtgggccagcccttccagctgagcaccccccagcccctgccccacccctaccatggagccatctggacagaggtgtgggagtag

SEQ ID NO: 166448 - DNA, 3147 bp, Artificial Sequence
  Description of Artificial Sequence: Synthetic coding sequence
atggattctggagctgggggccgccgctgcccagaggccgccctgctgatcctgggcccccccaggatggagcacctgcggcacagccctggccctgggggccagaggctgctgctgcccagcatgctgctggccctgctgctgctgctggcccccagccctggccacgccaccagggtggtgtacaaggtgcctgaggagcagccccccaacaccctcatcggcagcctggccgctgactatggcttcccagatgtgggccacctgtacaagctggaggtgggcgccccctacctgcgggtggatggcaagacaggagacatcttcaccacagagaccagcattgaccgggagggcctgcgggagtgccagaaccagctgcccggggacccctgcatcctggagtttgaggtgtccatcacagacctggtgcagaatggcagcccccggctgctggagggccagatcgaggtgcaggacatcaatgacaacacccccaactttgccagccctgtgatcaccctggccatccctgagaacaccaacatcggcagcctcttccccatccccctggccagtgacagagatgctggccccaacggggtggccagctatgagctgcaggtggccgaggaccaggaggagaagcagccccagctgattgtgatgggcaacctggaccgggagcgctgggacagctatgacctgaccatcaaggtgcaggacggcggcagccccccccgggccagcagcgccctgctgcgggtgacagtgctggacaccaatgacaatgcccccaagtttgagcggcccagctatgaagctgagctgtctgagaacagccccatcggccacagcgtcatccaggtgaaggccaatgacagcgaccagggcgccaatgctgagattgagtacaccttccaccaggcccctgaggtggtgcggcggctgctgcggctggacaggaacacaggcctcatcaccgtgcagggccctgtggaccgggaggacctgagcaccctgcgcttctctgtgctggccaaggaccggggcaccaaccccaagagcgcccgggcccaggtggtggtgacagtgaaggacatgaatgacaatgcccccaccatcgagatccggggcatcggcctggtgacccaccaggacggcatggccaacatcagtgaagatgtggccgaggagacagctgtggccctggtgcaggtgtctgacagagatgaaggagaaaatgctgctgtgacctgtgtggtggccggagatgtgcccttccagctgcggcaggccagcgagaccggcagtgacagcaagaagaagtacttcctgcagaccaccacccccctggactatgagaaggtgaaggactacaccatcgagatcgtggccgtggacagcggcaacccccccctgagcagcaccaacagcctgaaggtgcaggtggtggatgtgaatgacaatgcccctgtgttcacccagagcgtgacagaggtggccttccctgagaacaacaagccaggagaggtgattgctgagatcacagccagtgatgctgacagcggcagcaatgctgagctggtgtacagcctggagcctgagcctgctgccaagggcctcttcaccatcagccctgagactggagagatccaggtgaagaccagcctggaccgggagcagcgggagagctatgagctgaaggtggtggccgctgaccggggcagccccagcctgcagggcacagccaccgtgctggtgaatgtgctggactgcaatgacaatgaccccaagttcatgctgagcggctacaacttctctgtgatggagaacatgcctgccctgagccctgtgggcatggtgacagtgattgatggagacaagggagaaaatgcccaggtgcagctgtctgtggagcaggacaatggagactttgtgatccagaatggcaccggcaccatcctgagcagcctgagctttgaccgggagcagcagagcacctacaccttccagctgaaggctgtggatggaggagtgcccccaagaagtgcctacgtgggcgtgaccatcaacgtgctggatgaaaatgacaatgccccctacatcacagcccccagcaacaccagccacaagctgctgaccccccagacccggctgggggagaccgtgtcccaggtggccgctgaggactttgacagcggcgtgaatgctgagctgatctacagcattgctgggggcaacccctacggcctcttccagatcggcagccacagcggggccatcaccctggagaaggagattgaaagaagacaccacggcctgcaccggctggtggtgaaggtgtctgaccggggcaagccacccaggtatggaacagccctggtgcacctgtatgtgaatgagaccctggccaacagaaccctgctggagaccctgctgggccacagcctggacacccccctggacatcgacattgctggggaccctgaatatgaaagaagcaagcagaggggcaacatcctgtttggagtggtggccggcgtggtggccgtggccctgctgattgccctggccgtgctggtgcgctactgccggcagcgggaggccaagagcggctaccaggccggcaagaaggagaccaaggacctgtatgcccccaagcccagcggcaaggccagcaaaggaaacaagagcaagggcaagaagagcaagagccccaagcctgtgaagcctgtggaggatgaagatgaagctggcctgcagaagagcctgaagttcaacctgatgtctgatgcccctggggacagcccccgcatccacctgcccctgaactacccacctggcagcccagacctgggccgccactaccgcagcaacagccccctgcccagcatccagctgcagccccagagccccagcgccagcaagaagcaccaggtggtgcaggacctgcccccagccaacacctttgtgggcaccggggacaccaccagcacaggcagcgagcagtacagcgactacagctaccgcaccaacccccccaagtaccccagcaagcaggtgggccagcccttccagctgagcaccccccagcccctgccccacccctaccatggagccatctggacagaggtgtgggagtag

SEQ ID NO: 166449 - DNA, 3117 bp, Artificial Sequence
  Description of Artificial Sequence: Synthetic coding sequence
atggagcacctgcggcacagccctggccctgggggccagaggctgctgctgcccagcatgctgctggccctgctgctgctgctggcccccagccctggccacgccaccagggtggtgtacaaggtgcctgaggagcagccccccaacaccctcatcggcagcctggccgctgactatggcttcccagatgtgggccacctgtacaagctggaggtgggcgccccctacctgcgggtggatggcaagacaggagacatcttcaccacagagaccagcattgaccgggagggcctgcgggagtgccagaaccagctgcccggggacccctgcatcctggagtttgaggtgtccatcacagacctggtgcagaatggcagcccccggctgctggagggccagatcgaggtgcaggacatcaatgacaacacccccaactttgccagccctgtgatcaccctggccatccctgagaacaccaacatcggcagcctcttccccatccccctggccagtgacagagatgctggccccaacggggtggccagctatgagctgcaggccggccctgaggcccaggagctgtttggcctgcaggtggccgaggaccaggaggagaagcagccccagctgattgtgatgggcaacctggaccgggagcgctgggacagctatgacctgaccatcaaggtgcaggacggcggcagccccccccgggccagcagcgccctgctgcgggtgacagtgctggacaccaatgacaatgcccccaagtttgagcggcccagctatgaagctgagctgtctgagaacagccccatcggccacagcgtcatccaggtgaaggccaatgacagcgaccagggcgccaatgctgagattgagtacaccttccaccaggcccctgaggtggtgcggcggctgctgcggctggacaggaacacaggcctcatcaccgtgcagggccctgtggaccgggaggacctgagcaccctgcgcttctctgtgctggccaaggaccggggcaccaaccccaagagcgcccgggcccaggtggtggtgacagtgaaggacatgaatgacaatgcccccaccatcgagatccggggcatcggcctggtgacccaccaggacggcatggccaacatcagtgaagatgtggccgaggagacagctgtggccctggtgcaggtgtctgacagagatgaaggagaaaatgctgctgtgacctgtgtggtggccggagatgtgcccttccagctgcggcaggccagcgagaccggcagtgacagcaagaagaagtacttcctgcagaccaccacccccctggactatgagaaggtgaaggactacaccatcgagatcgtggccgtggacagcggcaacccccccctgagcagcaccaacagcctgaaggtgcaggtggtggatgtgaatgacaatgcccctgtgttcacccagagcgtgacagaggtggccttccctgagaacaacaagccaggagaggtgattgctgagatcacagccagtgatgctgacagcggcagcaatgctgagctggtgtacagcctggagcctgagcctgctgccaagggcctcttcaccatcagccctgagactggagagatccaggtgaagaccagcctggaccgggagcagcgggagagctatgagctgaaggtggtggccgctgaccggggcagccccagcctgcagggcacagccaccgtgctggtgaatgtgctggactgcaatgacaatgaccccaagttcatgctgagcggctacaacttctctgtgatggagaacatgcctgccctgagccctgtgggcatggtgacagtgattgatggagacaagggagaaaatgcccaggtgcagctgtctgtggagcaggacaatggagactttgtgatccagaatggcaccggcaccatcctgagcagcctgagctttgaccgggagcagcagagcacctacaccttccagctgaaggctgtggatggaggagtgcccccaagaagtgcctacgtgggcgtgaccatcaacgtgctggatgaaaatgacaatgccccctacatcacagcccccagcaacaccagccacaagctgctgaccccccagacccggctgggggagaccgtgtcccaggtggccgctgaggactttgacagcggcgtgaatgctgagctgatctacagcattgctgggggcaacccctacggcctcttccagatcggcagccacagcggggccatcaccctggagaaggagattgaaagaagacaccacggcctgcaccggctggtggtgaaggtgtctgaccggggcaagccacccaggtatggaacagccctggtgcacctgtatgtgaatgagaccctggccaacagaaccctgctggagaccctgctgggccacagcctggacacccccctggacatcgacattgctggggaccctgaatatgaaagaagcaagcagaggggcaacatcctgtttggagtggtggccggcgtggtggccgtggccctgctgattgccctggccgtgctggtgcgctactgccggcagcgggaggccaagagcggctaccaggccggcaagaaggagaccaaggacctgtatgcccccaagcccagcggcaaggccagcaaaggaaacaagagcaagggcaagaagagcaagagccccaagcctgtgaagcctgtggaggatgaagatgaagctggcctgcagaagagcctgaagttcaacctgatgtctgatgcccctggggacagcccccgcatccacctgcccctgaactacccacctggcagcccagacctgggccgccactaccgcagcaacagccccctgcccagcatccagctgcagccccagagccccagcgccagcaagaagcaccaggtggtgcaggacctgcccccagccaacacctttgtgggcaccggggacaccaccagcacaggcagcgagcagtacagcgactacagctaccgcaccaacccccccaagtaccccagcaagcaggtgggccagcccttccagctgagcaccccccagcccctgccccacccctaccatggagccatctggacagaggtgtgggagtag

SEQ ID NO: 166450 - DNA, 3123 bp, Artificial Sequence
  Description of Artificial Sequence: Synthetic coding sequence
atgattgtgctgctgctgtttgccctgctgtggatggtggagggcgtcttcagccagctgcactacacagtgcaggaggagcaggagcacggcacctttgtgggcaacattgctgaggacctgggcctggacatcaccaagctgagcgcccggggcttccagacagtgcccaacagcaggaccccctacctggacctgaacctggagaccggggtgctgtatgtgaatgagaagattgaccgggagcagatctgcaagcagagccccagctgtgtgctgcacctggaggtgttcctggagaaccccctggagctgttccaggtggagattgaggtgctggacatcaatgacaaccccccatccttccctgagccagacctgactgtggagatcagcgagagcgccaccccaggcacccgcttccccctggagagcgcctttgatcctgatgtgggcaccaacagcctgcgggactatgagatcacccccaacagctacttcagcctggatgtgcagacccagggagatggcaacagatttgctgagctggtgctggagaagcccctggaccgggagcagcaggccgtgcacagatatgtgctgacagctgtggatggcggcggcggcggcggcgtgggggagggcggcggcggcggcggcggggccggcctgcccccccagcagcagaggactggaacagccctgctgaccatccgggtgctggacagcaatgacaacgtgcctgcctttgaccagcctgtgtacacagtgtccctgcctgagaacagccccccaggcaccctggtgatccagctgaatgccacagatcctgatgagggccagaatggagaggtggtgtacagcttcagcagccacatcagcccccgggcccgggagctgtttggcctgagccccaggacaggccgcctggaggtgtctggagagctggactatgaggagagccctgtgtaccaggtgtatgtgcaggccaaggacctgggccccaatgctgtgcctgcccactgcaaggtgctggtgcgggtgctggatgccaatgacaatgcccctgagatctccttcagcacagtgaaggaggccgtgtctgagggcgccgcccctggcaccgtggtggccctcttctctgtgacagaccgggacagtgaagaaaatggccaggtgcagtgtgagctgctgggagatgtgcccttccggctgaagagcagcttcaagaactactacaccatcgtgacagaggcccccctggaccgggaggccggggacagctacaccctgactgtggtggcccgggacagaggagagcccgccctgagcaccagcaagagcatccaggtgcaggtgtctgatgtgaatgacaatgccccccgcttcagccagcctgtgtatgatgtgtatgtgacagagaacaacgtgcctggggcctacatctatgctgtgtctgccacagacagagatgaaggagccaatgcccagctggcctacagcatcctggagtgccagatccagggcatgtctgtgttcacctacgtgtccatcaacagtgaaaatggctacctgtatgccctgcggagctttgattatgagcagctgaaggacttctccttccaggtggaggccagagatgctggcagcccccaggccctggccggaaatgccaccgtgaacatcctgattgtggaccagaatgacaatgccccagccatcgtggcccccctgcctggaagaaatggcaccccagcccgggaggtgctgcccaggtctgctgagcccggctacctgctgaccagggtggccgctgtggatgctgatgatggagaaaatgcccggctgacctacagcatcgtgagaggaaatgagatgaacctcttcaggatggactggaggactggagagctgaggacagcccggcgggtgcctgccaagagggacccccagaggccctatgagctggtgattgaggtgcgggaccacggccagccccccctgagcagcacagccaccctggtggtgcagctggtggatggagctgtggagccccagggcggcggcggcagcggcggcggcggcagcggggagcaccagaggcccagccgcagcggcggcggggagaccagcctggacctgaccctcatcctgatcatcgccctgggctctgtgtccttcatcttcctgctggccatgattgtgctggccgtgcgctgccagaaggagaagaagctgaacatctacacctgcctggccagtgactgctgcctgtgctgctgctgctgcggcggcggcggcagcacctgctgcggccggcaggcccgggccaggaagaagaagctgagcaagagtgacatcatgctggtgcagagcagcaatgtgcccagcaacccagcccaggtgcccatcgaggagagcggcggcttcggcagccaccaccacaaccagaactactgctaccaggtgtgcctgaccccagagagcgccaagacagacctgatgttcctgaagccctgcagccccagccgcagcacagacacagagcacaacccctgtggggccatcgtgacaggctacacagaccagcagcctgacatcatcagcaatggcagcatcctgagcaatgagaccaagcaccagagagctgagctgagctacctggtggaccggcccaggagagtgaacagcagcgccttccaggaggccgacatcgtgagcagcaaggacagcggccatggagacagcgagcagggcgacagcgaccatgatgccaccaacagagcccagagcgctggcatggacctcttcagcaactgcacagaggagtgcaaggccctgggccacagcgaccgctgctggatgcccagctttgtgcccagtgatggccggcaggccgctgactaccgcagcaacctgcacgtgcccggcatggacagcgtgcctgacacagaggtgtttgagaccccagaggcccagcccggggctgagaggagcttcagcaccttcggcaaggagaaggccctgcacagcaccctggagaggaaggagctggatggcctgctgaccaacacccgggccccctacaagccaccctacctgaccaggaagaggatctgctag

SEQ ID NO: 166451 - DNA, 3123 bp, Artificial Sequence
  Description of Artificial Sequence: Synthetic coding sequence
atgattgtgctgctgctgtttgccctgctgtggatggtggagggcgtcttcagccagctgcactacacagtgcaggaggagcaggagcacggcacctttgtgggcaacattgctgaggacctgggcctggacatcaccaagctgagcgcccggggcttccagacagtgcccaacagcaggaccccctacctggacctgaacctggagaccggggtgctgtatgtgaatgagaagattgaccgggagcagatctgcaagcagagccccagctgtgtgctgcacctggaggtgttcctggagaaccccctggagctgttccaggtggagattgaggtgctggacatcaatgacaaccccccatccttccctgagccagacctgactgtggagatcagcgagagcgccaccccaggcacccgcttccccctggagagcgcctttgatcctgatgtgggcaccaacagcctgcgggactatgagatcacccccaacagctacttcagcctggatgtgcagacccagggagatggcaacagatttgctgagctggtgctggagaagcccctggaccgggagcagcaggccgtgcacagatatgtgctgacagctgtggatggcggcggcggcggcggcgtgggggagggcggcggcggcggcggcggggccggcctgcccccccagcagcagaggactggaacagccctgctgaccatccgggtgctggacagcaatgacaacgtgcctgcctttgaccagcctgtgtacacagtgtccctgcctgagaacagccccccaggcaccctggtgatccagctgaatgccacagatcctgatgagggccagaatggagaggtggtgtacagcttcagcagccacatcagcccccgggcccgggagctgtttggcctgagccccaggacaggccgcctggaggtgtctggagagctggactatgaggagagccctgtgtaccaggtgtatgtgcaggccaaggacctgggccccaatgctgtgcctgcccactgcaaggtgctggtgcgggtgctggatgccaatgacaatgcccctgagatctccttcagcacagtgaaggaggccgtgtctgagggcgccgcccctggcaccgtggtggccctcttctctgtgacagaccgggacagtgaagaaaatggccaggtgcagtgtgagctgctgggagatgtgcccttccggctgaagagcagcttcaagaactactacaccatcgtgacagaggcccccctggaccgggaggccggggacagctacaccctgactgtggtggcccgggacagaggagagcccgccctgagcaccagcaagagcatccaggtgcaggtgtctgatgtgaatgacaatgccccccgcttcagccagcctgtgtatgatgtgtatgtgacagagaacaacgtgcctggggcctacatctatgctgtgtctgccacagacagagatgaaggagccaatgcccagctggcctacagcatcctggagtgccagatccagggcatgtctgtgttcacctacgtgtccatcaacagtgaaaatggctacctgtatgccctgcggagctttgattatgagcagctgaaggacttctccttccaggtggaggccagagatgctggcagcccccaggccctggccggaaatgccaccgtgaacatcctgattgtggaccagaatgacaatgccccagccatcgtggcccccctgcctggaagaaatggcaccccagcccgggaggtgctgcccaggtctgctgagcccggctacctgctgaccagggtggccgctgtggatgctgatgatggagaaaatgcccggctgacctacagcatcgtgagaggaaatgagatgaacctcttcaggatggactggaggactggagagctgaggacagcccggcgggtgcctgccaagagggacccccagaggccctatgagctggtgattgaggtgcgggaccacggccagccccccctgagcagcacagccaccctggtggtgcagctggtggatggagctgtggagccccagggcggcggcggcagcggcggcggcggcagcggggagcaccagaggcccagccgcagcggcggcggggagaccagcctggacctgaccctcatcctgatcatcgccctgggctctgtgtccttcatcttcctgctggccatgattgtgctggccgtgcgctgccagaaggagaagaagctgaacatctacacctgcctggccagtgactgctgcctgtgctgctgctgctgcggcggcggcggcagcacctgctgcggccggcaggcccgggccaggaagaagaagctgagcaagagtgacatcatgctggtgcagagcagcaatgtgcccagcaacccagcccaggtgcccatcgaggagagcggcggcttcggcagccaccaccacaaccagaactactgctaccaggtgtgcctgaccccagagagcgccaagacagacctgatgttcctgaagccctgcagccccagccgcagcacagacacagagcacaacccctgtggggccatcgtgacaggctacacagaccagcagcctgacatcatcagcaatggcagcatcctgagcaatgagaccaagcaccagagagctgagctgagctacctggtggaccggcccaggagagtgaacagcagcgccttccaggaggccgacatcgtgagcagcaaggacagcggccatggagacagcgagcagggcgacagcgaccatgatgccaccaacagagcccagagcgctggcatggacctcttcagcaactgcacagaggagtgcaaggccctgggccacagcgaccgctgctggatgcccagctttgtgcccagtgatggccggcaggccgctgactaccgcagcaacctgcacgtgcccggcatggacagcgtgcctgacacagaggtgtttgagaccccagaggcccagcccggggctgagaggagcttcagcaccttcggcaaggagaaggccctgcacagcaccctggagaggaaggagctggatggcctgctgaccaacacccgggccccctacaagccaccctacctgaggaagaagcagcgctgctag

SEQ ID NO: 166452 - DNA, 3933 bp, Artificial Sequence
  Description of Artificial Sequence: Synthetic coding sequence
atggacctgctgagcggcacctacatctttgctgtgctgctggcctgtgtggtgttccacagcggggcccaggagaagaactacaccatccgggaggagatgccagaaaatgtgctgattggagacctgctgaaggacctgaacctgagcctcatccccaacaagagcctgaccacagccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagacagctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgaccaaggtgtctgccatggatgctgacagcggccccaatgccaagatcaactacctgctgggcccagatgcccctcctgagttcagcctggactgcaggacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaacttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgccccccagcaactgcagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcacagaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacaagcagaacagcgagtgggccacccccaaccctgagaaccggcagatgatcatgatgaagaagaagaagaagaagaagaagcacagccccaagaacctgctgctgaactttgtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacagcaagcaccacatcatccaggagctgcccctggacaacacctttgtggcctgtgacagcatcagcaagtgcagcagcagcagcagtgacccctacagcgtgtctgactgtggctaccctgtgaccacctttgaggtgcctgtgtctgtgcacacccggcccagccagaggagagtgaccttccacctgcctgagggcagccaggagagcagcagtgatggcggcctgggggaccatgatgctggcagcctgaccagcaccagccacggcctgcccctgggctacccccaggaggagtactttgaccgggccacccccagcaacagaacagaaggagatggcaacagcgaccctgagagcaccttcatccccaggagccccacagctgctgagatcaccgtgcagcccaccgtggaggaggccagtgacaactgcacccaggagtgcctgatctacggccacagtgatgcctgctggatgcctgccagcctggaccacagcagcagcagccaggcccaggccagcgccctgtgccacagcccccccctgagccaggccagcacccagcaccacagcccccgggtgacccagaccatcgccctgtgccacagcccccctgtgacccagaccatcgccctgtgccacagccccccacccatccaggtgtctgccctgcaccacagcccccccctggtgcaggccacagccctgcaccacagcccccccagcgcccaggccagcgccctgtgctacagcccccccctggcccaggccgccgccatcagccacagcagccccctgccccaggtgattgccctgcacaggagccaggcccagagctctgtgtccctgcagcagggctgggtgcagggcgcagatggcctgtgcagcgtggaccagggcgtgcagggcagcgccaccagccagttctacaccatgtctgagcggctgcaccccagtgatgacagcatcaaggtgatccccctgaccaccttcaccccccggcagcaggcccggcccagcagaggagacagccccatcatggaggagcaccccctgtag

SEQ ID NO: 166453 - DNA, 4044 bp, Artificial Sequence
  Description of Artificial Sequence: Synthetic coding sequence
atggacctgctgagcggcacctacatctttgctgtgctgctggcctgtgtggtgttccacagcggggcccaggagaagaactacaccatccgggaggagatgccagaaaatgtgctgattggagacctgctgaaggacctgaacctgagcctcatccccaacaagagcctgaccacagccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagacagctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgaccaaggtgtctgccatggatgctgacagcggccccaatgccaagatcaactacctgctgggcccagatgcccctcctgagttcagcctggactgcaggacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaacttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgccccccagcaactgcagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcacagaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacaagcagaacagcgagtgggccacccccaaccctgagaaccggcagatgatcatgatgaagaagaagaagaagaagaagaagcacagccccaagaacctgctgctgaactttgtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacagcaagcaccacatcatccaggagctgcccctggacaacacctttgtggcctgtgacagcatcagcaagtgcagcagcagcagcagtgacccctacagcgtgtctgactgtggctaccctgtgaccacctttgaggtgcctgtgtctgtgcacaccaggcctcccatgaaggaggtggtgcgcagctgcacccccatgaaggagagcaccaccatggagatctggatccacccccagccccagaggaagtctgagggcaaggtggccggcaagagccagaggagagtgaccttccacctgcctgagggcagccaggagagcagcagtgatggcggcctgggggaccatgatgctggcagcctgaccagcaccagccacggcctgcccctgggctacccccaggaggagtactttgaccgggccacccccagcaacagaacagaaggagatggcaacagcgaccctgagagcaccttcatccccaggagccccacagctgctgagatcaccgtgcagcccaccgtggaggaggccagtgacaactgcacccaggagtgcctgatctacggccacagtgatgcctgctggatgcctgccagcctggaccacagcagcagcagccaggcccaggccagcgccctgtgccacagcccccccctgagccaggccagcacccagcaccacagcccccgggtgacccagaccatcgccctgtgccacagcccccctgtgacccagaccatcgccctgtgccacagccccccacccatccaggtgtctgccctgcaccacagcccccccctggtgcaggccacagccctgcaccacagccccccatctgcccaggccagcgccctgtgctacagcccccccctggcccaggccgccgccatcagccacagcagccccctgccccaggtgattgccctgcacaggagccaggcccagagctctgtgtccctgcagcagggctgggtgcagggcgcagatggcctgtgcagcgtggaccagggcgtgcagggcagcgccaccagccagttctacaccatgtctgagcggctgcaccccagtgatgacagcatcaaggtgatccccctgaccaccttcaccccccggcagcaggcccggcccagcagaggagacagccccatcatggaggagcaccccctgtag

SEQ ID NO: 166454 - DNA, 3990 bp, Artificial Sequence
  Description of Artificial Sequence: Synthetic coding sequence
atggacctgctgagcggcacctacatctttgctgtgctgctggcctgtgtggtgttccacagcggggcccaggagaagaactacaccatccgggaggagatgccagaaaatgtgctgattggagacctgctgaaggacctgaacctgagcctcatccccaacaagagcctgaccacagccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagacagctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgaccaaggtgtctgccatggatgctgacagcggccccaatgccaagatcaactacctgctgggcccagatgcccctcctgagttcagcctggactgcaggacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaacttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgccccccagcaactgcagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcacagaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacaagcagaacagcgagtgggccacccccaaccctgagaaccggcagatgatcatgatgaagaagaagaagaagaagaagaagcacagccccaagaacctgctgctgaactttgtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacagcaagcaccacatcatccaggagctgcccctggacaacacctttgtggcctgtgacagcatcagcaagtgcagcagcagcagcagtgacccctacagcgtgtctgactgtggctaccctgtgaccacctttgaggtgcctgtgtctgtgcacaccaggcctcccatgaaggaggtggtgcgcagctgcacccccatgaaggagagcaccaccatggagatctggatccacccccagccccagagccagaggagagtgaccttccacctgcctgagggcagccaggagagcagcagtgatggcggcctgggggaccatgatgctggcagcctgaccagcaccagccacggcctgcccctgggctacccccaggaggagtactttgaccgggccacccccagcaacagaacagaaggagatggcaacagcgaccctgagagcacagctgagatcaccgtgcagcccaccgtggaggaggccagtgacaactgcacccaggagtgcctgatctacggccacagtgatgcctgctggatgcctgccagcctggaccacagcagcagcagccaggcccaggccagcgccctgtgccacagcccccccctgagccaggccagcacccagcaccacagcccccgggtgacccagaccatcgccctgtgccacagcccccctgtgacccagaccatcgccctgtgccacagccccccacccatccaggtgtctgccctgcaccacagcccccccctggtgcaggccacagccctgcaccacagccccccatctgcccaggccagcgccctgtgctacagcccccccctggcccaggccgccgccatcagccacagcagccccctgccccaggtgattgccctgcacaggagccaggcccagagctctgtgtccctgcagcagggctgggtgcagggcgcagatggcctgtgcagcgtggaccagggcgtgcagggcagcgccaccagccagttctacaccatgtctgagcggctgcaccccagtgatgacagcatcaaggtgatccccctgaccaccttcaccccccggcagcaggcccggcccagcagaggagacagccccatcatggaggagcaccccctgtag

SEQ ID NO: 166455 - DNA, 3066 bp, Artificial Sequence
  Description of Artificial Sequence: Synthetic coding sequence
atggacctgctgagcggcacctacatctttgctgtgctgctggcctgtgtggtgttccacagcggggcccaggagaagaactacaccatccgggaggagatgccagaaaatgtgctgattggagacctgctgaaggacctgaacctgagcctcatccccaacaagagcctgaccacagccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagacagctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgaccaaggtgtctgccatggatgctgacagcggccccaatgccaagatcaactacctgctgggcccagatgcccctcctgagttcagcctggactgcaggacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaacttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgccccccagcaactgcagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcacagaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacaagcagaacagcgagtgggccacccccaaccctgagaaccggcagatgatcatgatgaagaagaagaagaagaagaagaagcacagccccaagaacctgctgctgaactttgtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacagcaagcaccacatcatccaggagctgcccctggacaacacctttgtggcctgtgacagcatcagcaagtgcagcagcagcagcagtgacccctacagcgtgtctgactgtggctaccctgtgaccacctttgaggtgcctgtgtctgtgcacaccaggcctgtgggcatccaggtgagcaacaccaccttctag

SEQ ID NO: 166456 - DNA, 3933 bp, Artificial Sequence
  Description of Artificial Sequence: Synthetic coding sequence
atggacctgctgagcggcacctacatctttgctgtgctgctggcctgtgtggtgttccacagcggggcccaggagaagaactacaccatccgggaggagatgccagaaaatgtgctgattggagacctgctgaaggacctgaacctgagcctcatccccaacaagagcctgaccacagccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagacagctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgaccaaggtgtctgccatggatgctgacagcggccccaatgccaagatcaactacctgctgggcccagatgcccctcctgagttcagcctggactgcaggacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaacttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgccccccagcaactgcagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcacagaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacaagcagaacagcgagtgggccacccccaaccctgagaaccggcagatgatcatgatgaagaagaagaagaagaagaagaagcacagccccaagaacctgctgctgaactttgtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacagcaagcaccacatcatccaggagctgcccctggacaacacctttgtggcctgtgacagcatcagcaagtgcagcagcagcagcagtgacccctacagcgtgtctgactgtggctaccctgtgaccacctttgaggtgcctgtgtctgtgcacacccggcccagccagaggagagtgaccttccacctgcctgagggcagccaggagagcagcagtgatggcggcctgggggaccatgatgctggcagcctgaccagcaccagccacggcctgcccctgggctacccccaggaggagtactttgaccgggccacccccagcaacagaacagaaggagatggcaacagcgaccctgagagcaccttcatccctggcctgaagaaggctgctgagatcaccgtgcagcccaccgtggaggaggccagtgacaactgcacccaggagtgcctgatctacggccacagtgatgcctgctggatgcctgccagcctggaccacagcagcagcagccaggcccaggccagcgccctgtgccacagcccccccctgagccaggccagcacccagcaccacagcccccgggtgacccagaccatcgccctgtgccacagcccccctgtgacccagaccatcgccctgtgccacagccccccacccatccaggtgtctgccctgcaccacagcccccccctggtgcaggccacagccctgcaccacagcccccccagcgcccaggccagcgccctgtgctacagcccccccctggcccaggccgccgccatcagccacagcagccccctgccccaggtgattgccctgcacaggagccaggcccagagctctgtgtccctgcagcagggctgggtgcagggcgcagatggcctgtgcagcgtggaccagggcgtgcagggcagcgccaccagccagttctacaccatgtctgagcggctgcaccccagtgatgacagcatcaaggtgatccccctgaccaccttcaccccccggcagcaggcccggcccagcagaggagacagccccatcatggaggagcaccccctgtag

SEQ ID NO: 166457 - DNA, 4044 bp, Artificial Sequence
  Description of Artificial Sequence: Synthetic coding sequence
atggacctgctgagcggcacctacatctttgctgtgctgctggcctgtgtggtgttccacagcggggcccaggagaagaactacaccatccgggaggagatgccagaaaatgtgctgattggagacctgctgaaggacctgaacctgagcctcatccccaacaagagcctgaccacagccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagacagctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgaccaaggtgtctgccatggatgctgacagcggccccaatgccaagatcaactacctgctgggcccagatgcccctcctgagttcagcctggactgcaggacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaacttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgccccccagcaactgcagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcacagaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacaagcagaacagcgagtgggccacccccaaccctgagaaccggcagatgatcatgatgaagaagaagaagaagaagaagaagcacagccccaagaacctgctgctgaactttgtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacagcaagcaccacatcatccaggagctgcccctggacaacacctttgtggcctgtgacagcatcagcaagtgcagcagcagcagcagtgacccctacagcgtgtctgactgtggctaccctgtgaccacctttgaggtgcctgtgtctgtgcacaccaggcctcccatgaaggaggtggtgcgcagctgcacccccatgaaggagagcaccaccatggagatctggatccacccccagccccagaggaagtctgagggcaaggtggccggcaagagccagaggagagtgaccttccacctgcctgagggcagccaggagagcagcagtgatggcggcctgggggaccatgatgctggcagcctgaccagcaccagccacggcctgcccctgggctacccccaggaggagtactttgaccgggccacccccagcaacagaacagaaggagatggcaacagcgaccctgagagcaccttcatccctggcctgaagaaggctgctgagatcaccgtgcagcccaccgtggaggaggccagtgacaactgcacccaggagtgcctgatctacggccacagtgatgcctgctggatgcctgccagcctggaccacagcagcagcagccaggcccaggccagcgccctgtgccacagcccccccctgagccaggccagcacccagcaccacagcccccgggtgacccagaccatcgccctgtgccacagcccccctgtgacccagaccatcgccctgtgccacagccccccacccatccaggtgtctgccctgcaccacagcccccccctggtgcaggccacagccctgcaccacagccccccatctgcccaggccagcgccctgtgctacagcccccccctggcccaggccgccgccatcagccacagcagccccctgccccaggtgattgccctgcacaggagccaggcccagagctctgtgtccctgcagcagggctgggtgcagggcgcagatggcctgtgcagcgtggaccagggcgtgcagggcagcgccaccagccagttctacaccatgtctgagcggctgcaccccagtgatgacagcatcaaggtgatccccctgaccaccttcaccccccggcagcaggcccggcccagcagaggagacagccccatcatggaggagcaccccctgtag

SEQ ID NO: 166458 - DNA, 4014 bp, Artificial Sequence
  Description of Artificial Sequence: Synthetic coding sequence
atggacctgctgagcggcacctacatctttgctgtgctgctggcctgtgtggtgttccacagcggggcccaggagaagaactacaccatccgggaggagatgccagaaaatgtgctgattggagacctgctgaaggacctgaacctgagcctcatccccaacaagagcctgaccacagccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagacagctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgaccaaggtgtctgccatggatgctgacagcggccccaatgccaagatcaactacctgctgggcccagatgcccctcctgagttcagcctggactgcaggacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaacttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgccccccagcaactgcagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcacagaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacaagcagaacagcgagtgggccacccccaaccctgagaaccggcagatgatcatgatgaagaagaagaagaagaagaagaagcacagccccaagaacctgctgctgaactttgtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacagcaagcaccacatcatccaggagctgcccctggacaacacctttgtggcctgtgacagcatcagcaagtgcagcagcagcagcagtgacccctacagcgtgtctgactgtggctaccctgtgaccacctttgaggtgcctgtgtctgtgcacaccaggcctcccatgaaggaggtggtgcgcagctgcacccccatgaaggagagcaccaccatggagatctggatccacccccagccccagagccagaggagagtgaccttccacctgcctgagggcagccaggagagcagcagtgatggcggcctgggggaccatgatgctggcagcctgaccagcaccagccacggcctgcccctgggctacccccaggaggagtactttgaccgggccacccccagcaacagaacagaaggagatggcaacagcgaccctgagagcaccttcatccctggcctgaagaaggctgctgagatcaccgtgcagcccaccgtggaggaggccagtgacaactgcacccaggagtgcctgatctacggccacagtgatgcctgctggatgcctgccagcctggaccacagcagcagcagccaggcccaggccagcgccctgtgccacagcccccccctgagccaggccagcacccagcaccacagcccccgggtgacccagaccatcgccctgtgccacagcccccctgtgacccagaccatcgccctgtgccacagccccccacccatccaggtgtctgccctgcaccacagcccccccctggtgcaggccacagccctgcaccacagccccccatctgcccaggccagcgccctgtgctacagcccccccctggcccaggccgccgccatcagccacagcagccccctgccccaggtgattgccctgcacaggagccaggcccagagctctgtgtccctgcagcagggctgggtgcagggcgcagatggcctgtgcagcgtggaccagggcgtgcagggcagcgccaccagccagttctacaccatgtctgagcggctgcaccccagtgatgacagcatcaaggtgatccccctgaccaccttcaccccccggcagcaggcccggcccagcagaggagacagccccatcatggaggagcaccccctgtag

SEQ ID NO: 166459 - DNA, 3078 bp, Artificial Sequence
  Description of Artificial Sequence: Synthetic coding sequence
atggacctgctgagcggcacctacatctttgctgtgctgctggcctgtgtggtgttccacagcggggcccaggagaagaactacaccatccgggaggagatgccagaaaatgtgctgattggagacctgctgaaggacctgaacctgagcctcatccccaacaagagcctgaccacagccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagacagctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgaccaaggtgtctgccatggatgctgacagcggccccaatgccaagatcaactacctgctgggcccagatgcccctcctgagttcagcctggactgcaggacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaacttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgccccccagcaactgcagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcacagaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacaagcagaacagcgagtgggccacccccaaccctgagaaccggcagatgatcatgatgaagaagaagaagaagaagaagaagcacagccccaagaacctgctgctgaactttgtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacagcaagcaccacatcatccaggagctgcccctggacaacacctttgtggcctgtgacagcatcagcaagtgcagcagcagcagcagtgacccctacagcgtgtctgactgtggctaccctgtgaccacctttgaggtgcctgtgtctgtgcacacccggcccacagacagcaggaccagcaccatcgagatctgcagcgagatctag

SEQ ID NO: 166460 - DNA, 4020 bp, Artificial Sequence
  Description of Artificial Sequence: Synthetic coding sequence
atggacctgctgagcggcacctacatctttgctgtgctgctggcctgtgtggtgttccacagcggggcccaggagaagaactacaccatccgggaggagatgccagaaaatgtgctgattggagacctgctgaaggacctgaacctgagcctcatccccaacaagagcctgaccacagccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagacagctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgaccaaggtgtctgccatggatgctgacagcggccccaatgccaagatcaactacctgctgggcccagatgcccctcctgagttcagcctggactgcaggacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaacttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgccccccagcaactgcagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcacagaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacaagcagaacagcgagtgggccacccccaaccctgagaaccggcagatgatcatgatgaagaagaagaagaagaagaagaagcacagccccaagaacctgctgctgaactttgtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacagcaagcaccacatcatccaggagctgcccctggacaacacctttgtggcctgtgacagcatcagcaagtgcagcagcagcagcagtgacccctacagcgtgtctgactgtggctaccctgtgaccacctttgaggtgcctgtgtctgtgcacaccaggcctcccatgaaggaggtggtgcgcagctgcacccccatgaaggagagcaccaccatggagatctggatccacccccagccccagaggaagtctgagggcaaggtggccggcaagagccagaggagagtgaccttccacctgcctgagggcagccaggagagcagcagtgatggcggcctgggggaccatgatgctggcagcctgaccagcaccagccacggcctgcccctgggctacccccaggaggagtactttgaccgggccacccccagcaacagaacagaaggagatggcaacagcgaccctgagagcacagctgagatcaccgtgcagcccaccgtggaggaggccagtgacaactgcacccaggagtgcctgatctacggccacagtgatgcctgctggatgcctgccagcctggaccacagcagcagcagccaggcccaggccagcgccctgtgccacagcccccccctgagccaggccagcacccagcaccacagcccccgggtgacccagaccatcgccctgtgccacagcccccctgtgacccagaccatcgccctgtgccacagccccccacccatccaggtgtctgccctgcaccacagcccccccctggtgcaggccacagccctgcaccacagccccccatctgcccaggccagcgccctgtgctacagcccccccctggcccaggccgccgccatcagccacagcagccccctgccccaggtgattgccctgcacaggagccaggcccagagctctgtgtccctgcagcagggctgggtgcagggcgcagatggcctgtgcagcgtggaccagggcgtgcagggcagcgccaccagccagttctacaccatgtctgagcggctgcaccccagtgatgacagcatcaaggtgatccccctgaccaccttcaccccccggcagcaggcccggcccagcagaggagacagccccatcatggaggagcaccccctgtag

SEQ ID NO: 166461 - DNA, 3198 bp, Artificial Sequence
  Description of Artificial Sequence: Synthetic coding sequence
atggacctgctgagcggcacctacatctttgctgtgctgctggcctgtgtggtgttccacagcggggcccaggagaagaactacaccatccgggaggagatgccagaaaatgtgctgattggagacctgctgaaggacctgaacctgagcctcatccccaacaagagcctgaccacagccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagacagctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgaccaaggtgtctgccatggatgctgacagcggccccaatgccaagatcaactacctgctgggcccagatgcccctcctgagttcagcctggactgcaggacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaacttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgccccccagcaactgcagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcacagaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacaagcagaacagcgagtgggccacccccaaccctgagaaccggcagatgatcatgatgaagaagaagaagaagaagaagaagcacagccccaagaacctgctgctgaactttgtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacagcaagcaccacatcatccaggagctgcccctggacaacacctttgtggcctgtgacagcatcagcaagtgcagcagcagcagcagtgacccctacagcgtgtctgactgtggctaccctgtgaccacctttgaggtgcctgtgtctgtgcacaccaggcctcccatgaaggaggtggtgcgcagctgcacccccatgaaggagagcaccaccatggagatctggatccacccccagccccagaggaagtctgagggcaaggtggccggcaagacagtgctgaccagcagcagccccagcgccatgaccctgagctacctggactag

SEQ ID NO: 166462 - DNA, 1344 bp, Artificial Sequence
  Description of Artificial Sequence: Synthetic coding sequence
atggccacagctgccaccaccaccaccaccaccacagccaccgtggccctgaccacctcctgggacaatgccaccggccggcccacagctgagccagaccccatcctggacaactacgtgctgctggtggtggtgatgagcctgtttgtgggcggcaccctggtggtgctgagcggcgtgctgctgctgtgcaagcgctgctgggatgtgcaccagaggctgaacagagccatggaggaggccgagaagaccaccaccacctacctggacaatggcacccacccagcccaggaccctgacttccggggggaggaccctgagtgccaggatgctgagacagagcgcttcctgagcaccagcagcacaggccggcgggtgtccttcaatgaagctgccctgtttgagcagagcaggaagacccaggacaagggccgccgctacaccctgacagaaggagacttccaccacctgaagaatgcccggctgacccacctgcacctgccccccctgaagatcgtgaccatccatgaatgtgacagcggggaggccagcagcgccaccaccccccacccagccaccagccccaaggccaccctggccatcttccagcccccaggcaaggccctgaccggccgctctgtgggccccagcagcgccctgcccggggacccctacaacagcgctgctggggccacagactttgctgagatcagccccagcgccagcagtgacagcggggagggcaccagcctggatgctggcaccaggagcaccaaggccggcggccctggagctgctgctggccctggagaggccggccctggcagcggggccggcaccgtgctgcagttcctgacccggctgcggagacatgccagcctggatggagccagcccctacttcaaggtgaagaagtggaagctggagcccagccagagagctgccagcctggacacccggggcagccccaagaggcaccacttccagaggcagagagctgccagcgagagcacagagcaggaggagggagatgccccccaggaggacttcatccagtacatcgcccgggctggagatgctgtggccttcccccacccccggcccttcctggccagccccccaccagccctgggccgctacttctctgtggatggaggagcccggggcggccctgtgggcccctgcccccccagccccccaccccggcggccccgggagaggagccctggccctgtggacaccaggagccctgccagcagcggcaaggccccaccccggggcggcctgaccggggccaccagccctgcctggacccggggcggcaagcagggcgagaccggctag

SEQ ID NO: 166463 - DNA, 3114 bp, Artificial Sequence
  Description of Artificial Sequence: Synthetic coding sequence
atgacagtgggcttcaacagcgacatcagctctgtggtgcgggtgaacaccaccaactgccacaagtgcctgctgagcggcacctacatctttgctgtgctgctggtgtgtgtggtgttccacagcggggcccaggagaagaactacaccatccgggaggagatcccagaaaatgtgctgattggcaacctgctgaaggacctgaacctgagcctcatccccaacaagagcctgaccaccaccatgcagttcaagctggtgtacaagacaggagatgtgcccctcatccgcatcgaggaggacaccggggagatcttcaccaccggggccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatcccagaaaattctgccatcaacagcaagtacaccctgcctgctgctgtggaccctgatgtgggcatcaacggggtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacattggagaaaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagaatgctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgatgaaggtgtctgccacagatgctgacagcggccccaatgctgagatcaactacctgctgggcccagatgcccctcctgagttcagcctggacagaagaacaggcatgctgactgtggtgaagaagctggaccgggagaaggaggacaagtacctgttcaccatcctggccaaggacaacggggtgccccccctgaccagcaatgtgacagtgtttgtgtccatcatcgaccagaatgacaacagccctgtgttcacccacaatgagtacaagttctacgtgcctgagaacctgcccaggcatggaacagtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggcagaagatggcggccgggtgagccgcagcagcagcgccaaggtgaccatcaacgtggtggatgtgaatgacaacaagcctgtgttcatcgtgcccccctacaactacagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagactggaaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcattgaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacatgcagaacagcgagtgggccacccccaacccagaaaatcggcagatgatcatgatgaagaagaagaagaagaagaagaagcacagccccaagaacctgctgctgaatgtggtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacctgaagcaccacatcatccaggagctgcccctggacaacacctttgtggcctgtgacagcatcagcaactgcagcagcagcagcagtgacccctacagcgtgtctgactgtggctaccctgtgaccacctttgaggtgcctgtgtctgtgcacacccggcccacagacagcaggacatag

SEQ ID NO: 166464 - DNA, 3147 bp, Artificial Sequence
  Description of Artificial Sequence: Synthetic coding sequence
atgttccgggtgggcttcctgatcatcagcagcagcagcagcctgagccccctgctgctggtgtctgtggtgcgggtgaacaccaccaactgccacaagtgcctgctgagcggcacctacatctttgctgtgctgctggtgtgtgtggtgttccacagcggggcccaggagaagaactacaccatccgggaggagatcccagaaaatgtgctgattggcaacctgctgaaggacctgaacctgagcctcatccccaacaagagcctgaccaccaccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagaatgctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgatgaaggtgtctgccacagatgctgacagcggccccaatgctgagatcaactacctgctgggcccagatgcccctcctgagttcagcctggacagaagaacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaagttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgcccccctacaactacagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcattgaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacatgcagaacagcgagtgggccacccccaaccctgagaaccggcagatgatcatgatgaagaagaagaagaagaagaagaagcacagccccaagaacctgctgctgaatgtggtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacctgaagcaccacatcatccaggagctgcccctggacaacacctttgtggcctgtgacagcatcagcaactgcagcagcagcagcagtgacccctacagcgtgtctgactgtggctaccctgtgaccacctttgaggtgcctgtgtctgtgcacacccggcccacagacagcaggacatag

SEQ ID NO: 166465 - DNA, 3960 bp, Artificial Sequence
  Description of Artificial Sequence: Synthetic coding sequence
tgagtggtgcgggtgaacaccaccaactgccacaagtgcctgctgagcggcacctacatctttgctgtgctgctggtgtgtgtggtgttccacagcggggcccaggagaagaactacaccatccgggaggagatcccagaaaatgtgctgattggcaacctgctgaaggacctgaacctgagcctcatccccaacaagagcctgaccaccaccatgcagttcaagctggtgtacaagacaggagatgtgcccctcatccgcatcgaggaggacaccggggagatcttcaccaccggggccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatcccagaaaattctgccatcaacagcaagtacaccctgcctgctgctgtggaccctgatgtgggcatcaacggggtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacattggagaaaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagaatgctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgatgaaggtgtctgccacagatgctgacagcggccccaatgctgagatcaactacctgctgggcccagatgcccctcctgagttcagcctggacagaagaacaggcatgctgactgtggtgaagaagctggaccgggagaaggaggacaagtacctgttcaccatcctggccaaggacaacggggtgccccccctgaccagcaatgtgacagtgtttgtgtccatcatcgaccagaatgacaacagccctgtgttcacccacaatgagtacaagttctacgtgcctgagaacctgcccaggcatggaacagtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggcagaagatggcggccgggtgagccgcagcagcagcgccaaggtgaccatcaacgtggtggatgtgaatgacaacaagcctgtgttcatcgtgcccccctacaactacagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagactggaaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcattgaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacatgcagaacagcgagtgggccacccccaacccagaaaatcggcagatgatcatgatgaagaagaagaagaagaagaagaagcacagccccaagaacctgctgctgaatgtggtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacctgaagcaccacatcatccaggagctgcccctggacaacacctttgtggcctgtgacagcatcagcaactgcagcagcagcagcagtgacccctacagcgtgtctgactgtggctaccctgtgaccacctttgaggtgcctgtgtctgtgcacacccggcccagccagaggagagtgaccttccacctgcctgagggcagccaggagagcagcagtgatggcggcctgggggaccatgatgctggcagcctgaccagcaccagccacggcctgcccctgggctacccccaggaggagtactttgaccgggccacccccagcaacagaacagaaggagatggcaacagcgaccctgagagcaccttcatccctggcctgaagaaggagatcaccgtgcagcccaccgtggaggaggccagtgacaactgcacccaggagtgcctgatctacggccacagtgatgcctgctggatgcctgccagcctggaccacagcagcagcagccaggcccaggccagcgccctgtgccacagcccccccctgagccaggccagcacccagcaccacagcccccctgtgacccagaccatcgtgctgtgccacagcccccctgtgacccagaccatcgccctgtgccacagccccccacccatccaggtgtctgccctgcaccacagcccccccctggtgcagggcacagccctgcaccacagccccccatctgcccaggccagcgccctgtgctacagcccccccctggcccaggccgccgccatcagccacagcagcagcctgccccaggtgattgccctgcacaggagccaggcccagagctctgtgtccctgcagcagggctgggtgcagggcgccaacggcctgtgcagcgtggaccagggcgtgcagggcagcgccaccagccagttctacaccatgtctgagcggctgcaccccagtgatgacagcatcaaggtgatccccctgaccacctttgccccccggcagcaggcccggcccagcagaggagacagccccatcatggagacccaccccctgtag

SEQ ID NO: 166466 - DNA, 1080 bp, Artificial Sequence
  Description of Artificial Sequence: Synthetic coding sequence
atgaggagcatcaggaagcgctggaccatctgcaccatcagcctgctgctgatcttctacaagaccaaggagatcgccaggacagaggagcaccaggagacccagctgattggagatggagagctgagcctgagccgcagcctggtgaacagcagtgacaagatcatcaggaaggccggcagcagcatcttccagcacaacgtggagggctggaagatcaacagcagcctggtgctggagatcaggaagaacatcctgcgcttcctggatgctgagagagatgtgtctgtggtgaagagcagcttcaagccaggagatgtgatccactacgtgctggacagaagaaggaccctgaacatcagccatgacctgcacagcctgctgcctgaggtgagccccatgaagaacagacgcttcaagacctgtgctgtggtgggcaacagcggcatcctgctggacagtgaatgtgggaaggagattgacagccacaactttgtgatccgctgcaacctggcccctgtggtggagtttgctgctgatgtgggcaccaagagtgacttcatcaccatgaaccccagcgtggtgcagagggcctttggaggcttcagaaatgaaagtgaccgggagaagtttgtgcaccggctgtccatgctgaatgattctgtgctgtggatcccagccttcatggtgaagggcggggagaagcacgtggagtgggtgaatgccctgatcctgaagaacaagctgaaggtgaggacagcctaccccagcctgcggctcatccatgctgtgcggggctactggctgaccaacaaggtgcccatcaagaggcccagcacaggcctgctgatgtacaccctggccacccgcttctgtgatgagatccacctgtatggcttctggcccttccccaaggacctgaatggcaaggctgtgaagtaccactactatgatgacctgaagtaccgctacttcagcaatgccagcccccacaggatgcccctggagttcaagaccctgaatgtgctgcacaacagaggagccctgaagctgaccactggaaaatgtgtgaagcagtag

SEQ ID NO: 166467 - DNA, 72 bp, Artificial Sequence
  Description of Artificial Sequence: Synthetic coding sequence
atgatgcagctgctgcagctgctgctgggcctgctgggccctgggggctacctgttcctgctgggggactag

SEQ ID NO: 166468 - DNA, 3480 bp, Artificial Sequence
  Description of Artificial Sequence: Synthetic coding sequence
atgtacctgagcatctgctgctgcttcctgctgtgggccccagccctgaccctgaagaacctgaactacagcgtgcctgaggagcagggcgccggcaccgtgattggcaacatcggcagagatgcccggctgcagcccggcctgcccccagctgagcggggcggcggcggccgcagcaagagcggcagctacagagtgctggagaacagcgccccccacctgctggatgtggatgctgacagcggcctgctgtacaccaagcagagaattgaccgggagagcctgtgccgccacaatgccaagtgccagctgagcctggaggtgtttgccaatgacaaggagatctgcatgatcaaggtggagatccaggacatcaatgacaatgcccccagcttcagcagtgaccagatcgagatggacatcagtgaaaatgctgcccctggcacccgcttccccctgaccagcgcccatgaccctgatgctggagaaaatggcctgcggacctacctgctgaccagagatgaccacggcctgtttggcctggatgtgaagagcagaggagatggcaccaagtttcctgagctggtgatccagaaggccctggaccgggagcagcagaaccaccacaccctggtgctgacagccctggatggaggagagcccccaagaagtgccaccgtgcagatcaacgtgaaggtgattgacagcaatgacaacagccctgtgtttgaggcccccagctacctggtggagctgcctgaaaatgcccccctgggcaccgtggtgattgacctgaatgccacagatgctgatgagggccccaatggagaggtgctgtacagcttcagcagctatgtgcctgacagagtgcgggagctgttcagcattgaccccaagacaggcctcatccgggtgaagggcaacctggactatgaagaaaatggcatgctggagattgatgtgcaggcccgggacctgggccccaaccccatcccagcccactgcaaggtgacagtgaagctgattgacagaaatgacaatgcccccagcattggatttgtgtctgtgcggcagggcgccctgtctgaggccgcccctcctggcaccgtgattgccctggtgcgggtgacagaccgggacagcggcaagaatggccagctgcagtgccgggtgctgggcggcggcggcactggaggcggcggcggcctgggcggccctgggggctctgtgcccttcaagctggaggagaactatgacaacttctacacagtggtgacagaccggcccctggaccgggagacccaggatgagtacaacgtgaccatcgtggccagagatggcggcagcccccccctgaacagcaccaagagctttgccatcaagatcctggatgaaaatgacaaccccccacgcttcaccaagggcctgtatgtgctgcaggtgcatgagaacaacatccctggagagtacctgggctctgtgctggcccaggaccctgacctgggccagaatggcaccgtgtcctacagcatcctgcccagccacatcggagatgtgtccatctacacctacgtgtctgtgaaccccaccaatggagccatctatgccctgcgctccttcaactttgagcagaccaaggcctttgagttcaaggtgctggccaaggacagcggggccccagcccacctggagagcaatgccaccgtgcgggtgacagtgctggatgtgaatgacaatgcccctgtgattgtgctgcccaccctgcagaatgacacagctgagctgcaggtgcccagaaatgccggcctgggctacctggtgtccacagtgcgggccctggacagcgactttggagagagcggccgcctgacctatgaaattgtggatggaaatgatgaccacctgtttgaaattgaccccagcagcggggagatccgcaccctgcaccccttctgggaggatgtgacccctgtggtggagctggtggtgaaggtgacagaccacggcaagcccaccctgtctgctgtggccaagctgatcatccgctctgtgtctggcagcctgcctgagggcgtgccccgggtgaatggagagcagcaccactgggacatgagcctgcccctgattgtgaccctgagcaccatcagcatcatcctgctggccgccatgatcaccatcgctgtgaagtgcaagcgggagaacaaggagatccgcacctacaactgcagaattgctgagtacagccacccccagctgggcggcggcaagggcaagaagaagaagatcaacaagaatgacatcatgctggtgcagagcgaggtggaggagagaaatgccatgaatgtgatgaatgtggtgagcagccccagcctggccaccagccccatgtactttgactaccagacccggctgcccctgagcagccccaggtctgaggtgatgtacctgaagccagccagcaacaacctgactgtgccccagggccacgccggctgccacaccagcttcaccggccagggcaccaatgccagcgagaccccagccaccaggatgagcatcatccagacagacaacttccctgctgagcccaactacatgggcagccggcagcagtttgtgcagagcagcagcaccttcaaggaccctgagcgggccagcctgcgggacagcggccacggggacagcgaccaggccgacagcgaccaggacaccaacaagggcagctgctgtgacatgtctgtgcgggaggccctgaagatgaagaccaccagcaccaagagccagcccctggagcaggagcctgaggagtgtgtgaactgcacagatgaatgtcgggtgctgggccacagcgaccgctgctggatgccccagtttcctgctgccaaccaggctgaaaatgctgactaccgcaccaacctgtttgtgcccaccgtggaggccaacgtggagacagagacctatgaaacagtgaaccccaccgggaagaagaccttctgcaccttcggcaaggacaagcgggagcacaccatcctgattgccaacgtgaagccctacctgaaggccaagagggccctgagccccctgctgcaggaggtgcccagcgccagcagcagccccaccaaggcctgcatcgagccctgcaccagcaccaagggcagcctggatggctgtgaggccaagccaggggccctggccgaggccagcagccagtacctgcccacagacagccagtacctgagccccagcaagcagccccgggacccccccttcatggccagtgaccagatggcccgggtgtttgctgatgtgcacagccgggccagccgggacagcagcgagatgggcgctgtgctggagcagctggaccaccccaacagagacctgggccgggagagcgtggatgctgaggaggtggtgcgggagattgacaagctgctgcaggactgcagaggaaatgaccctgtggccgtgaggaagtag

SEQ ID NO: 166469 - DNA, 3408 bp, Artificial Sequence
  Description of Artificial Sequence: Synthetic coding sequence
atgcaccagatgaatgccaagatgcacttccgctttgtgtttgccctgctgattgtgtccttcaaccatgatgtgctgggcaagaacctgaagtaccgcatctatgaggagcagagggtgggcagcgtcatcgcccggctgtctgaagatgtggctgatgtgctgctgaagctgcccaaccccagcacagtgcgcttccgggccatgcagaggggcaacagccccctgctggtggtgaatgaagataatggagagatcagcatcggggccaccatcgaccgggagcagctgtgccagaagaacctgaactgcagcattgaatttgatgtgatcaccctgcccacagagcacctgcagctgttccacatcgaggtggaggtgctggacatcaatgacaacagcccccagttcagccgcagcctcatccccatcgagatcagcgagagcgctgctgtgggcacccgcatccccctggacagcgcctttgatcctgatgtgggggagaacagcctgcacacctacagcctgagcgccaatgacttcttcaacatcgaggtgaggaccaggacagatggagccaagtatgcagagctgattgtggtgcgggagctggaccgggagctgaagagcagctatgagctgcagctgacagccagtgacatgggcgtgccccagaggagcggcagcagcatcctgaagatcagcatcagtgacagcaatgacaacagccctgcctttgagcagcagagctacatcatccagctgctggagaacagccctgtgggcaccctgctgctggacctgaatgccacagatcctgatgagggcgccaacgggaagatcgtgtacagcttcagcagccacgtgagccccaagatcatggagaccttcaagattgattctgagcggggccacctgaccctcttcaagcaggtggactatgagatcaccaagagctatgaaattgatgtgcaggcccaggacctgggccccaacagcatcccagcccactgcaagatcatcatcaaggtggtggatgtgaatgacaacaagccagagatcaacatcaacctgatgagccctgggaaggaggagatctcctacatctttgaaggagaccccatcgacacctttgtggccctggtgcgggtgcaggacaaggacagcggcctgaatggagaaattgtgtgcaagctgcacggccacggccacttcaagctgcagaagacctatgagaacaactacctgatcctgaccaatgccaccctggaccgggagaagaggtctgagtacagcctgactgtgattgctgaggaccggggcacccccagcctgagcacagtgaagcacttcaccgtgcagatcaatgacatcaatgacaaccccccccacttccagaggagccgctatgaatttgtgatcagcgagaacaacagccctggggcctacatcaccaccgtgacagccacagatcctgacctgggggagaatggccaggtgacctacaccatcctggagagcttcatcctgggcagcagcatcaccacctacgtgaccatcgaccccagcaatggagccatctatgccctgcgcatctttgaccacgaggaggtgtcccagatcacctttgtggtggaggccagagatggcggcagccccaagcagctggtgagcaacaccaccgtggtgctgaccatcattgatgaaaatgacaacgtgcctgtggtgattggccctgccctgaggaacaacacagctgagatcaccatccccaagggagctgagagcggcttccacgtgacccgcatccgggccatcgaccgggacagcggcgtgaatgctgagctgagctgtgccatcgtggccggaaatgaggagaacatcttcatcatcgaccccaggagctgtgacatccacaccaacgtgtccatggacagcgtgccctacacagagtgggagctgagcgtcatcatccaggacaagggcaacccccagctgcacaccaaggtgctgctgaagtgcatgatctttgaatatgcagagagcgtgaccagcacagccatgacctctgtgtcccaggccagcctggatgtgtccatgatcatcatcatcagcctgggcgccatctgtgctgtgctgctggtgatcatggtgctgtttgccacccgctgcaaccgggagaagaaggacaccaggagctacaactgccgggtggccgagagcacctaccagcaccaccccaagaggcccagccggcagatccacaagggggacatcaccctggtgcccaccatcaatggcaccctgcccatccgcagccaccacaggagcagccccagcagcagccccaccctggagcggggccagatgggcagccggcagagccacaacagccaccagagcctgaacagcctggtgaccatcagcagcaaccacgtgcctgagaacttcagcctggagctgacccacgccaccccagctgtggagcaggtgtcccagctgctgtccatgctgcaccagggccagtaccagccccggcccagcttccggggcaacaagtacagccgcagctaccgctatgccctgcaggacatggacaagttcagcctgaaggacagcggccgcggggacagcgaggccggggacagcgactatgacctgggccgggacagccccatcgaccggctgctgggggagggcttcagtgacctcttcctgacagatggccgcatcccagctgccatgaggctgtgcacagaagaatgtcgggtgctgggccacagcgaccagtgctggatgccacccctgcccagccccagcagtgactaccgcagcaacatgttcatccctggagaggagttccccacccagccccagcagcagcacccccaccagagcctggaggatgatgcccagcctgctgacagcggggagaagaagaagagcttcagcaccttcggcaaggacagccccaatgatgaggacaccggggacaccagcaccagcagcctgctgtctgagatgagcagcgtcttccagaggctgctgccccccagcctggacacctacagtgaatgttctgaggtggacaggagcaacagcctggagaggaggaagggccccctgcctgccaagacagtgggctacccccagggcgtggccgcctgggccgccagcacccacttccagaaccccaccaccaactgtggcccccccctgggcacccacagctctgtgcagcccagcagcaagtggctgcctgccatggaggagatccctgagaactatgaggaggatgactttgacaacgtgctgaaccacctgaatgatggcaagcatgagctgatggatgccagcgagctggtggccgagatcaacaagctgctgcaggatgtgcggcagagctag

SEQ ID NO: 166470 - DNA, 3405 bp, Artificial Sequence
  Description of Artificial Sequence: Synthetic coding sequence
atgcaccagatgaatgccaagatgcacttccgctttgtgtttgccctgctgattgtgtccttcaaccatgatgtgctgggcaagaacctgaagtaccgcatctatgaggagcagagggtgggcagcgtcatcgcccggctgtctgaagatgtggctgatgtgctgctgaagctgcccaaccccagcacagtgcgcttccgggccatgcagaggggcaacagccccctgctggtggtgaatgaagataatggagagatcagcatcggggccaccatcgaccgggagcagctgtgccagaagaacctgaactgcagcattgaatttgatgtgatcaccctgcccacagagcacctgcagctgttccacatcgaggtggaggtgctggacatcaatgacaacagcccccagttcagccgcagcctcatccccatcgagatcagcgagagcgctgctgtgggcacccgcatccccctggacagcgcctttgatcctgatgtgggggagaacagcctgcacacctacagcctgagcgccaatgacttcttcaacatcgaggtgaggaccaggacagatggagccaagtatgcagagctgattgtggtgcgggagctggaccgggagctgaagagcagctatgagctgcagctgacagccagtgacatgggcgtgccccagaggagcggcagcagcatcctgaagatcagcatcagtgacagcaatgacaacagccctgcctttgagcagcagagctacatcatccagctgctggagaacagccctgtgggcaccctgctgctggacctgaatgccacagatcctgatgagggcgccaacgggaagatcgtgtacagcttcagcagccacgtgagccccaagatcatggagaccttcaagattgattctgagcggggccacctgaccctcttcaagcaggtggactatgagatcaccaagagctatgaaattgatgtgcaggcccaggacctgggccccaacagcatcccagcccactgcaagatcatcatcaaggtggtggatgtgaatgacaacaagccagagatcaacatcaacctgatgagccctgggaaggaggagatctcctacatctttgaaggagaccccatcgacacctttgtggccctggtgcgggtgcaggacaaggacagcggcctgaatggagaaattgtgtgcaagctgcacggccacggccacttcaagctgcagaagacctatgagaacaactacctgatcctgaccaatgccaccctggaccgggagaagaggtctgagtacagcctgactgtgattgctgaggaccggggcacccccagcctgagcacagtgaagcacttcaccgtgcagatcaatgacatcaatgacaaccccccccacttccagaggagccgctatgaatttgtgatcagcgagaacaacagccctggggcctacatcaccaccgtgacagccacagatcctgacctgggggagaatggccaggtgacctacaccatcctggagagcttcatcctgggcagcagcatcaccacctacgtgaccatcgaccccagcaatggagccatctatgccctgcgcatctttgaccacgaggaggtgtcccagatcacctttgtggtggaggccagagatggcggcagccccaagcagctggtgagcaacaccaccgtggtgctgaccatcattgatgaaaatgacaacgtgcctgtggtgattggccctgccctgaggaacaacacagctgagatcaccatccccaagggagctgagagcggcttccacgtgacccgcatccgggccatcgaccgggacagcggcgtgaatgctgagctgagctgtgccatcgtggccggaaatgaggagaacatcttcatcatcgaccccaggagctgtgacatccacaccaacgtgtccatggacagcgtgccctacacagagtgggagctgagcgtcatcatccaggacaagggcaacccccagctgcacaccaaggtgctgctgaagtgcatgatctttgaatatgcagagagcgtgaccagcacagccatgacctctgtgtcccaggccagcctggatgtgtccatgatcatcatcatcagcctgggcgccatctgtgctgtgctgctggtgatcatggtgctgtttgccacccgctgcaaccgggagaagaaggacaccaggagctacaactgccgggtggccgagagcacctaccagcaccaccccaagaggcccagccggcagatccacaagggggacatcaccctggtgcccaccatcaatggcaccctgcccatccgcagccaccacaggagcagccccagcagcagccccaccctggagcggggccagatgggcagccggcagagccacaacagccaccagagcctgaacagcctggtgaccatcagcagcaaccacgtgcctgagaacttcagcctggagctgacccacgccaccccagctgtggaggtgtcccagctgctgtccatgctgcaccagggccagtaccagccccggcccagcttccggggcaacaagtacagccgcagctaccgctatgccctgcaggacatggacaagttcagcctgaaggacagcggccgcggggacagcgaggccggggacagcgactatgacctgggccgggacagccccatcgaccggctgctgggggagggcttcagtgacctcttcctgacagatggccgcatcccagctgccatgaggctgtgcacagaggagtgccgggtgctgggccacagcgaccagtgctggatgccacccctgcccagccccagcagtgactaccgcagcaacatgttcatccctggagaggagttccccacccagccccagcagcagcacccccaccagagcctggaggatgatgcccagcctgctgacagcggggagaagaagaagagcttcagcaccttcggcaaggacagccccaatgatgaagatactggagacaccagcaccagcagcctgctgtctgagatgagctctgtgttccagaggctgctgccccccagcctggacacctacagcgagtgcagcgaggtggacaggagcaacagcctggagaggaggaagggccccctgcctgccaagacagtgggctacccccagggcgtggccgcctgggccgccagcacccacttccagaaccccaccaccaactgtggcccccccctgggcacccacagctctgtgcagcccagcagcaagtggctgcctgccatggaggagatcccagaaaattatgaagaagatgactttgacaacgtgctgaaccacctgaatgatggcaagcatgagctgatggatgccagcgagctggtggccgagatcaacaagctgctgcaggatgtgcggcagagctag

SEQ ID NO: 166471 - DNA, 3306 bp, Artificial Sequence
  Description of Artificial Sequence: Synthetic coding sequence
atggagagcctgctgctgcctgtgctgctgctgctggccatcctgtggacccaggccgccgccctgatcaacctgaagtacagcgtggaggaggagcagagagctggcaccgtgattgccaacgtggccaaggatgcccgggaggccggctttgccctggacccccggcaggccagcgccttccgggtggtgagcaacagcgccccccacctggtggacatcaaccccagcagcggcctgctggtgaccaagcagaagattgaccgggacctgctgtgccggcagagccccaagtgcatcatcagcctggaggtgatgagcagctccatggagatctgtgtgatcaaggtggagatcaaggacctgaatgacaatgcccccagcttccctgctgcccagatcgagctggagatcagcgaggccgccagccctggcacccgcatccccctggacagcgcctatgaccctgacagcggcagctttggagtgcagacctatgagctgaccccaaatgagctgtttggcctggagatcaagaccagaggagatggcagcagatttgctgagctggtggtggagaagagcctggaccgggagacccagagccactacagcttccgcatcacagccctggatggaggagaccccccccggctgggcaccgtgggcctgagcatcaaggtgacagacagcaatgacaacaaccctgtgttttctgagagcacctatgctgtgtctgtgcctgagaacagcccccccaacacccctgtgatccggctgaatgccagtgaccctgatgagggcaccaacggccaggtggtgtacagcttctacggctacgtgaatgacaggacccgggagctgttccagattgacccccacagcggcctggtgacagtgactggagccctggactatgaggagggccacgtgtatgagctggatgtgcaggccaaggacctgggccccaacagcatcccagcccactgcaaggtgacagtgtctgtgctggacaccaatgacaacccccctgtgatcaacctgctgtctgtgaacagcgagctggtggaggtgtctgagagcgcccctcctggctacgtgattgccctggtgcgggtgtctgaccgggacagcggcctgaatggccgggtgcagtgccgcctgctgggcaatgtgcccttccggctgcaggagtatgagagcttcagcaccatcctggtggatggccgcctggaccgggagcagcacgaccagtacaacctgaccatccaggccagagatggaggagtgcccatgctgcagagcgccaagagcttcaccgtgctgatcacagatgaaaatgacaaccacccccacttcagcaagccctactaccaggtgattgtgcaggagaacaacacccctggggcctacctgctgtctgtgtctgcccgggaccctgacctgggcctgaatggatctgtgtcctaccagatcgtgcccagccaggtgcgggacatgcctgtgttcacctacgtgtccatcaaccccaacagcggggacatctatgccctgcggagcttcaaccacgagcagaccaaggcctttgagttcaaggtgctggccaaggatggcggcctgcccagcctgcagagcaatgccaccgtgcgggtcatcatcctggatgtgaatgacaacacccctgtgatcacagccccacccctcatcaatggaacagctgaggtgtacatccccagaaattctggaattggctacctggtgacagtggtgaaggcagaagattatgatgaaggagaaaatggccgggtgacctatgacatgacagaaggagaccggggcttctttgaaattgaccaggtgaatggagaggtgaggaccaccaggaccttcggggagagcagcaagagcagctatgagctgattgtggtggcccatgaccacggcaagaccagcctgagcgccagcgccctggtgctgatctacctgagccctgccctggatgcccaggagagcatgggctctgtgaacctgagcctcatcttcatcatcgccctgggcagcattgctggcatcctgtttgtgaccatgatctttgtggccatcaagtgcaagagggacaacaaggagatccgcacctacaactgcagaattgctgagtacagctatggccaccagaagaagagcagcaagaagaagaagatcagcaagaatgacatccggctggtgcccagagatgtggaggagacagacaagatgaatgtggtgtcctgcagcagcctgaccagcagcctgaactactttgactaccaccagcagaccctgcccctgggctgcagaagaagtgagagcaccttcctgaatgtggagaaccagaacaccaggaacaccagcgccaaccacatctaccaccacagcttcaacagccagggcccccagcagcctgacctgatcatcaatggagtgcccctgcctgagacagagaactacagctttgacagcaactacgtgaacagccgggcccacctgatcaagagcagcagcaccttcaaggacctggagggcaacagcctgaaggacagcggccacgaggagagtgaccagacagacagcgagcatgatgtgcagaggagcctgtactgtgacacagctgtgaatgatgtgctgaacacctctgtgacctccatgggcagccagatgccagaccatgaccagaatgaaggcttccactgccgggaggagtgccgcatcctgggccacagcgaccgctgctggatgcccaggaaccccatgcccatccgcagcaagagccctgagcacgtgaggaacatcatcgccctgagcattgaggccacagctgctgatgtggaggcctatgatgactgtggccccaccaagaggacctttgccaccttcggcaaggatgtgtctgaccaccctgctgaggagcggcccaccctgaagggcaagaggacagtggatgtgaccatctgcagccccaaggtgaacagcgtcatccgggaggccggaaatggctgtgaggccatcagccctgtgaccagccccctgcacctgaagagcagcctgcccaccaagcccagcgtgtcctacaccatcgccctggcccccccagcccgggacctggagcagtatgtgaacaacgtgaacaacggccccacccggcccagcgaggccgagcccagaggagctgacagcgagaaggtgatgcatgaggtgagccccatcctgaaggagggcaggaacaaggagagccctggggtgaagaggctgaaggacatcgtgctgtag

SEQ ID NO: 166472 - DNA, 3447 bp, Artificial Sequence
  Description of Artificial Sequence: Synthetic coding sequence
atggagagcctgctgctgcctgtgctgctgctgctggccatcctgtggacccaggccgccgccctgatcaacctgaagtacagcgtggaggaggagcagagagctggcaccgtgattgccaacgtggccaaggatgcccgggaggccggctttgccctggacccccggcaggccagcgccttccgggtggtgagcaacagcgccccccacctggtggacatcaaccccagcagcggcctgctggtgaccaagcagaagattgaccgggacctgctgtgccggcagagccccaagtgcatcatcagcctggaggtgatgagcagctccatggagatctgtgtgatcaaggtggagatcaaggacctgaatgacaatgcccccagcttccctgctgcccagatcgagctggagatcagcgaggccgccagccctggcacccgcatccccctggacagcgcctatgaccctgacagcggcagctttggagtgcagacctatgagctgaccccaaatgagctgtttggcctggagatcaagaccagaggagatggcagcagatttgctgagctggtggtggagaagagcctggaccgggagacccagagccactacagcttccgcatcacagccctggatggaggagaccccccccggctgggcaccgtgggcctgagcatcaaggtgacagacagcaatgacaacaaccctgtgttttctgagagcacctatgctgtgtctgtgcctgagaacagcccccccaacacccctgtgatccggctgaatgccagtgaccctgatgagggcaccaacggccaggtggtgtacagcttctacggctacgtgaatgacaggacccgggagctgttccagattgacccccacagcggcctggtgacagtgactggagccctggactatgaggagggccacgtgtatgagctggatgtgcaggccaaggacctgggccccaacagcatcccagcccactgcaaggtgacagtgtctgtgctggacaccaatgacaacccccctgtgatcaacctgctgtctgtgaacagcgagctggtggaggtgtctgagagcgcccctcctggctacgtgattgccctggtgcgggtgtctgaccgggacagcggcctgaatggccgggtgcagtgccgcctgctgggcaatgtgcccttccggctgcaggagtatgagagcttcagcaccatcctggtggatggccgcctggaccgggagcagcacgaccagtacaacctgaccatccaggccagagatggaggagtgcccatgctgcagagcgccaagagcttcaccgtgctgatcacagatgaaaatgacaaccacccccacttcagcaagccctactaccaggtgattgtgcaggagaacaacacccctggggcctacctgctgtctgtgtctgcccgggaccctgacctgggcctgaatggatctgtgtcctaccagatcgtgcccagccaggtgcgggacatgcctgtgttcacctacgtgtccatcaaccccaacagcggggacatctatgccctgcggagcttcaaccacgagcagaccaaggcctttgagttcaaggtgctggccaaggatggcggcctgcccagcctgcagagcaatgccaccgtgcgggtcatcatcctggatgtgaatgacaacacccctgtgatcacagccccacccctcatcaatggaacagctgaggtgtacatccccagaaattctggaattggctacctggtgacagtggtgaaggcagaagattatgatgaaggagaaaatggccgggtgacctatgacatgacagaaggagaccggggcttctttgaaattgaccaggtgaatggagaggtgaggaccaccaggaccttcggggagagcagcaagagcagctatgagctgattgtggtggcccatgaccacggcaagaccagcctgagcgccagcgccctggtgctgatctacctgagccctgccctggatgcccaggagagcatgggctctgtgaacctgagcctcatcttcatcatcgccctgggcagcattgctggcatcctgtttgtgaccatgatctttgtggccatcaagtgcaagagggacaacaaggagatccgcacctacaactgcagcaactgcctgaccatcacctgcctgctgggctgcttcatcaagggccagaacagcaagtgcctgcactgcatctctgtgagccccatcagcgaggagcaggacaagaagacagaggagaaggtgtccctgcggggcaagagaattgctgagtacagctatggccaccagaagaagagcagcaagaagaagaagatcagcaagaatgacatccggctggtgcccagagatgtggaggagacagacaagatgaatgtggtgtcctgcagcagcctgaccagcagcctgaactactttgactaccaccagcagaccctgcccctgggctgccgccgctctgagagcaccttcctgaatgtggagaaccagaacaccaggaacaccagcgccaaccacatctaccaccacagcttcaacagccagggcccccagcagcctgacctgatcatcaacggggtgcccctgcctgagacagagaactacagctttgacagcaactacgtgaacagccgggcccacctgatcaagagcagcagcaccttcaaggacctggagggcaacagcctgaaggacagcggccacgaggagagtgaccagacagattctgaacatgatgtgcagaggagcctgtactgtgacacagctgtgaatgatgtgctgaacacctctgtgacctccatgggcagccagatgccagaccatgaccagaatgaaggcttccactgccgggaggagtgccgcatcctgggccacagcgaccgctgctggatgcccaggaaccccatgcccatccgcagcaagagccctgagcacgtgaggaacatcatcgccctgagcattgaggccacagctgctgatgtggaggcctatgatgactgtggccccaccaagaggacctttgccaccttcggcaaggatgtgtctgaccaccctgctgaggagcggcccaccctgaagggcaagaggacagtggatgtgaccatctgcagccccaaggtgaacagcgtcatccgggaggccggaaatggctgtgaggccatcagccctgtgaccagccccctgcacctgaagagcagcctgcccaccaagcccagcgtgtcctacaccatcgccctggcccccccagcccgggacctggagcagtatgtgaacaacgtgaacaacggccccacccggcccagcgaggccgagcccagaggagctgacagcgagaaggtgatgcatgaggtgagccccatcctgaaggagggcaggaacaaggagagccctggggtgaagaggctgaaggacatcgtgctgtag

SEQ ID NO: 166473 - DNA, 3303 bp, Artificial Sequence
  Description of Artificial Sequence: Synthetic coding sequence
atggagagcctgctgctgcctgtgctgctgctgctggccatcctgtggacccaggccgccgccctgatcaacctgaagtacagcgtggaggaggagcagagagctggcaccgtgattgccaacgtggccaaggatgcccgggaggccggctttgccctggacccccggcaggccagcgccttccgggtggtgagcaacagcgccccccacctggtggacatcaaccccagcagcggcctgctggtgaccaagcagaagattgaccgggacctgctgtgccggcagagccccaagtgcatcatcagcctggaggtgatgagcagctccatggagatctgtgtgatcaaggtggagatcaaggacctgaatgacaatgcccccagcttccctgctgcccagatcgagctggagatcagcgaggccgccagccctggcacccgcatccccctggacagcgcctatgaccctgacagcggcagctttggagtgcagacctatgagctgaccccaaatgagctgtttggcctggagatcaagaccagaggagatggcagcagatttgctgagctggtggtggagaagagcctggaccgggagacccagagccactacagcttccgcatcacagccctggatggaggagaccccccccggctgggcaccgtgggcctgagcatcaaggtgacagacagcaatgacaacaaccctgtgttttctgagagcacctatgctgtgtctgtgcctgagaacagcccccccaacacccctgtgatccggctgaatgccagtgaccctgatgagggcaccaacggccaggtggtgtacagcttctacggctacgtgaatgacaggacccgggagctgttccagattgacccccacagcggcctggtgacagtgactggagccctggactatgaggagggccacgtgtatgagctggatgtgcaggccaaggacctgggccccaacagcatcccagcccactgcaaggtgacagtgtctgtgctggacaccaatgacaacccccctgtgatcaacctgctgtctgtgaacagcgagctggtggaggtgtctgagagcgcccctcctggctacgtgattgccctggtgcgggtgtctgaccgggacagcggcctgaatggccgggtgcagtgccgcctgctgggcaatgtgcccttccggctgcaggagtatgagagcttcagcaccatcctggtggatggccgcctggaccgggagcagcacgaccagtacaacctgaccatccaggccagagatggaggagtgcccatgctgcagagcgccaagagcttcaccgtgctgatcacagatgaaaatgacaaccacccccacttcagcaagccctactaccaggtgattgtgcaggagaacaacacccctggggcctacctgctgtctgtgtctgcccgggaccctgacctgggcctgaatggatctgtgtcctaccagatcgtgcccagccaggtgcgggacatgcctgtgttcacctacgtgtccatcaaccccaacagcggggacatctatgccctgcggagcttcaaccacgagcagaccaaggcctttgagttcaaggtgctggccaaggatggcggcctgcccagcctgcagagcaatgccaccgtgcgggtcatcatcctggatgtgaatgacaacacccctgtgatcacagccccacccctcatcaatggaacagctgaggtgtacatccccagaaattctggaattggctacctggtgacagtggtgaaggcagaagattatgatgaaggagaaaatggccgggtgacctatgacatgacagaaggagaccggggcttctttgaaattgaccaggtgaatggagaggtgaggaccaccaggaccttcggggagagcagcaagagcagctatgagctgattgtggtggcccatgaccacggcaagaccagcctgagcgccagcgccctggtgctgatctacctgagccctgccctggatgcccaggagagcatgggctctgtgaacctgagcctcatcttcatcatcgccctgggcagcattgctggcatcctgtttgtgaccatgatctttgtggccatcaagtgcaagagggacaacaaggagatccgcacctacaactgcagaattgctgagtacagctatggccaccagaagaagagcagcaagaagaagaagatcagcaagaatgacatccggctggtgcccagagatgtggaggagacagacaagatgaatgtggtgtcctgcagcagcctgaccagcagcctgaactactttgactaccaccagcagaccctgcccctgggctgcagaagaagtgagagcaccttcctgaatgtggagaaccagaacaccaggaacaccagcgccaaccacatctaccaccacagcttcaacagccagggcccccagcagcctgacctgatcatcaatggagtgcccctgcctgagacagagaactacagctttgacagcaactacgtgaacagccgggcccacctgatcaagagcagcaccttcaaggacctggagggcaacagcctgaaggacagcggccacgaggagagtgaccagacagattctgaacatgatgtgcagaggagcctgtactgtgacacagctgtgaatgatgtgctgaacacctctgtgacctccatgggcagccagatgccagaccatgaccagaatgaaggcttccactgccgggaggagtgccgcatcctgggccacagcgaccgctgctggatgcccaggaaccccatgcccatccgcagcaagagccctgagcacgtgaggaacatcatcgccctgagcattgaggccacagctgctgatgtggaggcctatgatgactgtggccccaccaagaggacctttgccaccttcggcaaggatgtgtctgaccaccctgctgaggagcggcccaccctgaagggcaagaggacagtggatgtgaccatctgcagccccaaggtgaacagcgtcatccgggaggccggaaatggctgtgaggccatcagccctgtgaccagccccctgcacctgaagagcagcctgcccaccaagcccagcgtgtcctacaccatcgccctggcccccccagcccgggacctggagcagtatgtgaacaacgtgaacaacggccccacccggcccagcgaggccgagcccagaggagctgacagcgagaaggtgatgcatgaggtgagccccatcctgaaggagggcaggaacaaggagagccctggggtgaagaggctgaaggacatcgtgctgtag

SEQ ID NO: 166474 - DNA, 2094 bp, Artificial Sequence
  Description of Artificial Sequence: Synthetic coding sequence
atgttcaccctggatgtggaggagaatgaaaatggagagaggaccccctacctgattgtgatgggcgccctggaccgggagacccaggaccagtatgtgtccatcatcatcgcagaagatggcggcagcccccccctgctgggcagcgccaccctgaccatcggcatcagtgacatcaatgacaactgccccctcttcacagacagccagatcaacgtgacagtgtatggaaatgccaccgtgggcacccccatcgctgctgtgcaggccgtggacaaggacctgggcaccaatgcccagatcacctacagctacagccagaaggtgccccaggccagcaaggacctcttccacctggatgaaaatactggagtcatcaagctgttcagcaagattggaggctctgtgctggagagccacaagctgaccatcctggccaatggacctggctgcatcccagctgtgatcacagccctggtgtccatcatcaaggtgatcttccggcccccagagatcgtgccccgctacatcgccaatgaaattgatggagtggtgtacctgaaggagctggagcctgtgaacacccccatcgccttcttcaccatccgggaccctgagggcaagtacaaggtgaactgctacctggatggagagggccccttccggctgagcccctacaagccctacaacaatgagtacctgctggagaccaccaagcccatggactatgagctgcagcagttctatgaggtggccgtggtggcctggaacagcgagggcttccacgtgaagagggtcatcaaggtgcagctgctggatgacaatgacaatgcccccatcttcctgcagcccctcatcgagctgaccatcgaggagaacaacagccccaatgccttcctgaccaagctgtatgccacagatgctgacagcgaggagcggggccaggtgtcctacttcctgggcccagatgcccccagctacttcagcctggacagcgtgacaggcatcctgactgtgtccacccagctggaccgggaggagaaggagaagtaccgctacacagtgcgggctgtggactgtgggaagccaccccgggagagcgtggccaccgtggccctgactgtgctggacaagaatgacaacagcccccgcttcatcaacaaggacttctccttctttgtgcctgagaacttccctggctatggagaaattggagtcatctctgtgacagatgctgatgctggaagaaatggctgggtggccctgtctgtggtgaaccagagcgacatctttgtgattgacaccgggaagggcatgctgcgggccaaggtgtccctggaccgggagcagcagagcagctacaccctgtgggtggaggccgtggatggaggagagcccgccctgagcagcacagccaagatcaccatcctgctgctggacatcaatgacaacccccccctggtgctcttcccccagagcaacatgagctacctgctggtgctgcccagcaccctgcccggcagccctgtgacagaggtgtatgctgtggacaaggacaccggcatgaatgctgtgattgcctacagcatcattggaagaagaggccccaggcctgagagcttcagaattgaccccaagacaggcaacatcaccctggaggaggccctgctgcagacagattatggcctgcaccggctgctggtgaaggtgtctgaccacggctacccagagcccctgcacagcacagtgatggtgaacctgtttgtgaatgacacagtgtccaatgaaagctacatcgagagcctgctgaggaaggagcctgagatcaacatcgaggagaaggagccccagatcagcattgagcccacccacaggaaggtggagagcgtgtcctgcatgcccaccctggtggccctgagcgtcatcagcctgggcagcatcaccctggtgacaggcatgggcatctacatctgcctgaggaaaggagagaagcacccccgggaggatgagaacctggaggtgcagatccccctgaagggcaagattgacctgcacatgagggagaggaagcccatggacatcagcaacatctag

SEQ ID NO: 166475 - DNA, 2856 bp, Artificial Sequence
  Description of Artificial Sequence: Synthetic coding sequence
atgagaggaagaggaaatgcccggagcagccaggccctgggcgtgtcctggtgcccagccacctggcacccccggctggacatgggccgcctgcaccggcccaggagcagcaccagctacagaaacctgccccacctgttcctgttcttcctgtttgtgggccccttcagctgcctgggcagctacagccgggccacagagctgctgtacagcctgaatgaaggcctgcctgctggggtgctgattggcagcctggccgaggacctgcggctgctgcccaggtctgctggccgcccagacccccagagccagctgcctgagaggactggagctgagtggaacccccccctgtccttcagcctggccagccggggcctgagcggccagtatgtgaccctggacaacagaagtggagagctgcacaccagcgcccaggagattgaccgggaggccctgtgtgtggagggcggcggcggcacagcctggagcggctctgtgtccatcagcagcagccccagcgacagctgcctgctgctgctggatgtgctggtgctgccccaggagtacttccgctttgtgaaggtgaagatcgccatccgggacatcaatgacaatgccccccagtttcctgtgtcccagatctctgtgtgggtgcctgaaaatgcccctgtgaacacccggctggccatcgagcaccctgctgtggaccctgatgtgggcatcaacggggtgcagacctaccgcctgctggactaccacggcatgttcaccctggatgtggaggagaatgaaaatggagagaggaccccctacctgattgtgatgggcgccctggaccgggagacccaggaccagtatgtgtccatcatcatcgcagaagatggcggcagcccccccctgctgggcagcgccaccctgaccatcggcatcagtgacatcaatgacaactgccccctcttcacagacagccagatcaacgtgacagtgtatggaaatgccaccgtgggcacccccatcgctgctgtgcaggccgtggacaaggacctgggcaccaatgcccagatcacctacagctacagccagaaggtgccccaggccagcaaggacctcttccacctggatgaaaatactggagtcatcaagctgttcagcaagattggaggctctgtgctggagagccacaagctgaccatcctggccaatggacctggctgcatcccagctgtgatcacagccctggtgtccatcatcaaggtgatcttccggcccccagagatcgtgccccgctacatcgccaatgaaattgatggagtggtgtacctgaaggagctggagcctgtgaacacccccatcgccttcttcaccatccgggaccctgagggcaagtacaaggtgaactgctacctggatggagagggccccttccggctgagcccctacaagccctacaacaatgagtacctgctggagaccaccaagcccatggactatgagctgcagcagttctatgaggtggccgtggtggcctggaacagcgagggcttccacgtgaagagggtcatcaaggtgcagctgctggatgacaatgacaatgcccccatcttcctgcagcccctcatcgagctgaccatcgaggagaacaacagccccaatgccttcctgaccaagctgtatgccacagatgctgacagcgaggagcggggccaggtgtcctacttcctgggcccagatgcccccagctacttcagcctggacagcgtgacaggcatcctgactgtgtccacccagctggaccgggaggagaaggagaagtaccgctacacagtgcgggctgtggactgtgggaagccaccccgggagagcgtggccaccgtggccctgactgtgctggacaagaatgacaacagcccccgcttcatcaacaaggacttctccttctttgtgcctgagaacttccctggctatggagaaattggagtcatctctgtgacagatgctgatgctggaagaaatggctgggtggccctgtctgtggtgaaccagagcgacatctttgtgattgacaccgggaagggcatgctgcgggccaaggtgtccctggaccgggagcagcagagcagctacaccctgtgggtggaggccgtggatggaggagagcccgccctgagcagcacagccaagatcaccatcctgctgctggacatcaatgacaacccccccctggtgctcttcccccagagcaacatgagctacctgctggtgctgcccagcaccctgcccggcagccctgtgacagaggtgtatgctgtggacaaggacaccggcatgaatgctgtgattgcctacagcatcattggaagaagaggccccaggcctgagagcttcagaattgaccccaagacaggcaacatcaccctggaggaggccctgctgcagacagattatggcctgcaccggctgctggtgaaggtgtctgaccacggctacccagagcccctgcacagcacagtgatggtgaacctgtttgtgaatgacacagtgtccaatgaaagctacatcgagagcctgctgaggaaggagcctgagatcaacatcgaggagaaggagccccagatcagcattgagcccacccacaggaaggtggagagcgtgtcctgcatgcccaccctggtggccctgagcgtcatcagcctgggcagcatcaccctggtgacaggcatgggcatctacatctgcctgaggaaaggagagaagcacccccgggaggatgagaacctggaggtgcagatccccctgaagggcaagattgacctgcacatgagggagaggaagcccatggacatcagcaacatctag

SEQ ID NO: 166476 - DNA, 2856 bp, Artificial Sequence; identical to SEQ ID NO: 166475
  Description of Artificial Sequence: Synthetic coding sequence

SEQ ID NO: 166477 - DNA, 3603 bp, Artificial Sequence
  Description of Artificial Sequence: Synthetic coding sequence
atgctgaggatgaggacagctggctgggcccggggctggtgcctgggctgctgcctgctgctgcccctgagcctgagcctggccgccgccaagcagctgctgcgctaccgcctggccgaggagggccctgcagatgtgagaattggaaatgtggccagtgacctgggcatcgtgactggaagtggagaggtgaccttcagcctggagagcggcagcgagtacctgaagattgacaacctgactggagagctgagcaccagcgagaggagaattgaccgggagaagctgccccagtgccagatgatctttgatgaaaatgaatgcttcctggactttgaggtgtctgtgattggccccagccagagctgggtggacctgtttgagggccaggtgattgtgctggacatcaatgacaacacccccaccttccccagccctgtgctgaccctgactgtggaggagaacagacctgtgggcaccctgtacctgctgcccacagccacagaccgggactttggaagaaatggaattgaaagatatgagctgctgcaggagcccggcggcggcggcagcggcggggagagccggcgggccggggctgctgacagcgccccctacccaggcggcggcggcaatggagccagcggcggcggcagcggcggcagcaagaggcggctggatgccagcgagggcggcggcggcaccaaccctgggggccgcagctctgtgtttgagctgcaggtggccgacaccccagatggagagaagcagccccagctgattgtgaagggcgtgtatgaggccgacctggccgagaacagcgcccctggcacccccatcctgcagctgcgggctgctgacctggatgtgggcgtgaatggccagatcgagtatgtgtttggagctgccacagagagcgtgcggcggctgctgcggctggatgagaccagcggctggctgtctgtgctgcacagaattgaccgggaggaggtgaaccagctgcgcttcaccgtgatggcccgggaccggggccagccccccaagacagacaaggccaccgtggtgctgaacatcaaggatgaaaatgacaacgtgcccagcattgagatcaggaagattggccgcatccccctgaaggatggagtggccaacgtggctgaagatgtgctggtggacacccccatcgccctggtgcaggtgtctgaccgggaccagggagaaaatggagtggtgacctgcaccgtggtgggagatgtgcccttccagctgaagccagccagtgacacagaaggagaccagaacaagaagaagtacttcctgcacaccagcacccccctggactatgaggccacccgggagttcaacgtggtgattgtggccgtggacagcggcagccccagcctgagcagcaacaacagcctgattgtgaaggtgggggacaccaatgacaacccccccatgtttggccagagcgtggtggaggtgtacttccctgagaacaacatccctggagagcgggtggccaccgtgctggccacagatgctgacagcggcaagaatgctgagatcgcctacagcctggacagctctgtgatgggcatctttgccattgatcctgattctggggacatcctggtgaacacagtgctggaccgggagcagacagacagatatgagttcaaggtgaatgccaaggacaagggcatccctgtgctgcagggcagcaccaccgtgattgtgcaggtggccgacaagaatgacaatgaccccaagttcatgcaggatgtgttcaccttctacgtgaaggagaacctgcagcccaacagccctgtgggcatggtgacagtgatggatgctgacaagggcagaaatgctgagatgagcctgtacatcgaggagaacaacaacatcttcagcattgaaaatgacaccggcaccatctacagcaccatgagctttgaccgggagcaccagaccacctacaccttccgggtgaaggctgtggatggaggagaccccccaagaagtgccacagccaccgtgtccctgtttgtgatggatgaaaatgacaatgcccccaccgtgaccctgcccaagaacatctcctacaccctgctgccccccagcagcaatgtgaggacagtggtggccaccgtgctggccacagacagtgatgatggcatcaatgctgacctgaactacagcatcgtgggcggcaaccccttcaagctgtttgaaattgaccccaccagcggcgtggtgtccctggtgggcaagctgacccagaagcactacggcctgcaccggctggtggtgcaggtgaatgattctggccagcccagccagagcaccaccaccctggtgcacgtgtttgtgaatgaatctgtgtccaatgccacagccatcgacagccagatcgcccggagcctgcacatccccctgacccaggacattgctggggaccccagctatgagatcagcaagcagaggctgagcatcgtgattggagtggtggccggcatcatgaccgtcatcctgatcatcctgattgtggtgatggcccgctactgccgcagcaagaacaagaatggctatgaagctgggaagaaggaccacgaggacttcttcaccccccagcagcacgacaagagcaagaagcccaagaaggacaagaagaacaagaagagcaagcagcccctgtacagcagcatcgtgacagtggaggccagcaagcccaacggccagagatatgattctgtgaatgagaagctgagtgacagccccagcatgggccgctacagatctgtgaatggaggccctggcagcccagacctggcccggcactacaagagcagcagccccctgcccaccgtgcagctgcacccccagagccccacagctgggaagaagcaccaggccgtgcaggacctgcccccagccaacacctttgtgggcgctggggacaacatcagcatcggcagtgaccactgcagcgagtacagctgccagaccaacaacaagtacagcaagcagcccttccggcgggtgaccttctctgtggtgtcccagccccaggacccccaccagggcagcctgcagagctgctatgacagcggcctggaggagagcgagacccccagcagcaagagcagcagcggcccccggctgggcgccctgcccctgcctgaggacaactatgaaagaaccaccccagatggctctgtggacagccggcccctgcctgatgtggccctgaccgggaagtgcacccgggagtgtgatgaatatggccacagcgacagctgctggatgcctgtgaggaccagccctgagaggaagaagagccagcccaagctgagcaccttcatgcctgtggatgagcggggcagccaggagaagctggccaacggggaggccgccatcatgggagacaggaacagaaacctgctgaacaagaagctgaccagcagctatgagaccttctctgctgccagcttcagcaagaatgaggaggccaaccctgaggacatccccctgaccaagacaggagagtacaagcccagccctgtgaacaccctgacccggcgggaggtgtacctgtag

SEQ ID NO: 166478 - DNA, 3210 bp, Artificial Sequence
  Description of Artificial Sequence: Synthetic coding sequence
atgctgaggatgaggacagctggctgggcccggggctggtgcctgggctgctgcctgctgctgcccctgagcctgagcctggccgccgccaagcagctgctgcgctaccgcctggccgaggagggccctgcagatgtgagaattggaaatgtggccagtgacctgggcatcgtgactggaagtggagaggtgaccttcagcctggagagcggcagcgagtacctgaagattgacaacctgactggagagctgagcaccagcgagaggagaattgaccgggagaagctgccccagtgccagatgatctttgatgaaaatgaatgcttcctggactttgaggtgtctgtgattggccccagccagagctgggtggacctgtttgagggccaggtgattgtgctggacatcaatgacaacacccccaccttccccagccctgtgctgaccctgactgtggaggagaacagacctgtgggcaccctgtacctgctgcccacagccacagaccgggactttggaagaaatggaattgaaagatatgagctgctgcaggagcccggcggcggcggcagcggcggggagagccggcgggccggggctgctgacagcgccccctacccaggcggcggcggcaatggagccagcggcggcggcagcggcggcagcaagaggcggctggatgccagcgagggcggcggcggcaccaaccctgggggccgcagctctgtgtttgagctgcaggtggccgacaccccagatggagagaagcagccccagctgattgtgaagggggccctggaccgggagcagagggacagctatgagctgaccctgcgggtgagagatggaggagacccccccaggagcagccaggccatcctgcgggtgctgatcacagatgtgaatgacaacagccccaggtttgagaagtctgtgtatgaagctgacctggctgaaaattctgcccctggcacccccatcctgcagctgcgggctgctgacctggatgtgggcgtgaatggccagattgaatatgtgtttggagctgccacagaatctgtgcggcggctgctgcggctggatgagaccagcggctggctgtctgtgctgcacagaattgaccgggaggaggtgaaccagctgcgcttcaccgtgatggcccgggaccggggccagccccccaagacagacaaggccaccgtggtgctgaacatcaaggatgaaaatgacaacgtgcccagcattgagatcaggaagattggccgcatccccctgaaggatggagtggccaacgtggccgaggatgtgctggtggacacccccatcgccctggtgcaggtgtctgaccgggaccagggagaaaatggagtggtgacctgcaccgtggtgggagatgtgcccttccagctgaagccagccagtgacacagaaggagaccagaacaagaagaagtacttcctgcacaccagcacccccctggactatgaggccacccgggagttcaacgtggtgattgtggccgtggacagcggcagccccagcctgagcagcaacaacagcctcatcgtgaaggtgggggacaccaatgacaacccccccatgtttggccagagcgtggtggaggtgtacttccctgagaacaacatccctggagagcgggtggccaccgtgctggccacagatgctgacagcggcaagaatgctgagatcgcctacagcctggacagctctgtgatgggcatctttgccatcgaccctgacagcggggacatcctggtgaacacagtgctggaccgggagcagacagacagatatgagttcaaggtgaatgccaaggacaagggcatccctgtgctgcagggcagcaccaccgtcatcgtgcaggtggccgacaagaatgacaatgaccccaagttcatgcaggatgtgttcaccttctacgtgaaggagaacctgcagcccaacagccctgtgggcatggtgacagtgatggatgctgacaagggcagaaatgctgagatgagcctgtacatcgaggagaacaacaacatcttcagcattgaaaatgacaccggcaccatctacagcaccatgagctttgaccgggagcaccagaccacctacaccttccgggtgaaggctgtggatggaggagacccccccaggtctgccacagccaccgtgtccctgtttgtgatggatgaaaatgacaatgcccccaccgtgaccctgcccaagaacatctcctacaccctgctgccccccagcagcaatgtgaggacagtggtggccaccgtgctggccacagacagtgatgatggcatcaatgctgacctgaactacagcatcgtgggcggcaaccccttcaagctgtttgaaattgaccccaccagcggcgtggtgtccctggtgggcaagctgacccagaagcactacggcctgcaccggctggtggtgcaggtgaatgacagcggccagcccagccagagcaccaccaccctggtgcacgtgtttgtgaatgaatctgtgtccaatgccacagccatcgacagccagatcgcccggagcctgcacatccccctgacccaggacattgctggggaccccagctatgagatcagcaagcagaggctgagcatcgtcatcggcgtggtggccggcatcatgaccgtcatcctgatcatcctgattgtggtgatggcccgctactgccgcagcaagaacaagaatggctatgaggccggcaagaaggaccacgaggacttcttcaccccccagcagcacgacaagagcaagaagcccaagaaggacaagaagaacaagaagagcaagcagcccctgtacagcagcatcgtgacagtggaggccagcaagcccaacggccagagatatgacagcgtgaatgagaagctgagtgacagccccagcatgggccgctacagatctgtgaatggaggccctggcagcccagacctggcccggcactacaagagcagcagccccctgcccaccgtgcagctgcacccccagagccccacagctgggaagaagcaccaggccgtgcaggacctgcccccagccaacacctttgtgggcgctggggacaacatcagcattggaagtgaccactgcagcgagtacagctgccagaccaacaacaagtacagcaagcagatgaggctgcacccctacatcaccgtgtttggatag

SEQ ID NO: 166479 - DNA, 3768 bp, Artificial Sequence
  Description of Artificial Sequence: Synthetic coding sequence
atgctgaggatgaggacagctggctgggcccggggctggtgcctgggctgctgcctgctgctgcccctgagcctgagcctggccgccgccaagcagctgctgcgctaccgcctggccgaggagggccctgcagatgtgagaattggaaatgtggccagtgacctgggcatcgtgactggaagtggagaggtgaccttcagcctggagagcggcagcgagtacctgaagattgacaacctgactggagagctgagcaccagcgagaggagaattgaccgggagaagctgccccagtgccagatgatctttgatgaaaatgaatgcttcctggactttgaggtgtctgtgattggccccagccagagctgggtggacctgtttgagggccaggtgattgtgctggacatcaatgacaacacccccaccttccccagccctgtgctgaccctgactgtggaggagaacagacctgtgggcaccctgtacctgctgcccacagccacagaccgggactttggaagaaatggaattgaaagatatgagctgctgcaggagcccggcggcggcggcagcggcggggagagccggcgggccggggctgctgacagcgccccctacccaggcggcggcggcaatggagccagcggcggcggcagcggcggcagcaagaggcggctggatgccagcgagggcggcggcggcaccaaccctgggggccgcagctctgtgtttgagctgcaggtggccgacaccccagatggagagaagcagccccagctgattgtgaagggggccctggaccgggagcagagggacagctatgagctgaccctgcgggtgagagatggaggagacccccccaggagcagccaggccatcctgcgggtgctgatcacagatgtgaatgacaacagccccaggtttgagaagtctgtgtatgaagctgacctggctgaaaattctgcccctggcacccccatcctgcagctgcgggctgctgacctggatgtgggcgtgaatggccagattgaatatgtgtttggagctgccacagaatctgtgcggcggctgctgcggctggatgagaccagcggctggctgtctgtgctgcacagaattgaccgggaggaggtgaaccagctgcgcttcaccgtgatggcccgggaccggggccagccccccaagacagacaaggccaccgtggtgctgaacatcaaggatgaaaatgacaacgtgcccagcattgagatcaggaagattggccgcatccccctgaaggatggagtggccaacgtggccgaggatgtgctggtggacacccccatcgccctggtgcaggtgtctgaccgggaccagggagaaaatggagtggtgacctgcaccgtggtgggagatgtgcccttccagctgaagccagccagtgacacagaaggagaccagaacaagaagaagtacttcctgcacaccagcacccccctggactatgaggccacccgggagttcaacgtggtgattgtggccgtggacagcggcagccccagcctgagcagcaacaacagcctcatcgtgaaggtgggggacaccaatgacaacccccccatgtttggccagagcgtggtggaggtgtacttccctgagaacaacatccctggagagcgggtggccaccgtgctggccacagatgctgacagcggcaagaatgctgagatcgcctacagcctggacagctctgtgatgggcatctttgccatcgaccctgacagcggggacatcctggtgaacacagtgctggaccgggagcagacagacagatatgagttcaaggtgaatgccaaggacaagggcatccctgtgctgcagggcagcaccaccgtcatcgtgcaggtggccgacaagaatgacaatgaccccaagttcatgcaggatgtgttcaccttctacgtgaaggagaacctgcagcccaacagccctgtgggcatggtgacagtgatggatgctgacaagggcagaaatgctgagatgagcctgtacatcgaggagaacaacaacatcttcagcattgaaaatgacaccggcaccatctacagcaccatgagctttgaccgggagcaccagaccacctacaccttccgggtgaaggctgtggatggaggagacccccccaggtctgccacagccaccgtgtccctgtttgtgatggatgaaaatgacaatgcccccaccgtgaccctgcccaagaacatctcctacaccctgctgccccccagcagcaatgtgaggacagtggtggccaccgtgctggccacagacagtgatgatggcatcaatgctgacctgaactacagcatcgtgggcggcaaccccttcaagctgtttgaaattgaccccaccagcggcgtggtgtccctggtgggcaagctgacccagaagcactacggcctgcaccggctggtggtgcaggtgaatgacagcggccagcccagccagagcaccaccaccctggtgcacgtgtttgtgaatgaatctgtgtccaatgccacagccatcgacagccagatcgcccggagcctgcacatccccctgacccaggacattgctggggaccccagctatgagatcagcaagcagaggctgagcatcgtcatcggcgtggtggccggcatcatgaccgtcatcctgatcatcctgattgtggtgatggcccgctactgccgcagcaagaacaagaatggctatgaggccggcaagaaggaccacgaggacttcttcaccccccagcagcacgacaagagcaagaagcccaagaaggacaagaagaacaagaagagcaagcagcccctgtacagcagcatcgtgacagtggaggccagcaagcccaacggccagagatatgacagcgtgaatgagaagctgagtgacagccccagcatgggccgctacagatctgtgaatggaggccctggcagcccagacctggcccggcactacaagagcagcagccccctgcccaccgtgcagctgcacccccagagccccacagctgggaagaagcaccaggccgtgcaggacctgcccccagccaacacctttgtgggcgctggggacaacatcagcattggaagtgaccactgcagcgagtacagctgccagaccaacaacaagtacagcaagcagcccttcagaagagtgaccttctctgtggtgtcccagccccaggacccccaccagggcagcctgcagagctgctatgattctggcctggaggagagcgagacccccagcagcaagagcagcagcggcccccggctgggcgccctgcccctgcctgaggacaactatgaaagaaccaccccagatggctctgtgggggaggccgagcacatggagaatgacagccggcccctgcctgatgtggccctgaccgggaagtgcaccagagaatgtgatgaatatggccacagcgacagctgctggatgcctgtgaggaccagccctgagaggaagaagagccagcccaagctgagcaccttcatgcctgtggatgagcggggcagccaggagaagctggccaatggagaggccgccatcatgggagacaggaacagaaacctgctgaacaagaagctgaccagcagctatgagaccttctctgctgccagcttcagcaagaatgaggaggccaaccctgaggacatccccctgaccaagacaggagagtacaagcccagccctgtgaacaccctgacccggcgggaggtgtacctgtag

SEQ ID NO: 166480 - DNA, 2922 bp, Artificial Sequence
  Description of Artificial Sequence: Synthetic coding sequence
atgagccctgtgcggcgctggggcagcccctgcctcttccccctgcagctgttcagcctgtgctgggtgctgtctgtggcccagagcaagacagtgcgctacagcacctttgaagaagatgcccctggcaccgtcatcggcaccctggccgaggacctgcacatgaaggtgtctggggacaccagcttccggctgatgaagcagttcaacagcagcctgctgcgggtgcgggagggagatggccagctgactgtgggagatgctggcctggaccgggagcggctgtgtggccaggccccccagtgtgtgctggcctttgatgtggtgtccttcagccaggagcagttccggctggtgcacgtggaggtggaggtgagagatgtgaatgaccacgccccccgcttcccccgggcccagatccctgtggaggtgtctgagggcgctgctgtgggcacccgcatccccctggaggtgcctgtggatgaagatgtgggcgccaacggcctgcagacagtgcggctggccgagccccacagccccttccgggtggagctgcagaccagggcagatggagcccagtgtgccgacctggtgctgctgcaggagctggaccgggagagccaggccgcctacagcctggagctggtggcccaggacggcggccggcccccaagaagtgccacagctgccctgtctgtgcgggtgctggatgccaatgaccacagccctgccttcccccagggcgctgtggccgaggtggagctggctgaagatgcccctgtgggcagcctgctgctggacctggatgctgctgaccctgatgagggccccaatggagatgtggtgtttgcctttggagcccggaccccacctgaggcccggcggctcttccggctggaccccaggagcggccgcctgaccctggccggccctgtggactatgaaaggcaggacacctatgagctggatgtgcgggcccaggaccggggccctggccccagggctgccacctgcaaggtgattgtgcgcatcagagatgtgaatgacaatgccccagacatcgccatcacccccctggccgcccctggggccccagccaccagcccctttgctgctgctgctgctgctgctgccctgggcggcgcagatgccagcagccctgctggggccggcaccccagaggccggggccaccagcctggtgcctgagggcgccgcccgggagagcctggtggccctggtgtccaccagtgaccgggacagcggggccaacggccaggtgcgctgtgccctgtatggccacgagcacttccggctgcagcctgcctatgccggcagctacctggtggtgacagctgccagcctggaccgggagagaattgctgagtacaacctgaccctggtggccgaggacagaggagccccacccctgaggacagtgcggccctacacagtgcgggtgggagatgaaaatgacaatgcccccctcttcaccaggcctgtgtatgaggtgtctgtgcgggagaacaaccccccaggggcctacctggccaccgtggccgcccgggaccgggacctgggcagaaatggccaggtgacctaccgcctgctggaggccgaggtgggccgggccggcggcgctgtgtccacctacgtgtctgtggaccctgccaccggggccatctatgccctgcggagctttgattatgagaccctgcggcagctggatgtgcgcatccaggccagtgatggcggcagcccccagctgagcagcagcgccctggtgcaggtgcgggtgctggaccagaatgaccacgcccctgtgctggtgcacccagccccagccaacggcagcctggaggtggccgtgcccggccgcacagccaaggacacagtggtggcccgggtgcaggccagagatgctgatgagggcgccaacggggagctggcctttgagctgcagcagcaggagccccgggaggcctttgccatcggccgcaggactggagagatcctgctgaccggggacctgagccaggagcccccaggccgggtcttccgggccctgctggtgatcagtgatggcggccggccccccctgaccaccacagccaccgtgtcctttgtggtgacagctgggggcggccggggccctgctgccccagccagcgctggcagccctgagaggagccggcccccaggcagccggctgggcgtgtctggctctgtgctgcagtgggacacccccctgattgtcatcatcgtgctggccggcagctgcaccctgctgctggccgccatcatcgccatcgccaccacctgcaacagaaggaagaaggagccctacggggccagccctggctttgggaaggagcccgcccctcctgtggccgtgtggaagggccacagcttcaacaccatcagcggccgggaggccgagaagttcagcggcaaggacagcggcaagggggacagcgacttcaatgacagcgacagcgacatctctggagatgccctgaagaaggacctgatcaaccacatgcagagcggcctgtgggcctgcacagctgagtgcaagatcctgggccacagcgaccgctgctggagccccagctgcagcggccccaatgcccaccccagcccccaccccccagcccagatgagcaccttctgcaagagcaccagcctgccccgggaccccctgcggcgggacaactactaccaggcccagctgcccaagacagtgggcctgcagagcgtgtatgagaaggtgctgcaccgggactatgacagaacagtgaccctgctgagcccccccaggcctggccgcctgcctgacctgcaggagattggagtgcccctgtaccagagccccccaggccgctacctgagccccaagaagggggccaatgaaaatgtgtag

SEQ ID NO: 166481 - DNA, 3213 bp, Artificial Sequence
  Description of Artificial Sequence: Synthetic coding sequence
atgagccctgtgcggcgctggggcagcccctgcctcttccccctgcagctgttcagcctgtgctgggtgctgtctgtggcccagagcaagacagtgcgctacagcacctttgaagaagatgcccctggcaccgtcatcggcaccctggccgaggacctgcacatgaaggtgtctggggacaccagcttccggctgatgaagcagttcaacagcagcctgctgcgggtgcgggagggagatggccagctgactgtgggagatgctggcctggaccgggagcggctgtgtggccaggccccccagtgtgtgctggcctttgatgtggtgtccttcagccaggagcagttccggctggtgcacgtggaggtggaggtgagagatgtgaatgaccacgccccccgcttcccccgggcccagatccctgtggaggtgtctgagggcgctgctgtgggcacccgcatccccctggaggtgcctgtggatgaagatgtgggcgccaacggcctgcagacagtgcggctggccgagccccacagccccttccgggtggagctgcagaccagggcagatggagcccagtgtgccgacctggtgctgctgcaggagctggaccgggagagccaggccgcctacagcctggagctggtggcccaggacggcggccggcccccaagaagtgccacagctgccctgtctgtgcgggtgctggatgccaatgaccacagccctgccttcccccagggcgctgtggccgaggtggagctggctgaagatgcccctgtgggcagcctgctgctggacctggatgctgctgaccctgatgagggccccaatggagatgtggtgtttgcctttggagcccggaccccacctgaggcccggcggctcttccggctggaccccaggagcggccgcctgaccctggccggccctgtggactatgaaaggcaggacacctatgagctggatgtgcgggcccaggaccggggccctggccccagggctgccacctgcaaggtgattgtgcgcatcagagatgtgaatgacaatgccccagacatcgccatcacccccctggccgcccctggggccccagccaccagcccctttgctgctgctgctgctgctgctgccctgggcggcgcagatgccagcagccctgctggggccggcaccccagaggccggggccaccagcctggtgcctgagggcgccgcccgggagagcctggtggccctggtgtccaccagtgaccgggacagcggggccaacggccaggtgcgctgtgccctgtatggccacgagcacttccggctgcagcctgcctatgccggcagctacctggtggtgacagctgccagcctggaccgggagagaattgctgagtacaacctgaccctggtggccgaggacagaggagccccacccctgaggacagtgcggccctacacagtgcgggtgggagatgaaaatgacaatgcccccctcttcaccaggcctgtgtatgaggtgtctgtgcgggagaacaaccccccaggggcctacctggccaccgtggccgcccgggaccgggacctgggcagaaatggccaggtgacctaccgcctgctggaggccgaggtgggccgggccggcggcgctgtgtccacctacgtgtctgtggaccctgccaccggggccatctatgccctgcggagctttgattatgagaccctgcggcagctggatgtgcgcatccaggccagtgatggcggcagcccccagctgagcagcagcgccctggtgcaggtgcgggtgctggaccagaatgaccacgcccctgtgctggtgcacccagccccagccaacggcagcctggaggtggccgtgcccggccgcacagccaaggacacagtggtggcccgggtgcaggccagagatgctgatgagggcgccaacggggagctggcctttgagctgcagcagcaggagccccgggaggcctttgccatcggccgcaggactggagagatcctgctgaccggggacctgagccaggagcccccaggccgggtcttccgggccctgctggtgatcagtgatggcggccggccccccctgaccaccacagccaccgtgtcctttgtggtgacagctgggggcggccggggccctgctgccccagccagcgctggcagccctgagaggagccggcccccaggcagccggctgggcgtgtctggctctgtgctgcagtgggacacccccctgattgtcatcatcgtgctggccggcagctgcaccctgctgctggccgccatcatcgccatcgccaccacctgcaacagaaggaagaaggaggtgaggaaaggaggagccctgcgggaggagaggcctggagctgctgggggcggggccagcgcccctggcagccctgaggaggccgcccggggggccggcccccggcccaacatgtttgatgtgctgaccttccctggcaccgggaaggcccccttcggcagccctgctgctgatgcccctcctcctgctgtggccgctgctgaggtgcccggcagcgagggcggcagcgccaccggggagagcgcctgccactttgagggccagcagaggctgcggggggcccacgccgagccctatggagccagccctggctttgggaaggagcccgcccctcctgtggccgtgtggaagggccacagcttcaacaccatcagcggccgggaggccgagaagttcagcggcaaggacagcgggaaaggagacagcgacttcaatgacagcgacagcgacatctctggagatgccctgaagaaggacctgatcaaccacatgcagagcggcctgtgggcctgcacagctgagtgcaagatcctgggccacagcgaccgctgctggagccccagctgcagcggccccaatgcccaccccagcccccaccccccagcccagatgagcaccttctgcaagagcaccagcctgccccgggaccccctgcggcgggacaactactaccaggcccagctgcccaagacagtgggcctgcagagcgtgtatgagaaggtgctgcaccgggactatgacagaacagtgaccctgctgagccccccccggcccggccgcctgcctgacctgcaggagattggagtgcccctgtaccagagccccccaggccgctacctgagccccaagaagggggccaatgaaaatgtgtag

SEQ ID NO: 166482 - DNA, 1791 bp, Artificial Sequence
  Description of Artificial Sequence: Synthetic coding sequence
atgagccctgtgcggcgctggggcagcccctgcctcttccccctgcagctgttcagcctgtgctgggtgctgtctgtggcccagagcaagacagtgcgctacagcacctttgaagaagatgcccctggcaccgtcatcggcaccctggccgaggacctgcacatgaaggtgtctggggacaccagcttccggctgatgaagcagttcaacagcagcctgctgcgggtgcgggagggagatggccagctgactgtgggagatgctggcctggaccgggagcggctgtgtggccaggccccccagtgtgtgctggcctttgatgtggtgtccttcagccaggagcagttccggctggtgcacgtggaggtggaggtgagagatgtgaatgaccacgcccctgtgctggtgcacccagccccagccaacggcagcctggaggtggccgtgcccggccgcacagccaaggacacagtggtggcccgggtgcaggccagagatgctgatgagggcgccaacggggagctggcctttgagctgcagcagcaggagccccgggaggcctttgccatcggccgcaggactggagagatcctgctgaccggggacctgagccaggagcccccaggccgggtcttccgggccctgctggtgatcagtgatggcggccggccccccctgaccaccacagccaccgtgtcctttgtggtgacagctgggggcggccggggccctgctgccccagccagcgctggcagccctgagaggagccggcccccaggcagccggctgggcgtgtctggctctgtgctgcagtgggacacccccctgattgtcatcatcgtgctggccggcagctgcaccctgctgctggccgccatcatcgccatcgccaccacctgcaacagaaggaagaaggaggtgaggaaaggaggagccctgcgggaggagaggcctggagctgctgggggcggggccagcgcccctggcagccctgaggaggccgcccggggggccggcccccggcccaacatgtttgatgtgctgaccttccctggcaccgggaaggcccccttcggcagccctgctgctgatgcccctcctcctgctgtggccgctgctgaggtgcccggcagcgagggcggcagcgccaccggggagagcgcctgccactttgagggccagcagaggctgcggggggcccacgccgagccctatggagccagccctggctttgggaaggagcccgcccctcctgtggccgtgtggaagggccacagcttcaacaccatcagcggccgggaggccgagaagttcagcggcaaggacagcgggaaaggagacagcgacttcaatgacagcgacagcgacatctctggagatgccctgaagaaggacctgatcaaccacatgcagagcggcctgtgggcctgcacagctgagtgcaagatcctgggccacagcgaccgctgctggagccccagctgcagcggccccaatgcccaccccagcccccaccccccagcccagatgagcaccttctgcaagagcaccagcctgccccgggaccccctgcggcgggacaactactaccaggcccagctgcccaagacagtgggcctgcagagcgtgtatgagaaggtgctgcaccgggactatgacagaacagtgaccctgctgagccccccccggcccggccgcctgcctgacctgcaggagattggagtgcccctgtaccagagccccccaggccgctacctgagccccaagaagggggccaatgaaaatgtgtag

SEQ ID NO: 166483 - DNA, 2742 bp, Artificial Sequence
  Description of Artificial Sequence: Synthetic coding sequence
atgagccctgtgcggcgctggggcagcccctgcctcttccccctgcagctgttcagcctgtgctgggtgctgtctgtggcccagagcaagacagtgcgctacagcacctttgaagaagatgcccctggcaccgtcatcggcaccctggccgaggacctgcacatgaaggtgtctggggacaccagcttccggctgatgaagcagttcaacagcagcctgctgcgggtgcgggagggagatggccagctgactgtgggagatgctggcctggaccgggagcggctgtgtggccaggccccccagtgtgtgctggcctttgatgtggtgtccttcagccaggagcagttccggctggtgcacgtggaggtggaggtgagagatgtgaatgaccacgccccccgcttcccccgggcccagatccctgtggaggtgtctgagggcgctgctgtgggcacccgcatccccctggaggtgcctgtggatgaagatgtgggcgccaacggcctgcagacagtgcggctggccgagccccacagccccttccgggtggagctgcagaccagggcagatggagcccagtgtgccgacctggtgctgctgcaggagctggaccgggagagccaggccgcctacagcctggagctggtggcccaggacggcggccggcccccaagaagtgccacagctgccctgtctgtgcgggtgctggatgccaatgaccacagccctgccttcccccagggcgctgtggccgaggtggagctggctgaagatgcccctgtgggcagcctgctgctggacctggatgctgctgaccctgatgagggccccaatggagatgtggtgtttgcctttggagcccggaccccacctgaggcccggcggctcttccggctggaccccaggagcggccgcctgaccctggccggccctgtggactatgaaaggcaggacacctatgagctggatgtgcgggcccaggaccggggccctggccccagggctgccacctgcaaggtgattgtgcgcatcagagatgtgaatgacaatgccccagacatcgccatcacccccctggccgcccctggggccggcaacctgaccctgcggagaaatggccaggtgacctaccgcctgctggaggccgaggtgggccgggccggcggcgctgtgtccacctacgtgtctgtggaccctgccactggagccatctatgccctgcggagctttgattatgagaccctgcggcagctggatgtgcgcatccaggccagtgatggcggcagcccccagctgagcagcagcgccctggtgcaggtgcgggtgctggaccagaatgaccacgcccctgtgctggtgcacccagccccagccaacggcagcctggaggtggccgtgcccggccgcacagccaaggacacagtggtggcccgggtgcaggccagagatgctgatgaaggagccaatggagagctggcctttgagctgcagcagcaggagccccgggaggcctttgccatcggcagaagaactggagagatcctgctgactggagacctgagccaggagcccccaggccgggtcttccgggccctgctggtgatcagtgatggcggccggccccccctgaccaccacagccaccgtgtcctttgtggtgacagctgggggcggccggggccctgctgccccagccagcgctggcagccctgagaggagcaggcctcctggcagccggctgggcgtgtctggctctgtgctgcagtgggacacccccctcatcgtcatcatcgtgctggccggcagctgcaccctgctgctggccgccatcatcgccatcgccaccacctgcaacagaaggaagaaggaggtgaggaagggcggggccctgcgggaggagaggcctggagctgctgggggcggggccagcgcccctggcagccctgaggaggccgcccggggagctggcccccggcccaacatgtttgatgtgctgaccttccctggcaccgggaaggcccccttcggcagccctgctgctgatgcccctcctcctgctgtggccgctgctgaggtgcccggcagcgagggcggcagcgccactggagagagcgcctgccactttgagggccagcagaggctgcggggggcccatgctgagccctacggggccagccctggctttgggaaggagcccgcccctcctgtggccgtgtggaagggccacagcttcaacaccatcagcggccgggaggccgagaagttcagcggcaaggacagcggcaagggggacagcgacttcaatgacagcgacagcgacatctctggagatgccctgaagaaggacctgatcaaccacatgcagagcggcctgtgggcctgcacagctgagtgcaagatcctgggccacagcgaccgctgctggagccccagctgcagcggccccaatgcccaccccagcccccaccccccagcccagatgagcaccttctgcaagagcaccagcctgccccgggaccccctgcggcgggacaactactaccaggcccagctgcccaagacagtgggcctgcagagcgtgtatgagaaggtgctgcaccgggactatgacagaacagtgaccctgctgagcccccccaggcctggccgcctgcctgacctgcaggagattggagtgcccctgtaccagagccccccaggccgctacctgagccccaagaagggggccaatgaaaatgtgtag

SEQ ID NO: 166484 - DNA, 3612 bp, Artificial Sequence
  Description of Artificial Sequence: Synthetic coding sequence
atggacctgcgggacttctacctgctggccgccctgattgcctgcctgcggctggacagcgccatcgcccaggagctgatctacaccatccgggaggagctgcctgaaaatgtgcccatcggcaacatccccaaggacctgaacatcagccacatcaatgctgccaccggcaccagcgccagcctggtgtaccgcctggtgtccaaggctggagatgcccccctggtgaaggtgagcagcagcactggagagatcttcaccaccagcaacagaattgaccgggagaagctgtgtgccggggccagctatgcagaggagaatgaatgcttctttgagctggaggtggtgatcctgcccaatgacttcttccgcctcatcaagatcaagatcatcgtgaaggacaccaatgacaatgcccccatgttccccagccctgtgatcaacatcagcatccctgagaacaccctcatcaacagccgcttccccatccccagcgccacagatcctgacaccggcttcaacggggtgcagcactatgagctgctgaatggccagagcgtgtttggcctggacatcgtggagaccccagagggggagaagtggccccagctgattgtgcagcagaacctggaccgggagcagaaggacacctacgtgatgaagatcaaggtggaggatggcggcaccccccagaagagcagcacagccatcctgcaggtgacagtgtctgatgtgaatgacaacagacctgtgttcaaggagggccaggtggaggtgcacatcccagaaaatgcccctgtgggcaccagcgtcatccagctgcacgccacagatgctgacatcggcagcaatgctgagatccgctacatctttggagcccaggtggccccagccaccaagaggctgtttgccctgaacaacaccaccggcctcatcaccgtgcagaggagcctggaccgggaggagacagccatccacaaggtgacagtgctggccagtgatggcagcagcaccccagcccgggccaccgtgaccatcaacgtgacagatgtgaatgacaacccccccaacatcgacctgcgctacatcatcagccccatcaatggcaccgtgtacctgtctgagaaggaccctgtgaacaccaagatcgccctgatcaccgtgtctgacaaggacacagatgtgaatggcaaggtgatctgcttcatcgagcgggaggtgcccttccacctgaaggctgtgtatgacaaccagtacctgctggagaccagcagcctgctggactatgagggcaccaaggagttctccttcaagatcgtggccagtgacagcggcaagcccagcctgaaccagacagccctggtgcgggtgaagctggaggatgaaaatgacaacccccccatcttcaaccagcccgtcatcgagctgtctgtgtctgagaacaacagaagaggcctgtacctgaccaccatcagcgccacagatgaggacagcggcaagaatgctgacatcgtgtaccagctgggccccaatgccagcttctttgacctggacaggaagacaggagtgctgacagccagccgggtgtttgaccgggaggagcaggagcgcttcatcttcaccgtgacagcccgggacaatggcaccccacccctgcagagccaggccgctgtgattgtgacagtgctggatgaaaatgacaacagccccaagttcacccacaaccacttccagttctttgtgtctgagaacctgcccaagtacagcacagtgggcgtcatcaccgtgacagatgctgatgctggggagaacaaggctgtgaccctgagcatcctgaatgacaatgacaactttgtgctggacccctacagcggggtcatcaagagcaatgtgtcctttgaccgggagcagcagagcagctacacctttgatgtgaaggccacagatggcggccagcccccaagaagcagcacagccaaggtgaccatcaacgtgatggatgtgaatgacaacagccctgtggtgatcagcccccccagcaacaccagcttcaagctggtgcccctgagcgccatccctggctctgtggtggccgaggtgtttgctgtggatgtggacaccggcatgaatgctgagctgaagtacaccatcgtgtctggcaacaacaagggcctcttcagaattgatcctgtgacaggcaacatcaccctggaggagaagccagcccccacagatgtgggcctgcaccggctggtggtgaacatcagtgacctgggctaccccaagagcctgcacaccctggtgctggtgttcctgtatgtgaatgacacagctggaaatgccagctacatctatgacctgatccggaggaccatggagacccccctggacaggaacatcggggacagcagccagccctaccagaatgaagactacctgaccatcatgattgccatcatcgccggggccatggtggtgattgtggtgatctttgtgacagtgctggtgcgctgcagacatgccagccgcttcaaggccgcccagaggagcaagcagggcgctgagtggatgagccccaaccaggagaacaagcagaacaagaagaagaagaggaagaagaggaagagccccaagagcagcctgctgaactttgtgaccatcgaggagagcaagccagatgatgctgtgcatgagcccatcaatggcaccatcagcctgcctgctgagctggaggagcagagcatcggccgctttgactggggccctgccccacccaccaccttcaagcccaacagcccagacctggccaagcactacaagagcgccagcccccagcctgccttccacctgaagccagacacccctgtgtctgtgaagaagcaccacgtgatccaggagctgcccctggacaacacctttgtgggcggctgtgacaccctgagcaagaggagcagcaccagcagtgaccacttcagcgcctctgaatgtagcagccagggcggcttcaagaccaagggccccctgcacacccggcagagccagaggagagtgaccttccacctgcctgatggcagccaggagagctgcagcgacagcggcctgggggaccacgagcctgtgggcagcggcaccctcatcagccaccccctgcccctggtgcagccccaggatgagttctatgaccaggccagcccagacaagaggacagaagcagatggcaacagcgaccccaacagtgatggccccctgggcccccggggcctggccgaggccacagagatgtgcacccaggagtgcctggtgctgggccacagcgacaactgctggatgcctcctggcctgggcccctaccagcaccccaagagccccctgagcacctttgccccccagaaggagtgggtgaagaaggacaagctggtgaatggccacaccctgacccgggcctggaaggaggacagcaacagaaaccagttcaatgacaggaagcagtatggcagcaatgaaggccacttcaacaacggcagccacatgacagacatccccctggccaacctgaagagctacaagcaggccggcggggccacagagagccccaaggagcaccagctgtag

SEQ ID NO: 166485 - DNA, 3099 bp, Artificial Sequence
  Description of Artificial Sequence: Synthetic coding sequence
atggacctgcgggacttctacctgctggccgccctgattgcctgcctgcggctggacagcgccatcgcccaggagctgatctacaccatccgggaggagctgcctgaaaatgtgcccatcggcaacatccccaaggacctgaacatcagccacatcaatgctgccaccggcaccagcgccagcctggtgtaccgcctggtgtccaaggctggagatgcccccctggtgaaggtgagcagcagcactggagagatcttcaccaccagcaacagaattgaccgggagaagctgtgtgccggggccagctatgcagaggagaatgaatgcttctttgagctggaggtggtgatcctgcccaatgacttcttccgcctcatcaagatcaagatcatcgtgaaggacaccaatgacaatgcccccatgttccccagccctgtgatcaacatcagcatccctgagaacaccctcatcaacagccgcttccccatccccagcgccacagatcctgacaccggcttcaacggggtgcagcactatgagctgctgaatggccagagcgtgtttggcctggacatcgtggagaccccagagggggagaagtggccccagctgattgtgcagcagaacctggaccgggagcagaaggacacctacgtgatgaagatcaaggtggaggatggcggcaccccccagaagagcagcacagccatcctgcaggtgacagtgtctgatgtgaatgacaacagacctgtgttcaaggagggccaggtggaggtgcacatcccagaaaatgcccctgtgggcaccagcgtcatccagctgcacgccacagatgctgacatcggcagcaatgctgagatccgctacatctttggagcccaggtggccccagccaccaagaggctgtttgccctgaacaacaccaccggcctcatcaccgtgcagaggagcctggaccgggaggagacagccatccacaaggtgacagtgctggccagtgatggcagcagcaccccagcccgggccaccgtgaccatcaacgtgacagatgtgaatgacaacccccccaacatcgacctgcgctacatcatcagccccatcaatggcaccgtgtacctgtctgagaaggaccctgtgaacaccaagatcgccctgatcaccgtgtctgacaaggacacagatgtgaatggcaaggtgatctgcttcatcgagcgggaggtgcccttccacctgaaggctgtgtatgacaaccagtacctgctggagaccagcagcctgctggactatgagggcaccaaggagttctccttcaagatcgtggccagtgacagcggcaagcccagcctgaaccagacagccctggtgcgggtgaagctggaggatgaaaatgacaacccccccatcttcaaccagcccgtcatcgagctgtctgtgtctgagaacaacagaagaggcctgtacctgaccaccatcagcgccacagatgaggacagcggcaagaatgctgacatcgtgtaccagctgggccccaatgccagcttctttgacctggacaggaagacaggagtgctgacagccagccgggtgtttgaccgggaggagcaggagcgcttcatcttcaccgtgacagcccgggacaatggcaccccacccctgcagagccaggccgctgtgattgtgacagtgctggatgaaaatgacaacagccccaagttcacccacaaccacttccagttctttgtgtctgagaacctgcccaagtacagcacagtgggcgtcatcaccgtgacagatgctgatgctggggagaacaaggctgtgaccctgagcatcctgaatgacaatgacaactttgtgctggacccctacagcggggtcatcaagagcaatgtgtcctttgaccgggagcagcagagcagctacacctttgatgtgaaggccacagatggcggccagcccccaagaagcagcacagccaaggtgaccatcaacgtgatggatgtgaatgacaacagccctgtggtgatcagcccccccagcaacaccagcttcaagctggtgcccctgagcgccatccctggctctgtggtggccgaggtgtttgctgtggatgtggacaccggcatgaatgctgagctgaagtacaccatcgtgtctggcaacaacaagggcctcttcagaattgatcctgtgacaggcaacatcaccctggaggagaagccagcccccacagatgtgggcctgcaccggctggtggtgaacatcagtgacctgggctaccccaagagcctgcacaccctggtgctggtgttcctgtatgtgaatgacacagctggaaatgccagctacatctatgacctgatccggaggaccatggagacccccctggacaggaacatcggggacagcagccagccctaccagaatgaagactacctgaccatcatgattgccatcatcgccggggccatggtggtgattgtggtgatctttgtgacagtgctggtgcgctgcagacatgccagccgcttcaaggccgcccagaggagcaagcagggcgctgagtggatgagccccaaccaggagaacaagcagaacaagaagaagaagaggaagaagaggaagagccccaagagcagcctgctgaactttgtgaccatcgaggagagcaagccagatgatgctgtgcatgagcccatcaatggcaccatcagcctgcctgctgagctggaggagcagagcatcggccgctttgactggggccctgccccacccaccaccttcaagcccaacagcccagacctggccaagcactacaagagcgccagcccccagcctgccttccacctgaagccagacacccctgtgtctgtgaagaagcaccacgtgatccaggagctgcccctggacaacacctttgtgggcggctgtgacaccctgagcaagaggagcagcaccagcagtgaccacttcagcgcctctgaatgtagcagccagggcggcttcaagaccaagggccccctgcacacccggcaggtgaatgagcacttctactggagcatcagcacagcctacaagtgccctgtgaaccagtactag

SEQ ID NO: 166486 - DNA, 3714 bp, Artificial Sequence
  Description of Artificial Sequence: Synthetic coding sequence
atggacctgcgggacttctacctgctggccgccctgattgcctgcctgcggctggacagcgccatcgcccaggagctgatctacaccatccgggaggagctgcctgaaaatgtgcccatcggcaacatccccaaggacctgaacatcagccacatcaatgctgccaccggcaccagcgccagcctggtgtaccgcctggtgtccaaggctggagatgcccccctggtgaaggtgagcagcagcactggagagatcttcaccaccagcaacagaattgaccgggagaagctgtgtgccggggccagctatgcagaggagaatgaatgcttctttgagctggaggtggtgatcctgcccaatgacttcttccgcctcatcaagatcaagatcatcgtgaaggacaccaatgacaatgcccccatgttccccagccctgtgatcaacatcagcatccctgagaacaccctcatcaacagccgcttccccatccccagcgccacagatcctgacaccggcttcaacggggtgcagcactatgagctgctgaatggccagagcgtgtttggcctggacatcgtggagaccccagagggggagaagtggccccagctgattgtgcagcagaacctggaccgggagcagaaggacacctacgtgatgaagatcaaggtggaggatggcggcaccccccagaagagcagcacagccatcctgcaggtgacagtgtctgatgtgaatgacaacagacctgtgttcaaggagggccaggtggaggtgcacatcccagaaaatgcccctgtgggcaccagcgtcatccagctgcacgccacagatgctgacatcggcagcaatgctgagatccgctacatctttggagcccaggtggccccagccaccaagaggctgtttgccctgaacaacaccaccggcctcatcaccgtgcagaggagcctggaccgggaggagacagccatccacaaggtgacagtgctggccagtgatggcagcagcaccccagcccgggccaccgtgaccatcaacgtgacagatgtgaatgacaacccccccaacatcgacctgcgctacatcatcagccccatcaatggcaccgtgtacctgtctgagaaggaccctgtgaacaccaagatcgccctgatcaccgtgtctgacaaggacacagatgtgaatggcaaggtgatctgcttcatcgagcgggaggtgcccttccacctgaaggctgtgtatgacaaccagtacctgctggagaccagcagcctgctggactatgagggcaccaaggagttctccttcaagatcgtggccagtgacagcggcaagcccagcctgaaccagacagccctggtgcgggtgaagctggaggatgaaaatgacaacccccccatcttcaaccagcccgtcatcgagctgtctgtgtctgagaacaacagaagaggcctgtacctgaccaccatcagcgccacagatgaggacagcggcaagaatgctgacatcgtgtaccagctgggccccaatgccagcttctttgacctggacaggaagacaggagtgctgacagccagccgggtgtttgaccgggaggagcaggagcgcttcatcttcaccgtgacagcccgggacaatggcaccccacccctgcagagccaggccgctgtgattgtgacagtgctggatgaaaatgacaacagccccaagttcacccacaaccacttccagttctttgtgtctgagaacctgcccaagtacagcacagtgggcgtcatcaccgtgacagatgctgatgctggggagaacaaggctgtgaccctgagcatcctgaatgacaatgacaactttgtgctggacccctacagcggggtcatcaagagcaatgtgtcctttgaccgggagcagcagagcagctacacctttgatgtgaaggccacagatggcggccagcccccaagaagcagcacagccaaggtgaccatcaacgtgatggatgtgaatgacaacagccctgtggtgatcagcccccccagcaacaccagcttcaagctggtgcccctgagcgccatccctggctctgtggtggccgaggtgtttgctgtggatgtggacaccggcatgaatgctgagctgaagtacaccatcgtgtctggcaacaacaagggcctcttcagaattgatcctgtgacaggcaacatcaccctggaggagaagccagcccccacagatgtgggcctgcaccggctggtggtgaacatcagtgacctgggctaccccaagagcctgcacaccctggtgctggtgttcctgtatgtgaatgacacagctggaaatgccagctacatctatgacctgatccggaggaccatggagacccccctggacaggaacatcggggacagcagccagccctaccagaatgaagactacctgaccatcatgattgccatcatcgccggggccatggtggtgattgtggtgatctttgtgacagtgctggtgcgctgcagacatgccagccgcttcaaggccgcccagaggagcaagcagggcgctgagtggatgagccccaaccaggagaacaagcagaacaagaagaagaagaggaagaagaggaagagccccaagagcagcctgctgaactttgtgaccatcgaggagagcaagccagatgatgctgtgcatgagcccatcaatggcaccatcagcctgcctgctgagctggaggagcagagcatcggccgctttgactggggccctgccccacccaccaccttcaagcccaacagcccagacctggccaagcactacaagagcgccagcccccagcctgccttccacctgaagccagacacccctgtgtctgtgaagaagcaccacgtgatccaggagctgcccctggacaacacctttgtgggcggctgtgacaccctgagcaagaggagcagcaccagcagtgaccacttcagcgcctctgaatgtagcagccagggcggcttcaagaccaagggccccctgcacacccggcagtgcaacagccacagcaagagtgacaacatccctgtgaccccccagaagtgccccagcagcacaggcttccacatccaggagaatgaggagagccactatgagagccagaggagagtgaccttccacctgcctgatggcagccaggagagctgcagcgacagcggcctgggggaccacgagcctgtgggcagcggcaccctcatcagccaccccctgcccctggtgcagccccaggatgagttctatgaccaggccagcccagacaagaggacagaagcagatggcaacagcgaccccaacagtgatggccccctgggcccccggggcctggccgaggccacagagatgtgcacccaggagtgcctggtgctgggccacagcgacaactgctggatgcctcctggcctgggcccctaccagcaccccaagagccccctgagcacctttgccccccagaaggagtgggtgaagaaggacaagctggtgaatggccacaccctgacccgggcctggaaggaggacagcaacagaaaccagttcaatgacaggaagcagtatggcagcaatgaaggccacttcaacaacggcagccacatgacagacatccccctggccaacctgaagagctacaagcaggccggcggggccacagagagccccaaggagcaccagctgtag

SEQ ID NO: 166487 - DNA, 3612 bp, Artificial Sequence; identical to SEQ ID NO: 166484
  Description of Artificial Sequence: Synthetic coding sequence

SEQ ID NO: 166488 - DNA, 3714 bp, Artificial Sequence; identical to SEQ ID NO: 166486
  Description of Artificial Sequence: Synthetic coding sequence

SEQ ID NO: 166489 - DNA, 2424 bp, Artificial Sequence
  Description of Artificial Sequence: Synthetic coding sequence
atggtgttcagcagaagaggaggcctgggcgcccgggacctgctgctgtggctgctgctgctggccgcctgggaggtgggcagcggccagctgcactacagcatccctgaggaggccaagcacggcacctttgtgggccgggtggcccaggacctgggcctggagctggccgagctggtgcccaggctcttccgggtggccagcaagacccaccgggacctgctggaggtgaacctgcagaatggcatcctgtttgtgaacagcagaattgaccgggaggagctgtgccagtggagcgcagaatgttccatccacctggagctgattgctgaccggcccctgcaggtgttccacgtggaggtgaaggtgaaggacatcaatgacaacccccctgtgttccggggccgggagcagatcatcttcatccctgagagccggctgctgaacagccgcttccccatcgagggcgctgctgatgctgacatcggggccaatgccctgctgacctacaccctgagccccagcgactacttcagcctggatgtggaggccagtgatgagctgagcaagagcctgtggctggagctgaggaagtacctggaccgggaggagaccccagagctgcacctgctgctgacagccacagatggcggcaagccagagctgcagggcaccgtggagctgctgatcaccgtgctggatgtgaatgacaatgcccccctgtttgaccaggccgtgtacagagtgcacctgctggagaccacagccaacggcaccctggtgaccaccctgaatgccagtgatgctgatgagggcgtgaatggagaggtggtgttctcctttgattctggcatcagccgggacatccaggagaagttcaaggtggacagcagcagtggagagatccggctgattgacaagctggactatgaggagaccaagagctatgagatccaggtgaaggctgtggacaagggcagcccccccatgagcaaccactgcaaggtgctggtgaaggtgctggatgtgaatgacaatgcccctgagctggccgtgaccagcctgtacctgcccatcagagaagatgcccccctgagcacagtgattgccctgatcaccgtgtctgaccgggacagcggggccaacggccaggtgacctgcagcctgatgccccacgtgcccttcaagctggtgtccaccttcaagaactactacagcctggtgctggacagcgccctggaccgggagagcctgtctgtgtatgagctggtggtgacagccagagatggcggcagccccagcctgtgggccacagcccgggtgtctgtggaggtggctgatgtgaatgacaatgccccagcctttgcccagcctgagtacacagtgtttgtgaaggagaacaaccccccaggctgccacatcttcaccgtgtctgccagagatgctgatgcccaggagaatgccctggtgtcctacagcctggtggagaggagagtgggggagcgggccctgagcaactacgtgtctgtgcacgccgagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctggccccccgggtgggcggcaccatcggggctgtgtctgagctggtgccccggctggtgggcgccggccacgtggtggccaaggtgcgggctgtggatgctgacagcggctacaatgcctggctgtcctatgagctgcagcctgctgctggaggagcccgcatccccttccgggtgggcctgtacaccggggagatcagcaccaccagggtgctggatgaggccgacctgagccgctaccgcctgctggtgctggtgaaggaccacggggagcccgccctgacagccacagccaccgtgctggtgtccctggtggagagcggccaggcccccaaggccagcagccgggcctctgtgggcgtggccggccctgaggccgccctggtggatgtgaatgtgtacctgatcatcgccatctgtgctgtgagcagcctgctggtgctgaccctgctgctgtacacagccctgcgctgcagcgtgcccccaacagagggcgcctacgtgcctgggaagcccaccctggtgtgcagcagcgccctgggctcctggagcaacagccagcagaggcggcagagggtgtgcagcagcgagggcccccccaagacagacctgatggccttcagccctggcctgagccccagcctgaacaccagcgagagaaatgagcagcctgaggccaacctggacctgtctggaaatgtgagccccacctttgagttctggctgtag

SEQ ID NO: 166490 - DNA, 2061 bp, Artificial Sequence
  Description of Artificial Sequence: Synthetic coding sequence
atggtgttcagcagaagaggaggcctgggcgcccgggacctgctgctgtggctgctgctgctggccgcctgggaggtgggcagcggccagctgcactacagcatccctgaggaggccaagcacggcacctttgtgggccgggtggcccaggacctgggcctggagctggccgagctggtgcccaggctcttccgggtggccagcaagacccaccgggacctgctggaggtgaacctgcagaatggcatcctgtttgtgaacagcagaattgaccgggaggagctgtgccagtggagcgcagaatgttccatccacctggagctgattgctgaccggcccctgcaggtgttccacgtggaggtgaaggtgaaggacatcaatgacaacccccctgtgttccggggccgggagcagatcatcttcatccctgagagccggctgctgaacagccgcttccccatcgagggcgctgctgatgctgacatcggggccaatgccctgctgacctacaccctgagccccagcgactacttcagcctggatgtggaggccagtgatgagctgagcaagagcctgtggctggagctgaggaagtacctggaccgggaggagaccccagagctgcacctgctgctgacagccacagatggcggcaagccagagctgcagggcaccgtggagctgctgatcaccgtgctggatgtgaatgacaatgcccccctgtttgaccaggccgtgtacagagtgcacctgctggagaccacagccaacggcaccctggtgaccaccctgaatgccagtgatgctgatgagggcgtgaatggagaggtggtgttctcctttgattctggcatcagccgggacatccaggagaagttcaaggtggacagcagcagtggagagatccggctgattgacaagctggactatgaggagaccaagagctatgagatccaggtgaaggctgtggacaagggcagcccccccatgagcaaccactgcaaggtgctggtgaaggtgctggatgtgaatgacaatgcccctgagctggccgtgaccagcctgtacctgcccatcagagaagatgcccccctgagcacagtgattgccctgatcaccgtgtctgaccgggacagcggggccaacggccaggtgacctgcagcctgatgccccacgtgcccttcaagctggtgtccaccttcaagaactactacagcctggtgctggacagcgccctggaccgggagagcctgtctgtgtatgagctggtggtgacagccagagatggcggcagccccagcctgtgggccacagcccgggtgtctgtggaggtggctgatgtgaatgacaatgccccagcctttgcccagcctgagtacacagtgtttgtgaaggagaacaaccccccaggctgccacatcttcaccgtgtctgccagagatgctgatgcccaggagaatgccctggtgtcctacagcctggtggagaggagagtgggggagcgggccctgagcaactacgtgtctgtgcacgccgagagcggcaaggtgtatgccctgcagcccctggaccacgaggagctggagctgctgcagttccagccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166491 - DNA, 2853 bp, Artificial Sequence
  Description of Artificial Sequence: Synthetic coding sequence
atggtgttcagcagaagaggaggcctgggcgcccgggacctgctgctgtggctgctgctgctggccgcctgggaggtgggcagcggccagctgcactacagcatccctgaggaggccaagcacggcacctttgtgggccgggtggcccaggacctgggcctggagctggccgagctggtgcccaggctcttccgggtggccagcaagacccaccgggacctgctggaggtgaacctgcagaatggcatcctgtttgtgaacagcagaattgaccgggaggagctgtgccagtggagcgcagaatgttccatccacctggagctgattgctgaccggcccctgcaggtgttccacgtggaggtgaaggtgaaggacatcaatgacaacccccctgtgttccggggccgggagcagatcatcttcatccctgagagccggctgctgaacagccgcttccccatcgagggcgctgctgatgctgacatcggggccaatgccctgctgacctacaccctgagccccagcgactacttcagcctggatgtggaggccagtgatgagctgagcaagagcctgtggctggagctgaggaagtacctggaccgggaggagaccccagagctgcacctgctgctgacagccacagatggcggcaagccagagctgcagggcaccgtggagctgctgatcaccgtgctggatgtgaatgacaatgcccccctgtttgaccaggccgtgtacagagtgcacctgctggagaccacagccaacggcaccctggtgaccaccctgaatgccagtgatgctgatgagggcgtgaatggagaggtggtgttctcctttgattctggcatcagccgggacatccaggagaagttcaaggtggacagcagcagtggagagatccggctgattgacaagctggactatgaggagaccaagagctatgagatccaggtgaaggctgtggacaagggcagcccccccatgagcaaccactgcaaggtgctggtgaaggtgctggatgtgaatgacaatgcccctgagctggccgtgaccagcctgtacctgcccatcagagaagatgcccccctgagcacagtgattgccctgatcaccgtgtctgaccgggacagcggggccaacggccaggtgacctgcagcctgatgccccacgtgcccttcaagctggtgtccaccttcaagaactactacagcctggtgctggacagcgccctggaccgggagagcctgtctgtgtatgagctggtggtgacagccagagatggcggcagccccagcctgtgggccacagcccgggtgtctgtggaggtggctgatgtgaatgacaatgccccagcctttgcccagcctgagtacacagtgtttgtgaaggagaacaaccccccaggctgccacatcttcaccgtgtctgccagagatgctgatgcccaggagaatgccctggtgtcctacagcctggtggagaggagagtgggggagcgggccctgagcaactacgtgtctgtgcacgccgagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctggccccccgggtgggcggcaccatcggggctgtgtctgagctggtgccccggctggtgggcgccggccacgtggtggccaaggtgcgggctgtggatgctgacagcggctacaatgcctggctgtcctatgagctgcagcctgctgctggaggagcccgcatccccttccgggtgggcctgtacaccggggagatcagcaccaccagggtgctggatgaggccgacctgagccgctaccgcctgctggtgctggtgaaggaccacggggagcccgccctgacagccacagccaccgtgctggtgtccctggtggagagcggccaggcccccaaggccagcagccgggcctctgtgggcgtggccggccctgaggccgccctggtggatgtgaatgtgtacctgatcatcgccatctgtgctgtgagcagcctgctggtgctgaccctgctgctgtacacagccctgcgctgcagcgtgcccccaacagagggcgcctacgtgcctgggaagcccaccctggtgtgcagcagcgccctgggctcctggagcaacagccagcagaggcggcagagggtgtgcagcagcgagggcccccccaagacagacctgatggccttcagccctggcctgagccccagcctgaacaccagcgagagaaatgagcagcctgaggccaacctggacctgagcggcaacccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166492 - DNA, 2847 bp, Artificial Sequence
  Description of Artificial Sequence: Synthetic coding sequence
atggtgagccgctgcagctgcctgggcgtgcagtgcctgctgctgagcctgctgctgctggccgcctgggaggtgggcagcggccagctgcactacagcgtgtatgaggaggcccggcacggcacctttgtgggcagaattgcccaggacctgggcctggagctggccgagctggtgcagaggctcttccgggtggccagcaagagacatggagacctgctggaggtgaacctgcagaatggcatcctgtttgtgaacagcagaattgaccgggaggagctgtgtggccgctctgtggagtgcagcatccacctggaggtgattgtggaccggcccctgcaggtgttccacgtggatgtggaggtgaaggacatcaatgacaaccccccacgcttctctgtgacagagcagaagctgagcatccctgagagccggctgctggacagccgcttccccctggagggcgccagtgatgctgatgtgggagaaaatgccctgctgacctacaagctgagccccaatgagtactttgtgctggacatcatcaacaagaaggacaaggacaagtttcctgtgctggtgctgaggaagctgctggaccgggaggagaacccccagctgaagctgctgctgacagccacagatggcggcaagccagagttcaccggctctgtgtccctgctgatcctggtgctggatgccaatgacaatgcccccatctttgacaggcctgtgtatgaggtgaagatgtatgagaaccaggtgaaccagaccctggtgatccggctgaatgccagtgacagtgatgagggcatcaacaaggagatgatgtacagcttcagcagcctggtgccccccaccatccggaggaagttctggatcaatgaaagaactggagagatcaaggtgaatgatgccatcgactttgaggacagcaacacctatgagatccacgtggatgtgacagacaagggcaacccccccatggtgggccactgcaccgtgctggtggagctgctggatgaaaatgacaacagccctgaggtgattgtgaccagcctgagcctgcctgtgaaggaggatgcccaggtgggcaccgtcatcgccctgatctctgtgtctgaccatgacagcggggccaacggccaggtgacctgcagcctgacccctcatgtgcccttcaagctggtgtccacctacaagaactactacagcctggtgctggacagcgccctggaccgggagcgggtgtctgcctatgagctggtggtgacagccagagatggcggcagcccccccctgtgggccacagcctctgtgtctgtggaggtggctgatgtgaatgacaatgccccagcctttgcccagagcgagtacacagtgtttgtgaaggagaacaaccccccaggctgccacatcttcaccgtgtctgcctgggatgctgatgcccaggagaatgccctggtgtcctacagcctggtggagcggcggctgggggagaggagcctgagcagctatgtgtctgtgcatgctgagagcggcaaggtgtatgccctgcagcccctggaccacgaggagctggagctgctgcagttccaggtgtctgccagagatggcggcgtgccccccctgggcagcaacctgaccctgcaggtgtttgtgctggatgaaaatgacaatgccccagccctgctggccagccctgctggcagcgctgggggcgctgtgtctgagctggtgctgcggtctgtggtggccggccacgtggtggccaaggtgcgggctgtggatgctgacagcggctacaatgcctggctgtcctatgagctgcagagcgctgctgtgggcgcccgcatccccttccgggtgggcctgtacacaggagagatcagcaccacccgggccctggatgaaacagacagcccccggcagaggctgctggtgctggtgaaggaccatggagagcccagcctgacagccacagccaccgtgctggtgtccctggtggagggcagccaggcccccaaggccagcagccgggcctctgtgggcgtggcccctgaggtggccctggtggatgtgaatgtgtacctgatcatcgccatctgtgctgtgagcagcctgctggtgctgaccctgctgctgtacacagccctgcgctgcagcgctgcccccacagagggcgcctgtggccctgtgaagcccaccctggtgtgcagcagcgctgtgggctcctggagctacagccagcagaggcggcagagggtgtgcagcggggagggcctgcccaaggctgacctgatggccttcagccccagcctgcccccctgccccatggtggatgtggatggagaggaccagagcattggaggagaccacagcaggaagccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166493 - DNA, 2058 bp, Artificial Sequence
  Description of Artificial Sequence: Synthetic coding sequence
atggtgagccgctgcagctgcctgggcgtgcagtgcctgctgctgagcctgctgctgctggccgcctgggaggtgggcagcggccagctgcactacagcgtgtatgaggaggcccggcacggcacctttgtgggcagaattgcccaggacctgggcctggagctggccgagctggtgcagaggctcttccgggtggccagcaagagacatggagacctgctggaggtgaacctgcagaatggcatcctgtttgtgaacagcagaattgaccgggaggagctgtgtggccgctctgtggagtgcagcatccacctggaggtgattgtggaccggcccctgcaggtgttccacgtggatgtggaggtgaaggacatcaatgacaaccccccacgcttctctgtgacagagcagaagctgagcatccctgagagccggctgctggacagccgcttccccctggagggcgccagtgatgctgatgtgggagaaaatgccctgctgacctacaagctgagccccaatgagtactttgtgctggacatcatcaacaagaaggacaaggacaagtttcctgtgctggtgctgaggaagctgctggaccgggaggagaacccccagctgaagctgctgctgacagccacagatggcggcaagccagagttcaccggctctgtgtccctgctgatcctggtgctggatgccaatgacaatgcccccatctttgacaggcctgtgtatgaggtgaagatgtatgagaaccaggtgaaccagaccctggtgatccggctgaatgccagtgacagtgatgagggcatcaacaaggagatgatgtacagcttcagcagcctggtgccccccaccatccggaggaagttctggatcaatgaaagaactggagagatcaaggtgaatgatgccatcgactttgaggacagcaacacctatgagatccacgtggatgtgacagacaagggcaacccccccatggtgggccactgcaccgtgctggtggagctgctggatgaaaatgacaacagccctgaggtgattgtgaccagcctgagcctgcctgtgaaggaggatgcccaggtgggcaccgtcatcgccctgatctctgtgtctgaccatgacagcggggccaacggccaggtgacctgcagcctgacccctcatgtgcccttcaagctggtgtccacctacaagaactactacagcctggtgctggacagcgccctggaccgggagcgggtgtctgcctatgagctggtggtgacagccagagatggcggcagcccccccctgtgggccacagcctctgtgtctgtggaggtggctgatgtgaatgacaatgccccagcctttgcccagagcgagtacacagtgtttgtgaaggagaacaaccccccaggctgccacatcttcaccgtgtctgcctgggatgctgatgcccaggagaatgccctggtgtcctacagcctggtggagcggcggctgggggagaggagcctgagcagctatgtgtctgtgcatgctgagagcggcaaggtgtatgccctgcagcccctggaccacgaggagctggagctgctgcagttccagccccggcagcccaacccagactggagatacagcgccagcctgcgggccggcatgcacagctctgtgcacctggaggaggccggcatcctgcgggccggccctgggggccctgaccagcagtggcccaccgtgtcctctgccaccccagagcctgaggccggggaggtgtccccacctgtgggcgccggcgtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166494 - DNA, 2850 bp, Artificial Sequence
  Description of Artificial Sequence: Synthetic coding sequence
atgtttggcttccagaggcggggcctgggcaccccccggctgcagctgtggctgctgctgctggagttctgggaggtgggcagcggccagctgcactacagcgtgtctgaggaggccaagcacggcacctttgtgggccgcatcgcccaggacctgggcctggagctggccgagctggtgcagaggctcttccgggtggccagcaagacccatggagacctgctggaggtgaacctgcagaatggcatcctgtttgtgaacagcagaattgaccgggaggagctgtgtggccagagcgcagaatgttccatccacctggaggtgattgtggaccggcccctgcaggtgttccacgtgaatgtggaggtgaaggacatcaatgacaacccccctgtgttcagcctgcgggagcagaagctgctgattgctgagagcaagcagagcgacagccgcttccccctggagggcgccagtgatgctgacatcgaggagaatgccctgctgacctaccgcctgagcaagaatgagtacttcagcctggacagccccaccaacgggaagcagatcaagaggctgagcctcatcctgaagaagagcctggaccgggagaagaccccagagctgaacctgctgctgacagccacagatggcggcaagccagagctgactggaacagtgcggctgctggtgcaggtgctggatgtgaatgacaatgaccctgagtttgacaagtctgagtacaaggtgtccctgatggagaatgctgccaaggagaccctggtgctgaagctgaatgccacagacagagatgagggcgtgaatggagaggtgacctacagcctgatgagcatcaagcccaacggccgccacctgttcaccctggaccagaacaacggggaggtgcgggtgaatggcaccctggactatgaggagaacaagttctacaagattgaggtgcaggccacagacaagggcaccccacccatggccggccactgcaccgtgtgggtggagatcctggacaccaatgacaacagccctgaggtggccgtgaccagcctgagcctgcctgtgcgggaggatgcccagcccagcaccgtcatcgccctgatctctgtgtctgaccgggacagcggcgtgaatggccaggtgacctgcagcctgacccctcatgtgcccttcaagctggtgtccaccttcaagaactactacagcctggtgctggacagcgccctggacagagaaaatgtgtgggcctatgagctggtggtgacagccagagatggcggcagccccagcctgtgggccacagcccgggtgtctgtggaggtggctgatgtgaatgacaatgccccagcctttgcccagcctgagtacacagtgtttgtgaaggagaacaaccccccaggctgccacatcttcaccgtgtctgccagagatgctgatgcccaggagaatgccctggtgtcctacagcctggtggagcggcggctgggggaccgggccctgagcagctatgtgtctgtgcatgctgagagcggcaaggtgtatgccctgcagcccctggaccacgaggagctggagctgctgcagttccaggtgtctgccagagatgctggggtgccccccctgagcagcaatgtgaccctgcaggtgtttgtgctggatgaaaatgacaatgccccagccctgctggccacccaggccggcagcgctgggggcgctgtgaacaagctggtgcccaggtctgtgggcgccggccacgtggtggccaaggtgcgggctgtggatgctgacagcggctacaatgcctggctgtcctatgagctgcagcctgctgctgggggcagccgcatccccttccgggtgggcctgtacacaggagagatcagcaccacccgggccctggatgaagctgacagccccaggcaccggctgctggtgctggtgaaggaccatggagagcccgccctgacagccacagccaccgtgctggtgtccctggtggagagcggccaggcccccaaggccagcagcaggaccctggccggggccgccagccctgaggccgccctggtggatgtgaatgtgtacctgatcatcgccatctgtgtggtgagcagcctgctggtgctgaccctgctgctgtacacagccctgtggtggagcgccacccccacagaaggagcctgtgcccctgggaagcccaccctggtgtgcagcagagctgtgggctcctggagctacagccagcagaggcggcagagggtgtgcagcgaggagggcccccccaagacagacctgatggccttcagccccagcctgcccctgggcctgaacaaggaggaggagggggagcggcaggagcccggcagcaaccaccctggccagccccggcagcccaacccagactggagatacagcgccagcctgcgggccggcatgcacagctctgtgcacctggaggaggccggcatcctgcgggccggccctgggggccctgaccagcagtggcccaccgtgtcctctgccaccccagagcctgaggccggggaggtgtccccacctgtgggcgccggcgtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166495 - DNA, 2826 bp, Artificial Sequence
  Description of Artificial Sequence: Synthetic coding sequence
atggtgatcatcggcccccggggccctggcagccagaggctgctgctgagcctgctgctgctggccgcctgggaggtgggcagcggccagctgcactacagcgtgtatgaggaggccaagcacggcacctttgtgggccgcatcgcccaggacctgggcctggagctggccgagctggtgcccaggctcttccgggtggccagcaagagacatggagacctgctggaggtgaacctgcagaatggcatcctgtttgtgaacagcagaattgaccgggagaagctgtgtggccgctctgcagaatgttccatccacctggaggtgattgtggaccggcccctgcaggtgttccacgtggatgtggaggtgaaggacatcaatgacaacccccctgtgttccgggagcgggagcagaaggtgcctgtgtctgagagcgcccccctggacagccacttccccctggagggcgccagtgatgctgacatcggcgtgaacagcctgctgacctacgccctgagcctgaatgaaaattttgagctgaagatcaagaccaagaaggacaagagcatcctgcctgagctggtgctgaggaagctgctggaccgggagcagacccccaagctgaacctgctgctgatggtgattgatggcggcaagccagagctgactggatctgtgcagatccagatcaccgtgctggatgtgaatgacaatggacctgcctttgacaagcccagctacaaggtggtgctgtctgaaaatgtgcagaatgacaccagggtcatccagctgaatgccagtgaccctgatgagggcctgaatggagagatctcctatggcatcaagatgatcctgcctgtgtctgagaagtgcatgttcagcatcaacccagacacaggagagatccgcatctatggagagctggactttgaggagaacaatgcctatgagatccaggtgaatgccatcgacaagggcatccccagcatggccggccacagcatggtgctggtggaggtgctggatgtgaatgacaacgtgcctgaggtgatggtgaccagcctgagcctgcctgtgcaggaggatgcccaggtgggcaccgtgattgccctgatctctgtgtctgaccgggacagcggggccaacggccaggtgatctgcagcctgaccccccacgtgcccttcaagctggtgtccacctacaagaactactacagcctggtgctggacagcgccctggaccgggagagcgtgtctgcctatgagctggtggtgacagccagagatggcggcagccccagcctgtgggccacagcccgggtgtctgtggaggtggctgatgtgaatgacaatgccccagcctttgcccagcctgagtacacagtgtttgtgaaggagaacaaccccccaggctgccacatcttcaccgtgtctgcctgggatgctgatgcccagaagaatgccctggtgtcctacagcctggtggagaggagagtgggggagcacgccctgagcagctatgtgtctgtgcacgccgagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctggccaccccagctggcagcgctggaggagctgtgtctgagctggtgcccaggtctgtgggcgccggccacgtggtggccaaggtgcgggctgtggatgctgacagcggctacaatgcctggctgtcctatgagctgcagcctgctgctgtgggcgcccacatccccttccacgtgggcctgtacaccggggagatcagcaccacccgcatcctggatgaagcagatgcccccaggcaccggctgctggtgctggtgaaggaccacggggagcccgccctgaccagcacagccaccgtgctggtgtccctggtggagaatggccaggcccccaagaccagcagccgggcctctgtgggcgctgtggaccctgaggccgccctggtggacatcaacgtgtacctgatcatcgccatctgtgctgtgagcagcctgctggtgctgaccctgctgctgtacacagccctgcgctgcagcgccccacccaccgtgagccgctgtgcccctgggaagcccaccctggtgtgcagcagcgctgtgggctcctggagctacagccagcagaggcggcagagggtgtgcagcgctgagagcccccccaagacagacctgatggccttcagccccagcctgcagctgagccgggaggactgcctgaacccccccagcgagccccggcagcccaacccagactggagatacagcgccagcctgcgggccggcatgcacagctctgtgcacctggaggaggccggcatcctgcgggccggccctgggggccctgaccagcagtggcccaccgtgtcctctgccaccccagagcctgaggccggggaggtgtccccacctgtgggcgccggcgtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166496 - DNA, 2853 bp, Artificial Sequence
  Description of Artificial Sequence: Synthetic coding sequence
atgctgagctcctggcagggcggcccccggccccggcagctgctgctgtggctgctgatcctggccgcctgggagaccggcagcggccagctgcactacagcgtgcctgaggaggccaagcacggcacctttgtgggccgcatcgcccaggacctgggcctggagctggccgagctggtgcccaggctcttccgggtggccagcaagagacatggagacctgctggaggtgaacctgcagaatggcatcctgtttgtgaacagcagaattgaccgggaggagctgtgtggccgctctgcagaatgttccatccacctggaggtgattgtggaccggcccctgcaggtgttccacgtggaggtgaaggtgcgggacatcaatgacaacccccccatcttccctgagagcaagaagaggatcatcatcgccgagagcaggcctcctgagacccgcttccccctggatggagccagtgatgctgacatcggcgtgaacagcgccctgacctaccgcctggaccccaatgactacttcaccctggatgcccagaacagcctggagcagatgagcagcctgagcctggtgctgaggaagaccctggaccgggaggagatccaggagcacagcctgctgctgacagccagtgatggcggcaagccagagctgactggaacagtgcagctgctgatcaccatcctggatgtgaatgacaatgcccctgagttctaccagagcgtgtacaaggtgacagtgctggagaatgccttcaacggcaccctggtgatcaagctgaatgccacagatcctgatgatggcaccaacggggacatcgtgtacagcttccggcggcctgtgtggccagctgtggtgtatgccttcaccatcaaccccaacaatggagagatccgcaccaagggcaagctggactttgaggagaagaagctgtatgagatctctgtggaggccgtggacaagggcaacatccccatggccggccactgcaccctgctggtggaggtgctggatgtgaatgacaatgcccctgaggtgaccatcaccagcctgagcctgcccatccgggaggacacccagcccagcgccatcatcgccctgatctctgtgtctgaccgggacagcggcagcaatggccaggtgacctgcaccctgaccccccacgtgcccttcaagctggtgtccacctacaagaactactacagcctggtgctggacagcgccctggaccgggagagcgtgtctgcctatgagctggtggtgacagccagagatggcggcagccccagcctgtgggccacagcctctgtgtctgtgggcgtggctgatgtgaatgacaatgccccagcctttgcccagcctgagtacacagtgtttgtgaaggagaacaaccccccaggctgccacatcttcaccgtgtctgcccaggatgctgatgcccaggagaatgccctggtgtcctacagcctggtggagaggagagtgggggagcgggccctgagcagctatgtgtctgtgcacgccgagagcggcaaggtgtatgccctgcagcccctggaccacgaggagctggagctgctgcagttccaggtgtctgcccgggacagcggcgtgccccccctgggcagcaatgtgaccctgcaggtgtttgtgctggatgaaaatgacaatgccccagccctgctgacccctggggccggcagcgctgggggcaccgtgtctgagctgatgcccaggtctgtgggcgccggccacgtggtggccaaggtgcgggctgtggatgctgacagcggctacaatgcctggctgtcctatgagctgcagctggccgctgtgggcgcccgcatccccttccgggtgggcctgtacaccggggagatcagcaccacccggcccctggatgaggtggatgccccccaccaccggctgctggtgctggtgaaggaccacggggagcccgccctgacagccacagccaccgtgctgctgagcctggtggagagcggccaggccccccaggccagcagccgggccagcgctggagctgtgggccctgaggccgccctggtggatgtgaatgtgtacctgatcatcgccatctgtgctgtgagcagcctgctggtgctgaccctgctgctgtacacagccctgcgctgcagcgccccacccacagagggcgcctgtgcccctgggaagcccaccctggtgtgcagcagcgctgctggctcctggagctacagccagcagaggcggccccgggtgtgcagcggggagggcccccacaagacagacctgatggccttcagccccagcctgcccccctgcctgggcagcgctgagggcaccggccagcgggaggaggacagcgagtgcctgaaggagccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166497 - DNA, 2715 bp, Artificial Sequence
  Description of Artificial Sequence: Synthetic coding sequence
atgctgagctcctggcagggcggcccccggccccggcagctgctgctgtggctgctgatcctggccgcctgggagaccggcagcggccagctgcactacagcgtgcctgaggaggccaagcacggcacctttgtgggccgcatcgcccaggacctgggcctggagctggccgagctggtgcccaggctcttccgggtggccagcaagagacatggagacctgctggaggtgaacctgcagaatggcatcctgtttgtgaacagcagaattgaccgggaggagctgtgtggccgctctgcagaatgttccatccacctggaggtgattgtggaccggcccctgcaggtgttccacgtggaggtgaaggtgcgggacatcaatgacaacccccccatcttccctgagagcaagaagaggatcatcatcgccgagagcaggcctcctgagacccgcttccccctggatggagccagtgatgctgacatcggcgtgaacagcgccctgacctaccgcctggaccccaatgactacttcaccctggatgcccagaacagcctggagcagatgagcagcctgagcctggtgctgaggaagaccctggaccgggaggagatccaggagcacagcctgctgctgacagccagtgatggcggcaagccagagctgactggaacagtgcagctgctgatcaccatcctggatgtgaatgacaatgcccctgagttctaccagagcgtgtacaaggtgacagtgctggagaatgccttcaacggcaccctggtgatcaagctgaatgccacagatcctgatgatggcaccaacggggacatcgtgtacagcttccggcggcctgtgtggccagctgtggtgtatgccttcaccatcaaccccaacaatggagagatccgcaccaagggcaagctggactttgaggagaagaagctgtatgagatctctgtggaggccgtggacaagggcaacatccccatggccggccactgcaccctgctggtggaggtgctggatgtgaatgacaatgcccctgaggtgaccatcaccagcctgagcctgcccatccgggaggacacccagcccagcgccatcatcgccctgatctctgtgtctgaccgggacagcggcagcaatggccaggtgacctgcaccctgaccccccacgtgcccttcaagctggtgtccacctacaagaactactacagcctggtgctggacagcgccctggaccgggagagcgtgtctgcctatgagctggtggtgacagccagagatggcggcagccccagcctgtgggccacagcctctgtgtctgtgggcgtggctgatgtgaatgacaatgccccagcctttgcccagcctgagtacacagtgtttgtgaaggagaacaaccccccaggctgccacatcttcaccgtgtctgcccaggatgctgatgcccaggagaatgccctggtgtcctacagcctggtggagaggagagtgggggagcgggccctgagcagctatgtgtctgtgcacgccgagagcggcaaggtgtatgccctgcagcccctggaccacgaggagctggagctgctgcagttccaggtgtctgcccgggacagcggcgtgccccccctgggcagcaatgtgaccctgcaggtgtttgtgctggatgaaaatgacaatgccccagccctgctgacccctggggccggcagcgctgggggcaccgtgtctgagctgatgcccaggtctgtgggcgccggccacgtggtggccaaggtgcgggctgtggatgctgacagcggctacaatgcctggctgtcctatgagctgcagctggccgctgtgggcgcccgcatccccttccgggtgggcctgtacaccggggagatcagcaccacccggcccctggatgaggtggatgccccccaccaccggctgctggtgctggtgaaggaccacggggagcccgccctgacagccacagccaccgtgctgctgagcctggtggagagcggccaggccccccaggccagcagccgggccagcgctggagctgtgggccctgaggccgccctggtggatgtgaatgtgtacctgatcatcgccatctgtgctgtgagcagcctgctggtgctgaccctgctgctgtacacagccctgcgctgcagcgccccacccacagagggcgcctgtgcccctgggaagcccaccctggtgtgcagcagcgctgctggctcctggagctacagccagcagaggcggccccgggtgtgcagcggggagggcccccacaagacagacctgatggccttcagccccagcctgcccccctgcctgggcagcgctgagggcaccggccagcgggaggaggacagcgagtgcctgaaggagccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctgagcccaagaagcagacccaggtgtccttcctgctgcggaggaagggggaggccagccagccccggcagtag

SEQ ID NO: 166498 - DNA, 2475 bp, Artificial Sequence
  Description of Artificial Sequence: Synthetic coding sequence
atggccagcagcatccggcggggccgcggggcctggacccggctgctgagcctgctgctgctggccgcctgggaggtgggcagcggccagctgcgctacagcgtgcctgaggaggccaagcacggcacctttgtgggccgcatcgcccaggacctgggcctggagctggaggagctggtgcccaggctcttccgggtggccagcaagagacatggagacctgctggaggtgaacctgcagaatggcatcctgtttgtgaacagcagaattgaccgggaggagctgtgtggccgctctgcagaatgttccatccacgtggaggtgattgtggaccggcccctgcaggtgttccacgtggaggtggaggtgaaggacatcaatgacaacccccccatcttccccatgacagtgaagaccatccgcttccctgagagccggctgctggacagccgcttccccctggagggcgccagtgatgctgacatcggcgtgaatgccctgctgagctacaagctgagcagcagcgagttcttcttcctggacatccaggccaatgatgagctgtctgagagcctgagcctggtgctgggcaagagcctggaccgggaggagacagctgaggtgaacctgctgctggtggccacagatggcggcaagccagagctgactggaacagtgcagatcctgatcaaggtgctggatgtgaatgacaatgagcccacctttgcccagagcgtgtacaaggtgaagctgctggagaacacagccaacggcaccctggtggtgaagctgaatgccagtgatgctgatgagggccccaacagcgagatcgtgtacagcctgggcagtgatgtgagcagcaccatccagaccaagttcaccatcgaccccatctctggagagatccgcaccaagggcaagctggactatgaggaggccaagagctatgagatccaggtgacagccacagacaagggcacccccagcatgagcggccactgcaagatcagcctgaagctggtggacatcaatgacaacaccccagaggtgtccatcaccagcctgagcctgcccatcagtgaaaatgccagcctgggcaccgtgattgccctgatcaccgtgtctgaccgggacagcggcaccaacggccacgtgacctgcagcctgaccccccacgtgcccttcaagctggtgtccaccttcaagaactactacagcctggtgctggacagcgccctggaccgggagagcgtgtctgcctatgagctggtggtgacagccagagatggcggcagccccagcctgtgggccaccacctctgtgtccattgaggtggctgatgtgaatgacaatgccccagcctttgcccagcctgagtacacagtgtttgtgaaggagaacaaccccccaggctgccacatcttcaccgtgtctgcctgggatgctgatgcccaggagaatgccctggtgtcctacagcctggtggagaggagagtgggggagcgggccctgagcagctatgtgtctgtgcacgccgagagcggcaaggtgtatgccctgcagcccctggaccacgaggaggtggagctgctgcagttccaggtgtctgccagagatgctggggtgccccccctgggcagcaatgtgaccctgcaggtgtttgtgctggatgaaaatgacaatgccccagccctgctggccccccgggccggcacagctgctggagctgtgtctgagctggtgccctggagcgtgggcgccggccacgtggtggccaaggtgcgggctgtggatgctgacagcggctacaatgcctggctgtcctatgagctgcagctgggcactggaagtgcccgcatccccttccgggtgggcctgtacaccggggagatcagcaccacccgggccctggatgaggccgacagccccaggcaccggctgctggtgctggtgaaggaccacggggagcccgccctgacagccacagccaccgtgctggtgtccctggtggagagcggccaggcccccaaggccagcagccgggcctgggtgggcgctgctggcagcgaggccaccctggtggatgtgaatgtgtacctgatcatcgccatctgtgctgtgagcagcctgctggtgctgactgtgctgctgtacacagccctgcgctgcagcgtgcccccaacagagggcgcccgggcccctgggaagcccaccctggtgtgcagcagcgctgtgggctcctggagctacagccagcagaggcggcagagggtgtgcagcggggaggacccccccaagacagacctgatggccttcagccccagcctgagccagggccctgacagcgctgaggagaagcagctgtctgagagtgaatatgtgggcaaggtgtccctgctgctcttcctggccaacagcaagatcgtgctcttcaagaagttctacatgatcagcaccagctacctggacagctag

SEQ ID NO: 166499 - DNA, 2847 bp, Artificial Sequence
  Description of Artificial Sequence: Synthetic coding sequence
atggccagcagcatccggcggggccgcggggcctggacccggctgctgagcctgctgctgctggccgcctgggaggtgggcagcggccagctgcgctacagcgtgcctgaggaggccaagcacggcacctttgtgggccgcatcgcccaggacctgggcctggagctggaggagctggtgcccaggctcttccgggtggccagcaagagacatggagacctgctggaggtgaacctgcagaatggcatcctgtttgtgaacagcagaattgaccgggaggagctgtgtggccgctctgcagaatgttccatccacgtggaggtgattgtggaccggcccctgcaggtgttccacgtggaggtggaggtgaaggacatcaatgacaacccccccatcttccccatgacagtgaagaccatccgcttccctgagagccggctgctggacagccgcttccccctggagggcgccagtgatgctgacatcggcgtgaatgccctgctgagctacaagctgagcagcagcgagttcttcttcctggacatccaggccaatgatgagctgtctgagagcctgagcctggtgctgggcaagagcctggaccgggaggagacagctgaggtgaacctgctgctggtggccacagatggcggcaagccagagctgactggaacagtgcagatcctgatcaaggtgctggatgtgaatgacaatgagcccacctttgcccagagcgtgtacaaggtgaagctgctggagaacacagccaacggcaccctggtggtgaagctgaatgccagtgatgctgatgagggccccaacagcgagatcgtgtacagcctgggcagtgatgtgagcagcaccatccagaccaagttcaccatcgaccccatctctggagagatccgcaccaagggcaagctggactatgaggaggccaagagctatgagatccaggtgacagccacagacaagggcacccccagcatgagcggccactgcaagatcagcctgaagctggtggacatcaatgacaacaccccagaggtgtccatcaccagcctgagcctgcccatcagtgaaaatgccagcctgggcaccgtgattgccctgatcaccgtgtctgaccgggacagcggcaccaacggccacgtgacctgcagcctgaccccccacgtgcccttcaagctggtgtccaccttcaagaactactacagcctggtgctggacagcgccctggaccgggagagcgtgtctgcctatgagctggtggtgacagccagagatggcggcagccccagcctgtgggccaccacctctgtgtccattgaggtggctgatgtgaatgacaatgccccagcctttgcccagcctgagtacacagtgtttgtgaaggagaacaaccccccaggctgccacatcttcaccgtgtctgcctgggatgctgatgcccaggagaatgccctggtgtcctacagcctggtggagaggagagtgggggagcgggccctgagcagctatgtgtctgtgcacgccgagagcggcaaggtgtatgccctgcagcccctggaccacgaggaggtggagctgctgcagttccaggtgtctgccagagatgctggggtgccccccctgggcagcaatgtgaccctgcaggtgtttgtgctggatgaaaatgacaatgccccagccctgctggccccccgggccggcacagctgctggagctgtgtctgagctggtgccctggagcgtgggcgccggccacgtggtggccaaggtgcgggctgtggatgctgacagcggctacaatgcctggctgtcctatgagctgcagctgggcactggaagtgcccgcatccccttccgggtgggcctgtacaccggggagatcagcaccacccgggccctggatgaggccgacagccccaggcaccggctgctggtgctggtgaaggaccacggggagcccgccctgacagccacagccaccgtgctggtgtccctggtggagagcggccaggcccccaaggccagcagccgggcctgggtgggcgctgctggcagcgaggccaccctggtggatgtgaatgtgtacctgatcatcgccatctgtgctgtgagcagcctgctggtgctgactgtgctgctgtacacagccctgcgctgcagcgtgcccccaacagagggcgcccgggcccctgggaagcccaccctggtgtgcagcagcgctgtgggctcctggagctacagccagcagaggcggcagagggtgtgcagcggggaggacccccccaagacagacctgatggccttcagccccagcctgagccagggccctgacagcgctgaggagaagcagctgtctgagagtgaatatgtgggcaagccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166500 - DNA, 2853 bp, Artificial Sequence
  Description of Artificial Sequence: Synthetic coding sequence
atgctgttctcctggagagaagatcctggggcccagtgcctgctgctgagcctgctgctgctggccgccagcgaggtgggcagcggccagctgcactacagcgtgtctgaggaggccaagcacggcacctttgtgggccgcatcgcccaggacctgggcctggagctggccgagctggtgcccaggctcttccgggtggccagcaagagacatggagacctgctggaggtgaacctgcagaatggcatcctgtttgtgaacagcagaattgaccgggaggagctgtgtggccgctctgcagaatgttccatccacctggaggtgattgtggaccggcccctgcaggtgttccacgtggaggtggaggtgaaggacatcaatgacaatgcccctgtgttccccatggctgtgaagaacctcttcatcagcgagagccggcagcccggcagccgcttcagcctggagggcgccagtgatgctgacatcggcaccaacagcctgctgacctacagcctggacagcacagagtacttcaccctggatgtgaagagaaatgatgaggagatcaagagcctgggcctggtgctgaagaagaacctgaaccgggaggacacccccaagcactacctgctgatcacagccattgatggcggcaagccagagctgaccggcaccacccagctgaagatcaccgtgctggatgtgaatgacaatgccccagcctttgagaggaccatctacaaggtgcggctgctggagaatgccccaaatggcaccctggtggtgacagtgaatgccacagacctggatgagggcgtgaacaaggacatcgcctacagcttcaacacagacatgtctgctgacatcctgagcaagttccacctggaccctgtgaatggccagatctctgtgaagggcaacatcgactttgaggagagcaagagctatgagatccaggtggaggccacagacaagggcaacccccccatgtctgaccactgcaccgtgctgctggagatcgtggacatcaatgacaacgtgcctgagctggtgatccagagcctgagcctgcctgtgctggaggacagccccctgagcacagtgattgccctgatctctgtgtctgaccgggacagcggcgtgaatggccaggtgacctgcagcctgaccccccacgtgcccttcaagctggtgtccaccttcaagaactactacagcctggtgctggacagccccctggaccgggagagcgtgtctgcctatgagctggtggtgacagccagagatggcggcagccccagcctgtgggccacagcctctgtgtctgtggaggtggctgatgtgaatgacaatgccccagccttcagccagagcgagtacacagtgtttgtgaaggagaacaaccccccaggctgccacatcttcaccgtgtctgccagagatgctgatgcccaggagaatgccctggtgtcctacagcctggtggagaggagagtgggggagcgggccctgagcagctatgtgtctgtgcacgccgagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctgatgccccgggtgggcggcattggaggagctgtgtctgagctggtgcccaggtctgtgggcgccggccacgtggtggccaaggtgcgggctgtggatgctgacagcggctacaatgcctggctgtcctatgagctgcagcccggcactggaggagcccgcatccccttccgggtgggcctgtacaccggggagatcagcaccacccgggccctggatgaggtggatgcccccaggcaccggctgctggtgctggtgaaggaccacggggagcccagcctgacagccacagccaccgtgctggtgtccctggtggagagcggccaggcccccaaggccagcagccaggccagcgctggggccactggacctgaggccgccctggtggatgtgaatgtgtacctgattgtggccatctgtgctgtgagcagcctgctggtgctgaccctgctgctgtacacagccctgcgctgcagcgccccacccacagaaggagactgtggccctgggaagcccaccctggtgtgcagcagcgctgtgggctcctggagctacagccagcagaggcagcagagggtgtgcagcggggagggcctgcccaagacagacctgatggccttcagccccagcctgcccccctgccccatcagccgggaccgggaggagaagcaggatgtggatgtggacctgagcgccaagccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166501 - DNA, 2475 bp, Artificial Sequence
  Description of Artificial Sequence: Synthetic coding sequence
atgctgttctcctggagagaagatcctggggcccagtgcctgctgctgagcctgctgctgctggccgccagcgaggtgggcagcggccagctgcactacagcgtgtctgaggaggccaagcacggcacctttgtgggccgcatcgcccaggacctgggcctggagctggccgagctggtgcccaggctcttccgggtggccagcaagagacatggagacctgctggaggtgaacctgcagaatggcatcctgtttgtgaacagcagaattgaccgggaggagctgtgtggccgctctgcagaatgttccatccacctggaggtgattgtggaccggcccctgcaggtgttccacgtggaggtggaggtgaaggacatcaatgacaatgcccctgtgttccccatggctgtgaagaacctcttcatcagcgagagccggcagcccggcagccgcttcagcctggagggcgccagtgatgctgacatcggcaccaacagcctgctgacctacagcctggacagcacagagtacttcaccctggatgtgaagagaaatgatgaggagatcaagagcctgggcctggtgctgaagaagaacctgaaccgggaggacacccccaagcactacctgctgatcacagccattgatggcggcaagccagagctgaccggcaccacccagctgaagatcaccgtgctggatgtgaatgacaatgccccagcctttgagaggaccatctacaaggtgcggctgctggagaatgccccaaatggcaccctggtggtgacagtgaatgccacagacctggatgagggcgtgaacaaggacatcgcctacagcttcaacacagacatgtctgctgacatcctgagcaagttccacctggaccctgtgaatggccagatctctgtgaagggcaacatcgactttgaggagagcaagagctatgagatccaggtggaggccacagacaagggcaacccccccatgtctgaccactgcaccgtgctgctggagatcgtggacatcaatgacaacgtgcctgagctggtgatccagagcctgagcctgcctgtgctggaggacagccccctgagcacagtgattgccctgatctctgtgtctgaccgggacagcggcgtgaatggccaggtgacctgcagcctgaccccccacgtgcccttcaagctggtgtccaccttcaagaactactacagcctggtgctggacagccccctggaccgggagagcgtgtctgcctatgagctggtggtgacagccagagatggcggcagccccagcctgtgggccacagcctctgtgtctgtggaggtggctgatgtgaatgacaatgccccagccttcagccagagcgagtacacagtgtttgtgaaggagaacaaccccccaggctgccacatcttcaccgtgtctgccagagatgctgatgcccaggagaatgccctggtgtcctacagcctggtggagaggagagtgggggagcgggccctgagcagctatgtgtctgtgcacgccgagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctgatgccccgggtgggcggcattggaggagctgtgtctgagctggtgcccaggtctgtgggcgccggccacgtggtggccaaggtgcgggctgtggatgctgacagcggctacaatgcctggctgtcctatgagctgcagcccggcactggaggagcccgcatccccttccgggtgggcctgtacaccggggagatcagcaccacccgggccctggatgaggtggatgcccccaggcaccggctgctggtgctggtgaaggaccacggggagcccagcctgacagccacagccaccgtgctggtgtccctggtggagagcggccaggcccccaaggccagcagccaggccagcgctggggccactggacctgaggccgccctggtggatgtgaatgtgtacctgattgtggccatctgtgctgtgagcagcctgctggtgctgaccctgctgctgtacacagccctgcgctgcagcgccccacccacagaaggagactgtggccctgggaagcccaccctggtgtgcagcagcgctgtgggctcctggagctacagccagcagaggcagcagagggtgtgcagcggggagggcctgcccaagacagacctgatggccttcagccccagcctgcccccctgccccatcagccgggaccgggaggagaagcaggatgtggatgtggacctgagcgccaaggtgagcaacttctacctgttcttccccaagtgcctgtgcttctccttcctgaatgtgtccacccccctggagatccactag

SEQ ID NO: 166502 - DNA, 2451 bp, Artificial Sequence
  Description of Artificial Sequence: Synthetic coding sequence
atggtgtacagcagaagaggcagcctgggcagccggctgctgctgctgtggctgctgctggcctactggaaggccggcagcggccagctgcactacagcatccctgaggaggccaagcacggcacctttgtgggcagaattgcccaggacctgggcctggagctggccgagctggtgcccaggctcttccgggtggccagcaagggccgcggggacctgctggaggtgaacctgcagaatggcatcctgtttgtgaacagcagaattgaccgggaggagctgtgcagaagaagagctgagtgcagcatccacctggaggtgattgtggaccggcccctgcaggtgttccacgtggaggtggccgtgaaggacatcaatgacaaccccccacgcttcagccggcaggagcagaggctcttcatcctggagagcaggatgccagacagccgcttccccctggagggcgccagtgacctggacattggagccaatgcccagctgcgctaccgcctgaaccccaatgagtactttgacctggatgtgaagaccaatgaggaggagaccaacttcctggagctggtgctgaggaagagcctggaccgggaggagacccaggagcaccggctgctggtgattgccacagatggcggcaagccagagctgaccggcaccgtgcagctgctgatcaacgtgctggatgccaatgacaatgcccctgagtttgacaagagcatctacaacgtgcggctgctggagaatgcccccagcggcaccctggtgatcaagctgaatgccagtgatgctgatgagggcatcaacaaggagatcgtgtacttcttcagcaacctggtgctggatgatgtgaagagcaagttcatcatcaacagcaacacaggagagatcaaggtgaatggagagctggactatgaggactacaacagctatgagatcaacattgatgccatggacaagagcaccttccccctgagcggccactgcaaggtggtggtgaagctgctggatgtgaatgacaacaccccagagatggccatcaccaccctcttcctgcctgtgaaggaggatgcccccctgagcaccgtcatcgccctgatctctgtgtctgaccgggacagcggggccaacggccaggtgacctgcagcctgatgcctcatgtgcccttcaagctggtgtccaccttcaagaactactacagcctggtgctggacagcgccctggaccgggagagcgtgtctgtgtatgagctggtggtgacagccagagatggcggcagccccagcctgtgggccacagcctctgtgtctgtggaggtggctgatgtgaatgacaatgccccagcctttgcccagccccagtacacagtgtttgtgaaggagaacaaccccccaggctgccacatcttcaccgtgtctgccagagatgctgatgcccaggagaatgccctggtgtcctacagcctggtggagcggcgggtgggggagcggcccctgagcagctatgtgtctgtgcatgctgagagcggcaaggtgtatgccctgcagcccctggaccacgaggaggtggagctgctgcagttccaggtgtctgccagagatgctggggtgccccccctgggcagcaatgtgaccctgcaggtgtttgtgctggatgaaaatgacaatgccccagccctgctggtgccccgggtgggcggcaccggcggcgctgtgtctgagctggtgcccaggtctgtgggcgccggccacgtggtggccaaggtgcgggctgtggaccctgacagcggctacaatgcctggctgtcctatgagctgcagcctgcccctggcagcgcccgcatccccttccgggtgggcctgtacacaggagagatcagcaccaccaggagcctggatgaaacagaggcccccaggcaccggctgctggtgctggtgaaggaccatggagagccccccctgacagccacagccaccgtgctggtgtccctggtggagagcggccaggcccccaaggccagcagccgggccagcgctggagctgtgggccctgaggccgccctggtggatgtgaatgtgtacctgatcatcgccatctgtgctgtgagcagcctgctggtgctgaccctgctgctgtacacagccctgcgctgcagcgcccagcccacagaagctgtgtgcacccggggcaagcccaccctgctgtgcagcagcgctgtgggctcctggagctacagccagcagaggcggcagagggtgtgcagcggggaggccccacccaagacagacctgatggccttcagccccagcctgccccagggccccaccagcacagacaacgtgtccttcctgatcctgaccagcatcttccccagccagttcagcaacatcaagtgccacatccaccccctcttcctgtacctgaagatcatgtcctag

SEQ ID NO: 166503 - DNA, 2673 bp, Artificial Sequence
  Description of Artificial Sequence: Synthetic coding sequence
atggtgtacagcagaagaggcagcctgggcagccggctgctgctgctgtggctgctgctggcctactggaaggccggcagcggccagctgcactacagcatccctgaggaggccaagcacggcacctttgtgggcagaattgcccaggacctgggcctggagctggccgagctggtgcccaggctcttccgggtggccagcaagggccgcggggacctgctggaggtgaacctgcagaatggcatcctgtttgtgaacagcagaattgaccgggaggagctgtgcagaagaagagctgagtgcagcatccacctggaggtgattgtggaccggcccctgcaggtgttccacgtggaggtggccgtgaaggacatcaatgacaaccccccacgcttcagccggcaggagcagaggctcttcatcctggagagcaggatgccagacagccgcttccccctggagggcgccagtgacctggacattggagccaatgcccagctgcgctaccgcctgaaccccaatgagtactttgacctggatgtgaagaccaatgaggaggagaccaacttcctggagctggtgctgaggaagagcctggaccgggaggagacccaggagcaccggctgctggtgattgccacagatggcggcaagccagagctgaccggcaccgtgcagctgctgatcaacgtgctggatgccaatgacaatgcccctgagtttgacaagagcatctacaacgtgcggctgctggagaatgcccccagcggcaccctggtgatcaagctgaatgccagtgatgctgatgagggcatcaacaaggagatcgtgtacttcttcagcaacctggtgctggatgatgtgaagagcaagttcatcatcaacagcaacacaggagagatcaaggtgaatggagagctggactatgaggactacaacagctatgagatcaacattgatgccatggacaagagcaccttccccctgagcggccactgcaaggtggtggtgaagctgctggatgtgaatgacaacaccccagagatggccatcaccaccctcttcctgcctgtgaaggaggatgcccccctgagcaccgtcatcgccctgatctctgtgtctgaccgggacagcggggccaacggccaggtgacctgcagcctgatgcctcatgtgcccttcaagctggtgtccaccttcaagaactactacagcctggtgctggacagcgccctggaccgggagagcgtgtctgtgtatgagctggtggtgacagccagagatggcggcagccccagcctgtgggccacagcctctgtgtctgtggaggtggctgatgtgaatgacaatgccccagcctttgcccagccccagtacacagtgtttgtgaaggagaacaaccccccaggctgccacatcttcaccgtgtctgccagagatgctgatgcccaggagaatgccctggtgtcctacagcctggtggagcggcgggtgggggagcggcccctgagcagctatgtgtctgtgcatgctgagagcggcaaggtgtatgccctgcagcccctggaccacgaggaggtggagctgctgcagttccaggtgtctgccagagatgctggggtgccccccctgggcagcaatgtgaccctgcaggtgtttgtgctggatgaaaatgacaatgccccagccctgctggtgccccgggtgggcggcaccggcggcgctgtgtctgagctggtgcccaggtctgtgggcgccggccacgtggtggccaaggtgcgggctgtggaccctgacagcggctacaatgcctggctgtcctatgagctgcagcctgcccctggcagcgcccgcatccccttccgggtgggcctgtacacaggagagatcagcaccaccaggagcctggatgaaacagaggcccccaggcaccggctgctggtgctggtgaaggaccatggagagccccccctgacagccacagccaccgtgctggtgtccctggtggagagcggccaggcccccaaggccagcagccgggccagcgctggagctgtgggccctgaggccgccctggtggatgtgaatgtgtacctgatcatcgccatctgtgctgtgagcagcctgctggtgctgaccctgctgctgtacacagccctgcgctgcagcgcccagcccacagaagctgtgtgcacccggggcaagcccaccctgctgtgcagcagcgctgtgggctcctggagctacagccagcagaggcggcagagggtgtgcagcggggaggccccacccaagacagacctgatggccttcagccccagcctgccccagggccccaccagcacagacaacccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctgagcccaagaagcagacccaggtgtccttcctgctgcggaggaagggggaggccagccagccccggcagtag

SEQ ID NO: 166504 - DNA, 2811 bp, Artificial Sequence
  Description of Artificial Sequence: Synthetic coding sequence
atggtgtacagcagaagaggcagcctgggcagccggctgctgctgctgtggctgctgctggcctactggaaggccggcagcggccagctgcactacagcatccctgaggaggccaagcacggcacctttgtgggcagaattgcccaggacctgggcctggagctggccgagctggtgcccaggctcttccgggtggccagcaagggccgcggggacctgctggaggtgaacctgcagaatggcatcctgtttgtgaacagcagaattgaccgggaggagctgtgcagaagaagagctgagtgcagcatccacctggaggtgattgtggaccggcccctgcaggtgttccacgtggaggtggccgtgaaggacatcaatgacaaccccccacgcttcagccggcaggagcagaggctcttcatcctggagagcaggatgccagacagccgcttccccctggagggcgccagtgacctggacattggagccaatgcccagctgcgctaccgcctgaaccccaatgagtactttgacctggatgtgaagaccaatgaggaggagaccaacttcctggagctggtgctgaggaagagcctggaccgggaggagacccaggagcaccggctgctggtgattgccacagatggcggcaagccagagctgaccggcaccgtgcagctgctgatcaacgtgctggatgccaatgacaatgcccctgagtttgacaagagcatctacaacgtgcggctgctggagaatgcccccagcggcaccctggtgatcaagctgaatgccagtgatgctgatgagggcatcaacaaggagatcgtgtacttcttcagcaacctggtgctggatgatgtgaagagcaagttcatcatcaacagcaacacaggagagatcaaggtgaatggagagctggactatgaggactacaacagctatgagatcaacattgatgccatggacaagagcaccttccccctgagcggccactgcaaggtggtggtgaagctgctggatgtgaatgacaacaccccagagatggccatcaccaccctcttcctgcctgtgaaggaggatgcccccctgagcaccgtcatcgccctgatctctgtgtctgaccgggacagcggggccaacggccaggtgacctgcagcctgatgcctcatgtgcccttcaagctggtgtccaccttcaagaactactacagcctggtgctggacagcgccctggaccgggagagcgtgtctgtgtatgagctggtggtgacagccagagatggcggcagccccagcctgtgggccacagcctctgtgtctgtggaggtggctgatgtgaatgacaatgccccagcctttgcccagccccagtacacagtgtttgtgaaggagaacaaccccccaggctgccacatcttcaccgtgtctgccagagatgctgatgcccaggagaatgccctggtgtcctacagcctggtggagcggcgggtgggggagcggcccctgagcagctatgtgtctgtgcatgctgagagcggcaaggtgtatgccctgcagcccctggaccacgaggaggtggagctgctgcagttccaggtgtctgccagagatgctggggtgccccccctgggcagcaatgtgaccctgcaggtgtttgtgctggatgaaaatgacaatgccccagccctgctggtgccccgggtgggcggcaccggcggcgctgtgtctgagctggtgcccaggtctgtgggcgccggccacgtggtggccaaggtgcgggctgtggaccctgacagcggctacaatgcctggctgtcctatgagctgcagcctgcccctggcagcgcccgcatccccttccgggtgggcctgtacacaggagagatcagcaccaccaggagcctggatgaaacagaggcccccaggcaccggctgctggtgctggtgaaggaccatggagagccccccctgacagccacagccaccgtgctggtgtccctggtggagagcggccaggcccccaaggccagcagccgggccagcgctggagctgtgggccctgaggccgccctggtggatgtgaatgtgtacctgatcatcgccatctgtgctgtgagcagcctgctggtgctgaccctgctgctgtacacagccctgcgctgcagcgcccagcccacagaagctgtgtgcacccggggcaagcccaccctgctgtgcagcagcgctgtgggctcctggagctacagccagcagaggcggcagagggtgtgcagcggggaggccccacccaagacagacctgatggccttcagccccagcctgccccagggccccaccagcacagacaacccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166505 - DNA, 2061 bp, Artificial Sequence
  Description of Artificial Sequence: Synthetic coding sequence
atggtgttcaccccagaggaccggctgggcaagcagtgcctgctgctgcccctgctgctgctggccgcctggaaggtgggcagcggccagctgcactacagcgtgcctgaggaggccaagcacggcacctttgtgggccgcatcgcccaggacctgggcctggagctggccgagctggtgcccaggctcttcaggatggccagcaaggaccgggaggacctgctggaggtgaacctgcagaatggcatcctgtttgtgaacagcagaattgaccgggaggagctgtgtggccgctctgcagaatgttccatccacctggaggtgattgtggaccggcccctgcaggtgttccacgtggatgtggaggtgcgggacatcaatgacaaccccccactcttccctgtggaggagcagagggtgctgatctatgagagccggctgcctgacagcgtcttccccctggagggcgccagtgatgctgatgtgggcagcaacagcatcctgacctacaagctgagcagcagcgagtacttcggcctggatgtgaagatcaacagtgatgacaacaagcagatcggcctgctgctgaagaagagcctggaccgggaggaggccccagcccacaacctcttcctgacagccacagatggcggcaagccagagctgactggaacagtgcagctgctggtgacagtgctggatgtgaatgacaatgcccccacctttgagcagagtgaatatgaggtgcgcatctttgaaaatgctgacaatggcaccaccgtcatccggctgaatgccagtgacagagatgagggcgccaacggggccatctcctacagcttcaacagcctggtggccgccatggtgattgaccacttcagcattgacagaaatactggagagatcgtcatccggggcaacctggactttgagcaggagaacctgtacaagatcctgattgatgccacagacaagggccacccccccatggccggccactgcaccgtgctggtgcgcatcctggacaagaatgacaacgtgcctgagatcgccctgaccagcctgagcctgcctgtgagagaagatgcccagtttggaacagtgattgccctgatctctgtgaatgacctggacagcggggccaacggccaggtgaactgcagcctgaccccccacgtgcccttcaagctggtgtccaccttcaagaactactacagcctggtgctggacagcgccctggaccgggagagcgtgtctgcctatgagctggtggtgacagccagagatggcggcagccccagcctgtgggccacagccagcctgtctgtggaggtggccgacatgaatgacaatgccccagcctttgcccagcctgagtacacagtgtttgtgaaggagaacaaccccccaggctgccacatcttcaccgtgtctgccagagatgctgatgcccaggagaatgccctggtgtcctacagcctggtggagaggagagtgggggagcgggccctgagcagctacatctctgtgcacgccgagagcggcaaggtgtatgccctgcagcccctggaccacgaggagctggagctgctgcagttccagccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166506 - DNA, 2853 bp, Artificial Sequence
  Description of Artificial Sequence: Synthetic coding sequence
atggtgttcaccccagaggaccggctgggcaagcagtgcctgctgctgcccctgctgctgctggccgcctggaaggtgggcagcggccagctgcactacagcgtgcctgaggaggccaagcacggcacctttgtgggccgcatcgcccaggacctgggcctggagctggccgagctggtgcccaggctcttcaggatggccagcaaggaccgggaggacctgctggaggtgaacctgcagaatggcatcctgtttgtgaacagcagaattgaccgggaggagctgtgtggccgctctgcagaatgttccatccacctggaggtgattgtggaccggcccctgcaggtgttccacgtggatgtggaggtgcgggacatcaatgacaaccccccactcttccctgtggaggagcagagggtgctgatctatgagagccggctgcctgacagcgtcttccccctggagggcgccagtgatgctgatgtgggcagcaacagcatcctgacctacaagctgagcagcagcgagtacttcggcctggatgtgaagatcaacagtgatgacaacaagcagatcggcctgctgctgaagaagagcctggaccgggaggaggccccagcccacaacctcttcctgacagccacagatggcggcaagccagagctgactggaacagtgcagctgctggtgacagtgctggatgtgaatgacaatgcccccacctttgagcagagtgaatatgaggtgcgcatctttgaaaatgctgacaatggcaccaccgtcatccggctgaatgccagtgacagagatgagggcgccaacggggccatctcctacagcttcaacagcctggtggccgccatggtgattgaccacttcagcattgacagaaatactggagagatcgtcatccggggcaacctggactttgagcaggagaacctgtacaagatcctgattgatgccacagacaagggccacccccccatggccggccactgcaccgtgctggtgcgcatcctggacaagaatgacaacgtgcctgagatcgccctgaccagcctgagcctgcctgtgagagaagatgcccagtttggaacagtgattgccctgatctctgtgaatgacctggacagcggggccaacggccaggtgaactgcagcctgaccccccacgtgcccttcaagctggtgtccaccttcaagaactactacagcctggtgctggacagcgccctggaccgggagagcgtgtctgcctatgagctggtggtgacagccagagatggcggcagccccagcctgtgggccacagccagcctgtctgtggaggtggccgacatgaatgacaatgccccagcctttgcccagcctgagtacacagtgtttgtgaaggagaacaaccccccaggctgccacatcttcaccgtgtctgccagagatgctgatgcccaggagaatgccctggtgtcctacagcctggtggagaggagagtgggggagcgggccctgagcagctacatctctgtgcacgccgagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctggccccccgggtgggcggcactggaggagctgtgtctgagctggtgcccaggagcctgggcgccggccaggtggtggccaaggtgcgggctgtggatgctgacagcggctacaatgcctggctgtcctatgagctgcagcccccagccagcagcgcccgcttccccttccgggtgggcctgtacaccggggagatcagcaccaccagggtgctggatgaggccgacagccccaggcaccggctgctggtgctggtgaaggaccacggggagcccgccctgacagccacagccaccgtgctggtgtccctggtggagagcggccaggcccccaaggccagcagccgggcctctgtgggcgctgctggccctgaggccgccctggtggatgtgaatgtgtacctgatcatcgccatctgtgctgtgagcagcctgctggtgctgaccctgctgctgtacacagccctgcgctgcagcgccccacccacagagggcgcctgcacagctgacaagcccaccctggtgtgcagcagcgctgtgggctcctggagctacagccagcagaggcggcagagggtgtgcagcggggagggcccccccaagatggacctgatggccttcagccccagcctgagcccctgccccatcatgatgggcaaggccgagaaccaggacctgaatgaagatcatgatgccaagccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166507 - DNA, 2370 bp, Artificial Sequence
  Description of Artificial Sequence: Synthetic coding sequence
atggtgtgccccaacggctatgaccccggcggccgccacctgctgctcttcatcatcatcctggccgcctgggaggccggccggggccagctgcactacagcgtgcctgaggaggccaagcacggcaactttgtgggccgcatcgcccaggacctgggcctggagctggccgagctggtgcccaggctcttccgggctgtgtgcaagttccggggggacctgctggaggtgaacctgcagaatggcatcctgtttgtgaacagcagaattgaccgggaggagctgtgtggccgctctgcagaatgttccatccacctggaggtgattgtggagcggcccctgcaggtgttccacgtggatgtggaggtgaaggacatcaatgacaacccccctgtgtttcctgccacccagaggaacctcttcatcgccgagagccggcccctggacagccgcttccccctggagggcgccagtgatgctgacatcggggagaatgccctgctgacctaccgcctgagccccaatgagtacttcttcctggatgtgcccaccagcaaccagcaggtgaagcccctgggcctggtgctgaggaagctgctggaccgggaggagaccccagagctgcacctgctgctgacagccacagatggcggcaagccagagctgactggaacagtgcagctgctgatcaccgtgctggacaacaatgacaatgcccctgtgtttgacaggaccctgtacacagtgaagctgcctgaaaatgtgtccatcggcaccctggtgatccaccccaatgccagtgacctggatgagggcctgaatggagacatcatctacagcttcagcagtgatgtgtccccagacatcaagagcaagttccacatggaccccctgagcggggccatcaccgtgattggccacatggactttgaggagagccgggcccacaagatccctgtggaggccgtggacaagggcttcccccccctggccggccactgcaccgtgctggtggaggtggtggatgtgaatgacaatgccccccagctgaccctgaccagcctgagcctgcccatcccagaagatgcccagcccggcaccgtcatcaccctcatctctgtgtttgaccgggactttggagtgaatggccaggtgacctgcagcctgaccccccgggtgcccttcaagctggtgtccaccttcaagaactactacagcctggtgctggacagcgccctggaccgggagagcgtgtctgcctatgagctggtggtgacagccagagatggcggcagccccagcctgtgggccacagcctctgtgtctgtggaggtggctgatgtgaatgacaatgccccagcctttgcccagcctgagtacacagtgtttgtgaaggagaacaaccccccaggctgccacatcttcaccgtgtctgctggagatgctgatgcccagaagaatgccctggtgtcctacagcctggtggagctgcgggtgggggagcgggccctgagcagctatgtgtctgtgcacgccgagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctggccccccgggtgggcggcactggaggagctgtgcgggagctggtgcccaggtctgtgggcgccggccacgtggtggccaaggtgcgggctgtggatgctgacagcggctacaatgcctggctgtcctatgagctgcagcctgtggccgccggggccagcatccccttccgggtgggcctgtacaccggggagatcagcaccacccgggccctggatgaaacagatgcccccaggcaccggctgctggtgctggtgaaggaccacggggagcccagcctgacagccacagccaccgtgctggtgtccctggtggagagcggccaggcccccaaggccagcagccgggccagcctgggcattgctggccctgagacagagctggtggatgtgaatgtgtacctgatcatcgccatctgtgctgtgagcagcctgctggtgctgaccctgctgctgtacacagccctgcgctgcagcgcccccagcagcgagggcgcctgcagcctggtgaagcccaccctggtgtgcagcagcgctgtgggctcctggagcttcagccagcagaggcggcagagggtgtgcagcggggagggcccccccaagacagacctgatggccttcagccccagcctgccccagggccccagcagcacagacaacgtgagccacaagtag

SEQ ID NO: 166508 - DNA, 2814 bp, Artificial Sequence
  Description of Artificial Sequence: Synthetic coding sequence
atggtgtgccccaacggctatgaccccggcggccgccacctgctgctcttcatcatcatcctggccgcctgggaggccggccggggccagctgcactacagcgtgcctgaggaggccaagcacggcaactttgtgggccgcatcgcccaggacctgggcctggagctggccgagctggtgcccaggctcttccgggctgtgtgcaagttccggggggacctgctggaggtgaacctgcagaatggcatcctgtttgtgaacagcagaattgaccgggaggagctgtgtggccgctctgcagaatgttccatccacctggaggtgattgtggagcggcccctgcaggtgttccacgtggatgtggaggtgaaggacatcaatgacaacccccctgtgtttcctgccacccagaggaacctcttcatcgccgagagccggcccctggacagccgcttccccctggagggcgccagtgatgctgacatcggggagaatgccctgctgacctaccgcctgagccccaatgagtacttcttcctggatgtgcccaccagcaaccagcaggtgaagcccctgggcctggtgctgaggaagctgctggaccgggaggagaccccagagctgcacctgctgctgacagccacagatggcggcaagccagagctgactggaacagtgcagctgctgatcaccgtgctggacaacaatgacaatgcccctgtgtttgacaggaccctgtacacagtgaagctgcctgaaaatgtgtccatcggcaccctggtgatccaccccaatgccagtgacctggatgagggcctgaatggagacatcatctacagcttcagcagtgatgtgtccccagacatcaagagcaagttccacatggaccccctgagcggggccatcaccgtgattggccacatggactttgaggagagccgggcccacaagatccctgtggaggccgtggacaagggcttcccccccctggccggccactgcaccgtgctggtggaggtggtggatgtgaatgacaatgccccccagctgaccctgaccagcctgagcctgcccatcccagaagatgcccagcccggcaccgtcatcaccctcatctctgtgtttgaccgggactttggagtgaatggccaggtgacctgcagcctgaccccccgggtgcccttcaagctggtgtccaccttcaagaactactacagcctggtgctggacagcgccctggaccgggagagcgtgtctgcctatgagctggtggtgacagccagagatggcggcagccccagcctgtgggccacagcctctgtgtctgtggaggtggctgatgtgaatgacaatgccccagcctttgcccagcctgagtacacagtgtttgtgaaggagaacaaccccccaggctgccacatcttcaccgtgtctgctggagatgctgatgcccagaagaatgccctggtgtcctacagcctggtggagctgcgggtgggggagcgggccctgagcagctatgtgtctgtgcacgccgagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctggccccccgggtgggcggcactggaggagctgtgcgggagctggtgcccaggtctgtgggcgccggccacgtggtggccaaggtgcgggctgtggatgctgacagcggctacaatgcctggctgtcctatgagctgcagcctgtggccgccggggccagcatccccttccgggtgggcctgtacaccggggagatcagcaccacccgggccctggatgaaacagatgcccccaggcaccggctgctggtgctggtgaaggaccacggggagcccagcctgacagccacagccaccgtgctggtgtccctggtggagagcggccaggcccccaaggccagcagccgggccagcctgggcattgctggccctgagacagagctggtggatgtgaatgtgtacctgatcatcgccatctgtgctgtgagcagcctgctggtgctgaccctgctgctgtacacagccctgcgctgcagcgcccccagcagcgagggcgcctgcagcctggtgaagcccaccctggtgtgcagcagcgctgtgggctcctggagcttcagccagcagaggcggcagagggtgtgcagcggggagggcccccccaagacagacctgatggccttcagccccagcctgccccagggccccagcagcacagacaacccccggcagcccaacccagactggagatacagcgccagcctgcgggccggcatgcacagctctgtgcacctggaggaggccggcatcctgcgggccggccctgggggccctgaccagcagtggcccaccgtgtcctctgccaccccagagcctgaggccggggaggtgtccccacctgtgggcgccggcgtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166509 - DNA, 2445 bp, Artificial Sequence
  Description of Artificial Sequence: Synthetic coding sequence
atggactaccactggagaggagagctgggctcctggaggctgctgctgctgctgctgctgctggccgcctggaaggtgggcagcggccagctgcactacagcgtgcctgaggaggccaagcacggcacctttgtgggccgcatcgcccaggacctgggcctggagctggccgagctggtgcccaggctcttccgggtggccagcaagaggcaccgggacctgctggaggtgtccctgcagaatggcatcctgtttgtgaacagcagaattgaccgggaggagctgtgtggccgctctgcagaatgttccatccacctggaggtgattgtggaccggcccctgcaggtgttccacgtggatgtggaggtgaaggatgtgaatgacaacccccctgtgttccgggtgaaggaccagaagctgtttgtgtctgagagcaggatgccagacagccgcttccccctggagggcgccagtgatgctgatgtgggcgccaacagcgtgctgacctaccgcctgagcagccatgactacttcatgctggatgtgaacagcaagaatgatgagaacaagctggtggagctggtgctgaggaagagcctggacagagaagatgccccagcccaccacctgttcctgacagccacagatggcggcaagccagagctgactggaacagtgcagctgctggtgacagtgctggatgtgaatgacaatgcccccacctttgagcagagtgaatatgaggtgcgcatctttgaaaatgctgacaatggcaccaccgtcatcaagctgaatgccagtgaccctgatgagggcgccaacggggccatctcctacagcttcaacagcctggtggagaccatggtgattgaccacttcagcattgacagaaatactggagagatcgtcatccggggcaacctggactttgagcaggagaacctgtacaagatcctgattgatgccacagacaagggccacccccccatggccggccactgcaccgtgctggtgcgcatcctggacaagaatgacaacgtgcctgagatcgccctgaccagcctgagcctgcctgtgagagaagatgcccagtttggaacagtgattgccctgatctctgtgaatgacctggacagcggggccaacggccaggtgacctgcagcctgatgccccacgtgcccttcaagctggtgtccaccttcaagaactactacagcctggtgctggacagcgccctggaccgggagcgggtgtctgcctatgagctggtggtgacagccagagatggcggcagccccagcctgtgggccacagccagcctgtctgtggaggtggctgatgtgaatgacaatgccccagcctttgcccagcctgagtacacagtgtttgtgaaggagaacaaccccccaggctgccacatcttcaccgtgtctgccagagatgctgatgcccaggagaatgccctggtgtcctacagcctggtggagaggagagtgggggagaggagcctgagcagctacatctctgtgcacacagagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctggagccccgggtgggcggcactggaggagctgccagcaagctggtgcccaggtctgtgggcgccggccacgtggtggccaaggtgcgggctgtggatgctgacagcggctacaatgcctggctgtcctatgagctgcagcctgctgccagcagcccccgcatccccttccgggtgggcctgtacaccggggagatcagcaccaccagggtgctggatgaggccgacagccccaggcaccggctgctggtgctggtgaaggaccacggggagcccgccctgacagccacagccaccgtgctggtgtccctggtggagagcggccaggcccccaaggccagcagccggcagagcgctggggtgctgggccctgaggccgccctggtggatgtgaatgtgtacctgatcatcgccatctgtgctgtgagcagcctgctggtgctgaccctgctgctgtacacagccctgcgctgcagcgccctgcccacagagggcggctgccgggccggcaagcccaccctggtgtgcagcagcgctgtgggctcctggagctacagccagcagcagccccagagggtgtgcagcggggagggcccccccaagacagacctgatggccttcagcccctgcctgcccccagacctgggctctgtggatgtgggggaggagcaggacctgaatgtggaccacggcctgaaggtgagccccttcaagttccgcacccacaagttctacctgtggaagctgtag

SEQ ID NO: 166510 - DNA, 2853 bp, Artificial Sequence
  Description of Artificial Sequence: Synthetic coding sequence
atggactaccactggagaggagagctgggctcctggaggctgctgctgctgctgctgctgctggccgcctggaaggtgggcagcggccagctgcactacagcgtgcctgaggaggccaagcacggcacctttgtgggccgcatcgcccaggacctgggcctggagctggccgagctggtgcccaggctcttccgggtggccagcaagaggcaccgggacctgctggaggtgtccctgcagaatggcatcctgtttgtgaacagcagaattgaccgggaggagctgtgtggccgctctgcagaatgttccatccacctggaggtgattgtggaccggcccctgcaggtgttccacgtggatgtggaggtgaaggatgtgaatgacaacccccctgtgttccgggtgaaggaccagaagctgtttgtgtctgagagcaggatgccagacagccgcttccccctggagggcgccagtgatgctgatgtgggcgccaacagcgtgctgacctaccgcctgagcagccatgactacttcatgctggatgtgaacagcaagaatgatgagaacaagctggtggagctggtgctgaggaagagcctggacagagaagatgccccagcccaccacctgttcctgacagccacagatggcggcaagccagagctgactggaacagtgcagctgctggtgacagtgctggatgtgaatgacaatgcccccacctttgagcagagtgaatatgaggtgcgcatctttgaaaatgctgacaatggcaccaccgtcatcaagctgaatgccagtgaccctgatgagggcgccaacggggccatctcctacagcttcaacagcctggtggagaccatggtgattgaccacttcagcattgacagaaatactggagagatcgtcatccggggcaacctggactttgagcaggagaacctgtacaagatcctgattgatgccacagacaagggccacccccccatggccggccactgcaccgtgctggtgcgcatcctggacaagaatgacaacgtgcctgagatcgccctgaccagcctgagcctgcctgtgagagaagatgcccagtttggaacagtgattgccctgatctctgtgaatgacctggacagcggggccaacggccaggtgacctgcagcctgatgccccacgtgcccttcaagctggtgtccaccttcaagaactactacagcctggtgctggacagcgccctggaccgggagcgggtgtctgcctatgagctggtggtgacagccagagatggcggcagccccagcctgtgggccacagccagcctgtctgtggaggtggctgatgtgaatgacaatgccccagcctttgcccagcctgagtacacagtgtttgtgaaggagaacaaccccccaggctgccacatcttcaccgtgtctgccagagatgctgatgcccaggagaatgccctggtgtcctacagcctggtggagaggagagtgggggagaggagcctgagcagctacatctctgtgcacacagagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctggagccccgggtgggcggcactggaggagctgccagcaagctggtgcccaggtctgtgggcgccggccacgtggtggccaaggtgcgggctgtggatgctgacagcggctacaatgcctggctgtcctatgagctgcagcctgctgccagcagcccccgcatccccttccgggtgggcctgtacaccggggagatcagcaccaccagggtgctggatgaggccgacagccccaggcaccggctgctggtgctggtgaaggaccacggggagcccgccctgacagccacagccaccgtgctggtgtccctggtggagagcggccaggcccccaaggccagcagccggcagagcgctggggtgctgggccctgaggccgccctggtggatgtgaatgtgtacctgatcatcgccatctgtgctgtgagcagcctgctggtgctgaccctgctgctgtacacagccctgcgctgcagcgccctgcccacagagggcggctgccgggccggcaagcccaccctggtgtgcagcagcgctgtgggctcctggagctacagccagcagcagccccagagggtgtgcagcggggagggcccccccaagacagacctgatggccttcagcccctgcctgcccccagacctgggctctgtggatgtgggggaggagcaggacctgaatgtggaccacggcctgaagccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166511 - DNA, 2529 bp, Artificial Sequence
  Description of Artificial Sequence: Synthetic coding sequence
atgctgtacagcagcagaggagaccctgagggccagcccctgctgctgagcctgctgatcctggccatgtgggtggtgggcagcggccagctgcactacagcgtgcctgaggaggccgagcacggcacctttgtgggccgcatcgcccaggacctgggcctggagctggccgagctggtgcccaggctcttccagctggacagcaagggccgcggggacctgctggaggtgaacctgcagaatggcatcctgtttgtgaacagcagaattgaccgggaggagctgtgtggccgctctgcagaatgttccatccacctggaggtgattgtggaccggcccctgcaggtgttccacgtggatgtggaggtgaaggacatcaatgacaacccccctgtgtttcctgccacccagaagaacctcttcatcgccgagagccggcccctggacagccgcttccccctggagggcgccagtgatgctgacatcggggagaatgccctgctgacctaccgcctgagccccaatgagtacttcttcctggatgtgcccaccagcaaccagcaggtgaagcccctgggcctggtgctgaggaagctgctggaccgggaggagaccccagagctgcacctgctgctgacagccacagatggcggcaagccagagctgactggaacagtgcagctgctgatcaccgtgctggacaacaatgacaatgcccctgtgtttgacaggaccctgtacacagtgaagctgcctgaaaatgtgtccatcggcaccctggtgatccaccccaatgccagtgacctggatgagggcctgaatggagacatcatctacagcttcagcagtgatgtgtccccagacatcaagagcaagttccacatggaccccctgagcggggccatcaccgtgattggccacatggactttgaggagagccgggcccacaagatccctgtggaggccgtggacaagggcttcccccccctggccggccactgcaccctgctggtggaggtggtggatgtgaatgacaatgccccccagctgaccatcaagaccctgtctgtgcctgtgaaggaggatgcccagctgggcaccgtgattgccctgatctctgtgattgacctggatgctgatgccaacggccaggtgacctgcagcctgaccccccacgtgcccttcaagctggtgtccacctacaagaactactacagcctggtgctggaccgggccctggaccgggagagcgtgtctgcctatgagctggtggtgacagccagagatggcggcagccccagcctgtgggccacagcccgggtgtctgtggaggtggctgatgtgaatgacaatgccccagcctttgcccagagcgagtacacagtgtttgtgaaggagaacaaccccccaggctgccacatcttcaccgtgtctgccagagatgctgatgcccaggagaatgccctggtgtcctacagcctggtggagcggcggctgggggagaggagcctgagcagctatgtgtctgtgcacgccgagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctgacccccaggatgaggggcacagatggagctgtgtctgagatggtgctgcggtctgtgggcgccggcgtggtggtgggcaaggtgcgggctgtggatgctgacagcggctacaatgcctggctgtcctatgagctgcagcctgagacagccagcgccagcatccccttccgggtgggcctgtacaccggggagatcagcaccacccgggccctggatgaaacagatgccccccggcagaggctgctggtgctggtgaaggaccacggggagcccgccctgacagccacagccaccgtgctggtgtccctggtggagagcggccaggcccccaagagcagcagccgggcctctgtgggcgccactggacctgaggtgaccctggtggatgtgaatgtgtacctgatcatcgccatctgtgctgtgagcagcctgctggtgctgaccctgctgctgtacacagtgctgcgctgcagcgccatgcccacagaaggagaatgtgcccctgggaagcccaccctggtgtgcagcagcgctgtgggctcctggagctacagccagcagaggcggcagagggtgtgcagcggggagggcaagcagaagacagacctgatggccttcagccctggcctgagcccctgtgccggcagcacagagaggactggagagcccagcgccagcagtgacagcacaggcaaggtgggcttcagcagcatcctcttcatctacatcatcttcttcctggagcgctactaccgcctgctgcctggagctgtgcagatcgtgctcttcatcttcctggagatccagcagatcttcttcctgatcaagtag

SEQ ID NO: 166512 - DNA, 2853 bp, Artificial Sequence
  Description of Artificial Sequence: Synthetic coding sequence
atgctgtacagcagcagaggagaccctgagggccagcccctgctgctgagcctgctgatcctggccatgtgggtggtgggcagcggccagctgcactacagcgtgcctgaggaggccgagcacggcacctttgtgggccgcatcgcccaggacctgggcctggagctggccgagctggtgcccaggctcttccagctggacagcaagggccgcggggacctgctggaggtgaacctgcagaatggcatcctgtttgtgaacagcagaattgaccgggaggagctgtgtggccgctctgcagaatgttccatccacctggaggtgattgtggaccggcccctgcaggtgttccacgtggatgtggaggtgaaggacatcaatgacaacccccctgtgtttcctgccacccagaagaacctcttcatcgccgagagccggcccctggacagccgcttccccctggagggcgccagtgatgctgacatcggggagaatgccctgctgacctaccgcctgagccccaatgagtacttcttcctggatgtgcccaccagcaaccagcaggtgaagcccctgggcctggtgctgaggaagctgctggaccgggaggagaccccagagctgcacctgctgctgacagccacagatggcggcaagccagagctgactggaacagtgcagctgctgatcaccgtgctggacaacaatgacaatgcccctgtgtttgacaggaccctgtacacagtgaagctgcctgaaaatgtgtccatcggcaccctggtgatccaccccaatgccagtgacctggatgagggcctgaatggagacatcatctacagcttcagcagtgatgtgtccccagacatcaagagcaagttccacatggaccccctgagcggggccatcaccgtgattggccacatggactttgaggagagccgggcccacaagatccctgtggaggccgtggacaagggcttcccccccctggccggccactgcaccctgctggtggaggtggtggatgtgaatgacaatgccccccagctgaccatcaagaccctgtctgtgcctgtgaaggaggatgcccagctgggcaccgtgattgccctgatctctgtgattgacctggatgctgatgccaacggccaggtgacctgcagcctgaccccccacgtgcccttcaagctggtgtccacctacaagaactactacagcctggtgctggaccgggccctggaccgggagagcgtgtctgcctatgagctggtggtgacagccagagatggcggcagccccagcctgtgggccacagcccgggtgtctgtggaggtggctgatgtgaatgacaatgccccagcctttgcccagagcgagtacacagtgtttgtgaaggagaacaaccccccaggctgccacatcttcaccgtgtctgccagagatgctgatgcccaggagaatgccctggtgtcctacagcctggtggagcggcggctgggggagaggagcctgagcagctatgtgtctgtgcacgccgagagcggcaaggtgtatgccctgcagcccctggaccacgaggagctggagctgctgcagttccaggtgtctgccagagatgctggggtgccccccctgggcagcaatgtgaccctgcaggtgtttgtgctggatgaaaatgacaatgccccagccctgctgacccccaggatgaggggcacagatggagctgtgtctgagatggtgctgcggtctgtgggcgccggcgtggtggtgggcaaggtgcgggctgtggatgctgacagcggctacaatgcctggctgtcctatgagctgcagcctgagacagccagcgccagcatccccttccgggtgggcctgtacaccggggagatcagcaccacccgggccctggatgaaacagatgccccccggcagaggctgctggtgctggtgaaggaccacggggagcccgccctgacagccacagccaccgtgctggtgtccctggtggagagcggccaggcccccaagagcagcagccgggcctctgtgggcgccactggacctgaggtgaccctggtggatgtgaatgtgtacctgatcatcgccatctgtgctgtgagcagcctgctggtgctgaccctgctgctgtacacagtgctgcgctgcagcgccatgcccacagaaggagaatgtgcccctgggaagcccaccctggtgtgcagcagcgctgtgggctcctggagctacagccagcagaggcggcagagggtgtgcagcggggagggcaagcagaagacagacctgatggccttcagccctggcctgagcccctgtgccggcagcacagagaggactggagagcccagcgccagcagtgacagcacaggcaagccccggcagcccaacccagactggagatacagcgccagcctgcgggccggcatgcacagctctgtgcacctggaggaggccggcatcctgcgggccggccctgggggccctgaccagcagtggcccaccgtgagcagcgccaccccagagcctgaggccggggaggtgagcccccctgtgggcgctggggtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166513 - DNA, 2892 bp, Artificial Sequence
  Description of Artificial Sequence: Synthetic coding sequence
atggtgggctgcggcgtggccgtgctgtgcctgtgggtgtcctgtggggctgctgctggccagctggagtacagcgtgcctgaggagacagagcggggcgtggccgtgggcaacctgtctgctgacctgcggctgcctgctgctgccatgagcagcaggaacttccgcttcctgagcagccaccgggagctgtactttggagtggacctgcccagcggcaacctggtggtgcgggagcctgctgaccgggagcagctgtgccgggccaaggccgcctgtgtgctgacctatgacctggtgctggaggaccccctggagctgcacaagatccgcatccacgtgctggacaccaatgacaacagccccctcttccctgctggagatgtgcagctgcacatccctgagttcctgacccctggggcccgcttcaccctgcccaatgcccaggatgatgatgagggcagcaatggcatcctgagctacagcctgagccccagccagcacttccggctggacatgggcagccgggtggatggcagcgagtacccagagctggtgctggagaaggccctggaccgggagcagagggccacccacctgctggtgctgacagccagagatggcggcctgcctgcccggtctggagatgcccaggtgaccatcatcgtggtggacaccaatgacaatgcccctgtgtttgagaggtctgtgtaccgcaccaaggtgcctgagacagcccccaacggcaccgtgctcttccgggtgcaggccctggaccctgatgagggcagcaatggagaggtgcagtacagcctgagcaacagcacccaggccgagctgcggcaccgcttccacgtgcaccccaagagcggggaggtgcaggtggccgccagcctgggccccccagagaccctgctggaggcctacatcgaggccagagatgagggcgtgtttggcctggccagcacagccaagctgctggtggaggtgacagatgtgaatgaccacgcccctgagctggacttcctgaccctgagcaaccctgtgcctgaagatgctgcccctggcaccgtgattgccctcttctctgtgaaggatgaggacctggacagcaatggccgggtcatctgtggcatgagcagcgctggccccttccagctgacagccagctttgacaactactacagcctgctgattgatggccccctggaccgggagcagatcagcgagtaccaggtgctgatcacagccagtgacagcggcagcccccccctgagcaccaggaggaccatcaccgtgtctgtggctgatgtgaatgacaacacccccaacttcccccagccccagcaggagctgtttgtggccgagaacaacggccctggggccagcctgggccgggtgtttgcccaggaccctgacctgggcaagaatggcctggtgtcctatgagctgctggatgtgatcagcgagggccccagcgccagcagcctgctggccgtggagagcagcagcggggccatcacagccaagaccagctttgattttgagcagctgcggggcttccacttccaggtggagggcagagatggcggcatccccccaagaagtgccaccgtgaccatcaacctgtttgtggtggacagaaatgacaactaccctgtgatcctcttccccctgcccagaaatggatctgtgcctgtggagatcgtgcccaggtctgccaggacaggccacctggtgaccaaggtggtggccgaggatgctgacagcggcagcaatgcctggctgagctaccacatcagccgggccagtgacagcagcctcttccgcatcagcgccaacattggagagctgaggacagcccggctggtgctgcccacagatgctgtgaagcagagggtggtggtggtggtgcgggaccatggagacccccccctgagcagctctgtgaccctgggcgtgctgctgagcaacagcgtgccccagctgctgcctgactttgaagatgtgtgggagcccggcggccagctgagcgcccagaacctgtacctggtgattgccctggcctgcatctccttcctgttcctgggctgcctgctcttctttgtgtgcaccaagctgcaccagagccctggctgctgtgcccagagctgctgccgcagcacagaggacctgcgctatggcagcaagatggtgagcaacccctgcatgaccagcgccaccattgatgtgaccaccgtggagcggctgagccagacctacctgtaccgggccagcctgggcctgggcagtgacaacaacagcctgctgctgcggggggagtacaatgctgctgacctgaggaacctggccactggagtgggcctgaacctgcccatcagctgcatccagatccggaacaggaagggggaccacgccaacgtgaatgccatgccccggcagcccaacccagactggagatacagcgccagcctgcgggccggcatgcacagctctgtgcacctggaggaggccggcatcctgcgggccggccctgggggccctgaccagcagtggcccaccgtgtcctctgccaccccagagcctgaggccggggaggtgtccccacctgtgggcgccggcgtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166514 - DNA, 2457 bp, Artificial Sequence
  Description of Artificial Sequence: Synthetic coding sequence
atggtgggctgcggcgtggccgtgctgtgcctgtgggtgtcctgtggggctgctgctggccagctggagtacagcgtgcctgaggagacagagcggggcgtggccgtgggcaacctgtctgctgacctgcggctgcctgctgctgccatgagcagcaggaacttccgcttcctgagcagccaccgggagctgtactttggagtggacctgcccagcggcaacctggtggtgcgggagcctgctgaccgggagcagctgtgccgggccaaggccgcctgtgtgctgacctatgacctggtgctggaggaccccctggagctgcacaagatccgcatccacgtgctggacaccaatgacaacagccccctcttccctgctggagatgtgcagctgcacatccctgagttcctgacccctggggcccgcttcaccctgcccaatgcccaggatgatgatgagggcagcaatggcatcctgagctacagcctgagccccagccagcacttccggctggacatgggcagccgggtggatggcagcgagtacccagagctggtgctggagaaggccctggaccgggagcagagggccacccacctgctggtgctgacagccagagatggcggcctgcctgcccggtctggagatgcccaggtgaccatcatcgtggtggacaccaatgacaatgcccctgtgtttgagaggtctgtgtaccgcaccaaggtgcctgagacagcccccaacggcaccgtgctcttccgggtgcaggccctggaccctgatgagggcagcaatggagaggtgcagtacagcctgagcaacagcacccaggccgagctgcggcaccgcttccacgtgcaccccaagagcggggaggtgcaggtggccgccagcctgggccccccagagaccctgctggaggcctacatcgaggccagagatgagggcgtgtttggcctggccagcacagccaagctgctggtggaggtgacagatgtgaatgaccacgcccctgagctggacttcctgaccctgagcaaccctgtgcctgaagatgctgcccctggcaccgtgattgccctcttctctgtgaaggatgaggacctggacagcaatggccgggtcatctgtggcatgagcagcgctggccccttccagctgacagccagctttgacaactactacagcctgctgattgatggccccctggaccgggagcagatcagcgagtaccaggtgctgatcacagccagtgacagcggcagcccccccctgagcaccaggaggaccatcaccgtgtctgtggctgatgtgaatgacaacacccccaacttcccccagccccagcaggagctgtttgtggccgagaacaacggccctggggccagcctgggccgggtgtttgcccaggaccctgacctgggcaagaatggcctggtgtcctatgagctgctggatgtgatcagcgagggccccagcgccagcagcctgctggccgtggagagcagcagcggggccatcacagccaagaccagctttgattttgagcagctgcggggcttccacttccaggtggagggcagagatggcggcatccccccaagaagtgccaccgtgaccatcaacctgtttgtggtggacagaaatgacaactaccctgtgatcctcttccccctgcccagaaatggatctgtgcctgtggagatcgtgcccaggtctgccaggacaggccacctggtgaccaaggtggtggccgaggatgctgacagcggcagcaatgcctggctgagctaccacatcagccgggccagtgacagcagcctcttccgcatcagcgccaacattggagagctgaggacagcccggctggtgctgcccacagatgctgtgaagcagagggtggtggtggtggtgcgggaccatggagacccccccctgagcagctctgtgaccctgggcgtgctgctgagcaacagcgtgccccagctgctgcctgactttgaagatgtgtgggagcccggcggccagctgagcgcccagaacctgtacctggtgattgccctggcctgcatctccttcctgttcctgggctgcctgctcttctttgtgtgcaccaagctgcaccagagccctggctgctgtgcccagagctgctgccgcagcacagaggacctgcgctatggcagcaagatggtgagcaacccctgcatgaccagcgccaccattgatgtgaccaccgtggagcggctgagccagacctacctgtaccgggccagcctgggcctgggcagtgacaacaacagcctgctgctgcggggggagtacaatgctgctgacctgaggaacctggccactggagtgggcctgaacctgcccatcagctgcatccagatccggaacaggaagggggaccacgccaacgtgaatgccatggtgtccaagttctacggcatctag

SEQ ID NO: 166515 - DNA, 3024 bp, Artificial Sequence
  Description of Artificial Sequence: Synthetic coding sequence
atggagcaggccggcaccaggcctgctgccacagagcacccccggctgcggcggcccatgccctggctgctgctgctgcccctgctgctgctgctgctgctgctgctgcccggccctgctgccagccagctgcgctacagcgtgcctgaggagcaggcccctggggccctggtgggcaatgtggcccgggccctgggcctggagctgcggcggctgggccctggctgcctgcgcatcaaccacctgggcgcccccagcccccgctacctggagctggacctgaccagcggggccctgtttgtgaatgaaagaattgaccgggaggccctgtgtgagcagaggccccgctgcctgctgagcctggaggtgctggcccacaaccctgtggccgtgtctgctgtggaggtggagatcctggacatcaatgacaacagcccccgcttcccccggcccaactaccagctgcaggtgtctgagagcgtggcccctggggcccgcttccacattgaaagtgcccaggaccctgatgtgggcgccaacagcgtgcagacctatgagctgagccccagcgagcactttgagctggacctgaagcccctgcaggagaacagcaaggtgctggagctggtgctgaggaagggcctggaccgggagcaggccgccctgcaccacctggtgctgacagctgtggatggcggcatcccagcccggagcggcacagcccagatctctgtgcgggtgctggacaccaatgacaacagccctgcctttgaccagagcacctacagagtgcagctgcgggaggacagccccccaggcaccctggtggtgaagctgaatgccagtgaccctgatgagggcagcaatggagagctgcgctacagcctgagcagctacaccagtgaccgggagcggcagctgttcagcattgatgccagcactggagaggtgcgggtcatcggcggcctggactatgaggaggccagcagctaccagatctacgtgcaggccacagaccggggccctgtgcccatggccggccactgcaaggtgctggtggacatcgtggatgtgaatgacaatgcccctgaggtggtgctgacagacctgtacagccctgtgcctgaaaatgccacccccaacaccatcgtggccgtgctgtctgtgaatgaccaggacagcggccccaacaggaaggtgtccctgggcctggaggccaccctgcccttccggctgaatggatttggaaacagctacaccctggtggtgtctggccccctggaccgggagcgggtggccgtgtacaacatcaccgtgacagccacagatggcggcatcccccagctgaccagcctgcggaccctgaaggtggagatcagtgacatcaatgacaacccccccagcttcctggaggacagctacagcatctacatccaggagaacaacctgcccggggtgctgctgtgcaccgtgcaggccacagatcctgatgagaaggaaaatgctgaggtgacctacagcctgctggagcgggagatccagggcctgcctgtgaccagctatgtgtccatcaacagcgccagcggcagcctgtatgctgtgaacagctttgattatgagaagttccgggagttctttgtgacagtggaggcccaggacaagggcagcccccccctgagcagcacagtgacagccaacgtgtatgtggtggacatgaatgaccacgccccccacatcctgtaccccaccagcaccaacagcagcgctgcctttgagatggtgcccaggacagccccagctggctacctggtgaccaaggtgattgccatggacagcgacagcggccagaatgcctggctgttctaccacctggcccagaccagtgacctggacctcttcaaggtggagctgcacactggagagatccgcaccaccaggaagatgggagatgagagcggcagcaccttcaacctgactgtggtggtgcgggacaatggagagcccagcctgagcgcctctgtggccatcaccgtggccgtggtggacagagtgtccaagatcctgcctgacacccagagacatgtgaagagccccaggacctacagcgagatcaccctgtacctgatcatcgccctgagcacagtgtccttcatcttcctgctgaccatcatcatcctgagcatcatcaagtgctaccgctacacagcctatggaacagcctgctgcggcggcttctgtggggtgcgggagaggagccctgctgagctgtacaagcaggccaacaacaacattgatgcccgcatcccccacggcctgaaggtgcagccccacttcatcgaggtgagaggaaatggcagcctgaccaagacctactgctacaaggcctgcctgacagctggcagcggcagtgacaccttcatgttctacaacacaggagcccagacaggccctggccccagcggggcccaggccgctgtgacagacagcaggaacctgaccggccagagcggccagaatgccggcaacctgatcatcctgaagaatgaggccgtgtcccagaatgagccccggcagcccaacccagactggagatacagcgccagcctgcgggccggcatgcacagctctgtgcacctggaggaggccggcatcctgcgggccggccctgggggccctgaccagcagtggcccaccgtgtcctctgccaccccagagcctgaggccggggaggtgtccccacctgtgggcgccggcgtgaacagcaacagctggaccttcaagtatggccctggcaaccccaagcagagcggccctggagagctgcctgacaagttcatcatccctggcagccctgccatcatcagcatccggcaggagcccaccaacagccagattgacaagagtgacttcatcaccttcggcaagaaggaggagaccaagaagaagaagaagaagaagaagggcaacaagacccaggagaagaaggagaagggcaacagcaccacagacaacagcgaccagtag

SEQ ID NO: 166516 - DNA, 2457 bp, Artificial Sequence
  Description of Artificial Sequence: Synthetic coding sequence
atggccggcaccaggaggaagagcctgcagaaccggcaggtgggcagcctgctgatcttcctgtgcatctctgtgggagatgccaccaccatccgctacagcgtggccgaggagatggagagcggcagctttgtggccaacgtggccaaggacctgggcctggaggtgggcaagctggccgcccggggggcccggctggtgtctgagggcaacaagatgcacttccggctgcacaggaagacaggagacctgtttgtgaaggagaagctggaccgggagagcctgtgtgggaaggctgacccctgtgtgctgcactttgaggtggtgctggtggagcccctgcagagcttccgggcagaggtgcgggtgtttgacatcaatgacaatgcccctgtgttcctgaacaaggagcccctgctgaagatccctgagagcacccccctgggcagccgcttccccctgcagagcgcccaggacctggatgtgggcctgaatggcctgcagaactacaccctgagcgccaacggctacttccacctgcacacccgcttctgcagccacggccccaagtatgcagagctggtgctgaacaagcccctggaccgggaggagcagcctgaggtgaacctgaccatcacagctgtggatggcggcagcccccccaagtctggaacagcccacatccacgtggtggtgctggatgtgaatgaccacgtgccccagttcagccggctggtgtaccgggcccaggtgtctgagaacagccccaacggcagcctggtggccaccgtgacagctgtggacctggatgagggcaccaacaaggccatcacctacagcctggcccagaaccctgaggccatcctgaagaccttccagattgacccccagaatggagaggtgcggctgcggggccccctggactttgaggccatcgagacctatgacatcgacatccaggccacagatggcggcggcctgagcgcccacagcaaggtgctggtggaggtggtggatgtgaatgacaaccccccagaggtgatggtgtcctctgtgagcagccccctgcctgaggacagccccccccagacagtggtggccctcttcaccatccgggaccgggacatccgggtgggcggcaaggtgacctgcttcctgcgggaggacctgcccttcgtcatcaagcccaccttcggcaacagctacagcctggtgacagacaggagcctggaccgggaggaggtgtctggctacaacatcaccatcgtggccatggacaccggcccccccagcctgtctgctgagaccatgattgaggtgctgatcagtgatgtgaatgacaacccccccatcttccgggaggacagctacatcctgactgtgcgggagaacaacagccctgctgtgttcatcggcaaggtgcatgctgaggacctggacctgggagaaaatgcccagatcacctacagcctgctgccccccaagaatggagacctgtctgtgtttgcctacatcagcatcaacagcggaaatggcaagctgtatgccctgcggaccatggactatgaggccatccaggacttccagtttgtggtgaaggccacagatggcggcttcctgagcctgagcagccaggtgacagtgcgggtggtggtgctggatgacaatgacaaccggcccatgatcctgtaccccctgcagaatggcaccctgccctgcaatgacctggtgcccaggtctgctgaggccggctacctggtgaccaaggtggtggccgtggatggagacagcggccagaacagctggctgagctaccacctgctgaaggccacagacctgggcctcttctctgtgcagaggcagaatggagagatccacaccctgcggcagatcagcgagcgggaccccatgatgcagaagctgatcatcctggtgcaggaccacggccagcctgccctgagcaccaccgtgtccctgaacatcctgctggtggatggcttcagcgagccctacctgcagttccaggaccccaccaagcacagcaggaaggtgaaccccagcaccaagtacctggtgatcagcctggtgatcctgtccttcctgttcctgctgtctgtgattgtcatcttcatcatccacgtgtaccagaagatcaagtaccgggagaagttcaccatccaggagcacttctatgatgactgcaacttcagcaacaacctggtgcagggccagggcaatggcagcctgagccggccctgcccctatgagatgtgcagcgccactggaactggaaacagcgagttccgcttcctgaagcgcttcatgcccaacttccccttcccccacgccaccggggagatcaagatggaggccggcagcagcctgccccccaacagcgacaggaacaagagccagaggctggagggccatgaccaggtgtctgatgactacatgtag

SEQ ID NO: 166517 - DNA, 2394 bp, Artificial Sequence
  Description of Artificial Sequence: Synthetic coding sequence
atggagaaccagggcaccaggacccagcagatccggcaggtgctgctgctgtttgtgctgctgggcatgagccaggccggcagcgagacctggagcttctctgtggccgaggagatgcagagcggcagctttgtgggcaacctggccaaggacctgggcctgaaggtgcgggagctgagcagcagaggagcccgggtggtgtccaatgacaagaagcagaggctgcagctggacatcaacacaggagacctgctgctgtctgagaccctggaccgggaggagctgtgtggcagcattgagccctgtgtgctgcacctgcaggtgctgatgcagaaccccacccagttcctgcagatcgagctgcaggtgcgggacatcaatgaccacagccccatcttcagcgagaagcagatgctgctggagatccctgagaacagccctgtgggcgctgtgttcctgctggagagcgccaaggacctggatgtgggcatcaatgctgtgaagagctacaccatcagccccaacagccacttccacatcaagatgagggtcatcccagacaacaggaagtacccagagctggtgctggacaaggccctggactatgaggagctgcctgagctgtccttcatcctgagcgccctggatggcggcagcccccccaggtctggaacagccctggtgcgggtggtggtggtggacatcaatgacaacagccctgagtttgagcaggccttctatgaggtgaagatcagagaaaattccatcctgggcagcctcatcctgattgtgtctgcctgggacctggacagcggcaccaacggggagatctgctacaccttcagccacgccagcgaggacatcaggaagacctttgagatcaaccagaagagcggggagatcaccctgcgggcccccctggactttgagaccatcgagagctacagcatcatcatccaggccacagatggcggcggcctgtttgggaagagcaccgtcatcatccacgtgattgatgtgaatgacaatgcccctgagatcaccgtgagcagcatcaccagccccatccctgagaacaccccagagaccgtggtgatggtgttcagcatccaggacattgattctggggacaatggaagaattgtgtgcagcatccctgaggacctgccctttgtgctgaagagctctgtggagaactactacaccctggagacagagcggcccctggaccgggagagcacagctgagtacaacatcaccatcaccgtgacagacctgggcatcccccggctgaagacagagcacaacaccaccgtgctggtgtctgatgtgaatgacaatgcccccaccttcacccagaccagctacaccctgtttgtgcgggagaacaacagccctgccctgcacatcggctctgtgtctgccacagaccgggacagcggcaccaatgcccaggtgaactacagcctgctgcccccccaggacctgcacctgcccctggccagcctggtgtccatcaacacagacaatggccacctgtttgccctgcggagcctggactatgaggccctgcaggcctttgacttccgggtgggcgccacagaccggggcagccctgccctgagcagcgaggccctggtgcgggtgctggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagcccggcctgtttggagtgtgggcccacaatggagaggtgaggacagcccggctgctgtctgaaagagatgctgccaagcaccggctggtggtgctggtgaaggacaatggagagccccccaggtctgccacagccaccctgcaggtgctgctggtggatggcttcagccagccctacctgcccctgcctgaggccgccccagcccaggcccaggccgacagcctgactgtgtacctggtggtggccctggcctctgtgagcagcctcttcctgttctctgtgctgctgtttgtggccgtgcggctgtgcagaagaagcagagctgcctctgtgggcagctgcagcgtgcccaagggccccttccctggccacctggtggatgtgtctggcaccggcaccctgagccagagctaccagtatgaggtgtgcctgaccggcggcagcgagaccaatgagttcaagttcctgaagcctgtgatccccaacatccaggccaagggcctgggcaagaacagcgaggagaacagcaccttcaggaacagctttggcttcaacttctag

SEQ ID NO: 166518 - DNA, 1299 bp, Artificial Sequence
  Description of Artificial Sequence: Synthetic coding sequence
atggtgttcagcatccaggacatcgacagcggggacaatggccgcatcgtgtgcagcatccctgaggacctgccctttgtgctgaagagctctgtggagaactactacaccctggagacagagcggcccctggaccgggagagcacagctgagtacaacatcaccatcaccgtgacagacctgggcatcccccggctgaagacagagcacaacaccaccgtgctggtgtctgatgtgaatgacaatgcccccaccttcacccagaccagctacaccctgtttgtgcgggagaacaacagccctgccctgcacatcggctctgtgtctgccacagaccgggacagcggcaccaatgcccaggtgaactacagcctgctgcccccccaggacctgcacctgcccctggccagcctggtgtccatcaacacagacaatggccacctgtttgccctgcggagcctggactatgaggccctgcaggcctttgacttccgggtgggcgccacagaccggggcagccctgccctgagcagcgaggccctggtgcgggtgctggtgctggatgccaatgacaacagcccctttgtgctgtaccccctgcagaatggcagcgccccctgcacagagctggtgcccagggctgctgagcccggctacctggtgaccaaggtggtggccgtggatggagacagcggccagaatgcctggctgagctaccagctgctgaaggccacagagcccggcctgtttggagtgtgggcccacaacggggaggtgaggacagcccggctgctgtctgaaagagatgctgccaagcaccggctggtggtgctggtgaaggacaacggggagcccccaagaagtgccacagccaccctgcaggtgctgctggtggatggcttcagccagccctacctgcccctgcctgaggccgccccagcccaggcccaggccgacagcctgactgtgtacctggtggtggccctggcctctgtgagcagcctcttcctgttctctgtgctgctgtttgtggccgtgcggctgtgccgccgcagccgggccgcctctgtgggcagctgcagcgtgcccaagggccccttccctggccacctggtggatgtgtctggaacaggcaccctgagccagagctaccagtatgaggtgtgcctgactggaggcagcgagaccaatgagttcaagttcctgaagcctgtgatccccaacatccaggccaagggcctgggcaagaacagcgaggagaacagcaccttcagaaattcctttggcttcaacttctag

SEQ ID NO: 166519 - DNA, 399 bp, Artificial Sequence
  Description of Artificial Sequence: Synthetic coding sequence
accatcgagagctacagcatcatcatccaggccacagatggcggcggcctgtttgggaagagcaccgtcatcatccacgtgattgatgtgaatgacaatgcccctgagatcaccgtgagcagcatcaccagccccatccctgagaacaccccagagaccgtggtgatggtgttcagcatccaggacattgatggcaccacagaggagctgtttgtgcccttcaggaagaccagccacgtgctgaagagctctgtggagaactactacaccctggagacagagcggcccctggaccgggagagcacagctgagtacaacatcaccatcaccgtgacagacctgggcatcccccggctgaagacagagcacaacaccaccgtgctggtgtctgatgtgtag

SEQ ID NO: 166520 - DNA, 2388 bp, Artificial Sequence
  Description of Artificial Sequence: Synthetic coding sequence
atggagaatggaggagctggcaccctgcagatccggcaggtgctgctcttctttgtgctgctgggcatgagccaggccggcagcgagaccggcaacttcctggtgatggaggagctgcagagcggcagctttgtgggcaacctggccaagaccctgggcctggaggtgtctgagctgagcagcagaggagcccgggtggtgtccaatgacaacaaggaatgtctgcagctggacaccaacacaggagacctgctgctgcgggagatgctggaccgggaggagctgtgtggcagcaatgagccctgtgtgctgtacttccaggtgctgatgaagaaccccacccagttcctgcagatcgagctgcaggtgcgggacatcaatgaccacagccctgtgttcctggagaaggagatgctgctggagatccctgagaacagccctgtgggcgctgtgttcctgctggagagcgccaaggacctggatgtgggcatcaatgctgtgaagagctacaccatcaaccccaacagccacttccacgtgaagatccgggtgaacccagacaacaggaagtacccagagctggtgctggacaaggccctggactatgaggagaggcctgagctgtccttcatcctgacagccctggatggcggcagcccccccaggtctggaacagccctggtgcgggtggtggtggtggacatcaatgacaacagccctgagtttgagcaggccttctatgaggtgaagatcctggagaacagcatcctgggcagcctggtggtgacagtgtctgcctgggacctggacagcggcaccaacagcgagctgagctacaccttcagccacgccagcgaggacatcaggaagacctttgagatcaaccagaagagcggggacatcaccctgacagcccccctggactttgaggccatcgagagctacagcatcatcatccaggccacagatggcggcggcctgtttgggaagagcacagtgcgcatccaggtgatggatgtgaatgacaatgcccctgagatcaccgtgagcagcatcaccagccccatccctgagaacaccccagagaccgtggtgatggtgttccgcatccgggaccgggacagcggggacaacgggaagatggtgtgcagcatccctgaggacatcccctttgtgctgaagagctctgtgaacaactactacaccctggagacagagcggcccctggaccgggagagcagagctgagtacaacatcaccatcaccgtgacagacctgggcaccccccggctgaagacagagcacaacatcaccgtgctggtgtctgatgtgaatgacaatgccccagccttcacccagaccagctatgccctgtttgtgcgggagaacaacagccctgccctgcacatcggcagcatcagcgccacagaccgggacagcggcaccaatgcccaggtgaactacagcctgctgcccagccaggacccccacctgcccctggccagcctggtgtccatcaatgctgacaatggccacctgtttgccctgcggagcctggactatgaggccctgcagggcttccagttccgggtgggcgccacagaccacggcagccctgccctgagcagcgaggccctggtgcgggtgctggtgctggatgccaatgacaacagcccctttgtgctgtaccccctgcagaatggaagtgccccctgcacagagctggtgccctgggccgctgagcccggctacctggtgaccaaggtggtggccgtggatggagacagcggccagaatgcctggctgagctaccagctgctgaaggccacagagcccggcctgtttggagtgtgggcccacaatggagaggtgaggacagcccggctgctgtctgaaagagatgctgccaagcaccggctggtggtgctggtgaaggacaatggagagccccccaggtctgccacagccaccctgcacgtgctgctggtggatggcttcagccagccctacctgcccctgcctgaggccgccccagcccaggcccaggccgacagcctgactgtgtacctggtggtggccctggcctctgtgagcagcctcttcctgttctctgtgctgctgtttgtggccgtgcggctgtgcagaagaagcagagctgcccctgtgggccgctgcagcgtgcctgagggccccttccctggccacctggtggatgtgtctggcaccggcaccctgagccagagctaccactatgaggtgtgtgtgactggaggcagccgcagcaacaagttcaagttcctgaagcccatcatccccaacttcctgccccagagcactggaagtgaggtggaggagaacccccccttccagaacaacctgggcttctag

SEQ ID NO: 166521 - DNA, 1257 bp, Artificial Sequence
  Description of Artificial Sequence: Synthetic coding sequence
atggtgtgcagcatccctgaggacatcccctttgtgctgaagagctctgtgaacaactactacaccctggagacagagcggcccctggaccgggagagcagagctgagtacaacatcaccatcaccgtgacagacctgggcaccccccggctgaagacagagcacaacatcaccgtgctggtgtctgatgtgaatgacaatgccccagccttcacccagaccagctatgccctgtttgtgcgggagaacaacagccctgccctgcacatcggcagcatcagcgccacagaccgggacagcggcaccaatgcccaggtgaactacagcctgctgcccagccaggacccccacctgcccctggccagcctggtgtccatcaatgctgacaatggccacctgtttgccctgcggagcctggactatgaggccctgcagggcttccagttccgggtgggcgccacagaccacggcagccctgccctgagcagcgaggccctggtgcgggtgctggtgctggatgccaatgacaacagcccctttgtgctgtaccccctgcagaatggaagtgccccctgcacagagctggtgccctgggccgctgagcccggctacctggtgaccaaggtggtggccgtggatggagacagcggccagaatgcctggctgagctaccagctgctgaaggccacagagcccggcctgtttggagtgtgggcccacaatggagaggtgaggacagcccggctgctgtctgaaagagatgctgccaagcaccggctggtggtgctggtgaaggacaatggagagccccccaggtctgccacagccaccctgcacgtgctgctggtggatggcttcagccagccctacctgcccctgcctgaggccgccccagcccaggcccaggccgacagcctgactgtgtacctggtggtggccctggcctctgtgagcagcctcttcctgttctctgtgctgctgtttgtggccgtgcggctgtgcagaagaagcagagctgcccctgtgggccgctgcagcgtgcctgagggccccttccctggccacctggtggatgtgtctggcaccggcaccctgagccagagctaccactatgaggtgtgtgtgactggaggcagccgcagcaacaagttcaagttcctgaagcccatcatccccaacttcctgccccagagcactggaagtgaggtggaggagaacccccccttccagaacaacctgggcttctggatccagtag

SEQ ID NO: 166522 - DNA, 1377 bp, Artificial Sequence
  Description of Artificial Sequence: Synthetic coding sequence
atggatgtgaatgacaatgcccctgagatcaccgtgagcagcatcaccagccccatccctgagaacaccccagagaccgtggtgatggtgttccgcatccgggaccgggacagcggggacaatggcaagatggtgtgcagcatccctgaggacatcccctttgtgctgaagagctctgtgaacaactactacaccctggagacagagcggcccctggaccgggagagcagagctgagtacaacatcaccatcaccgtgacagacctgggcaccccccggctgaagacagagcacaacatcaccgtgctggtgtctgatgtgaatgacaatgccccagccttcacccagaccagctatgccctgtttgtgcgggagaacaacagccctgccctgcacatcggcagcatcagcgccacagaccgggacagcggcaccaatgcccaggtgaactacagcctgctgcccagccaggacccccacctgcccctggccagcctggtgtccatcaatgctgacaatggccacctgtttgccctgcggagcctggactatgaggccctgcagggcttccagttccgggtgggcgccacagaccacggcagccctgccctgagcagcgaggccctggtgcgggtgctggtgctggatgccaatgacaacagcccctttgtgctgtaccccctgcagaatggcagcgccccctgcacagagctggtgccctgggccgctgagcccggctacctggtgaccaaggtggtggccgtggatggagacagcggccagaatgcctggctgagctaccagctgctgaaggccacagagcccggcctgtttggagtgtgggcccacaacggggaggtgaggacagcccggctgctgtctgaaagagatgctgccaagcaccggctggtggtgctggtgaaggacaacggggagcccccaagaagtgccacagccaccctgcacgtgctgctggtggatggcttcagccagccctacctgcccctgcctgaggccgccccagcccaggcccaggccgacagcctgactgtgtacctggtggtggccctggcctctgtgagcagcctcttcctgttctctgtgctgctgtttgtggccgtgcggctgtgccgccgcagccgggccgcccctgtgggccgctgcagcgtgcctgagggccccttccctggccacctggtggatgtgtctggaacaggcaccctgagccagagctaccactatgaggtgtgtgtgactggaggcagccgcagcaacaagttcaagttcctgaagcccatcatccccaacttcctgccccagagcacaggcagcgaggtggaggagaacccccccttccagaacaacctgggcttctag

SEQ ID NO: 166523 - DNA, 2397 bp, Artificial Sequence
  Description of Artificial Sequence: Synthetic coding sequence
atggaggccagcggcaagctgatctgccggcagaggcaggtgctcttctccttcctgctgctgggcctgagcctggccggggctgctgagcccaggagctacagcgtggtggaggagacagagggcagcagctttgtgaccaacctggccaaggacctgggcctggagcagcgggagttcagccggcggggcgtgcgggtggtgtcccggggcaacaagctgcacctgcagctgaaccaggagacagctgacctgctgctgaatgagaagctggaccgggaggacctgtgtggccacacagagccctgtgtgctgcgcttccaggtgctgctggagagcccctttgagttcttccaggccgagctgcaggtgattgacatcaatgaccacagccctgtgttcctggacaagcagatgctggtgaaggtgtctgagagcagccccccaggcaccaccttccccctgaagaatgctgaggacctggatgtgggccagaacaacatcgagaactacatcatcagccccaacagctacttccgggtgctgaccaggaagagaagtgatggcaggaagtacccagagctggtgctggacaaggccctggaccgggaggaggaggccgagctgcggctgaccctgacagccctggatggcggcagccccccaagaagtggcacagcccaggtgtacatcgaggtgctggatgtgaatgacaatgcccctgagtttgagcagcccttctacagagtgcagatcagcgaggacagccctgtgggcttcctggtggtgaaggtgtctgccacagatgtggacaccggggtgaatggagagatctcctacagcctcttccaggccagcgaggagatcggcaagaccttcaagatcaaccccctgactggagaaattgagctgaagaagcagctggactttgagaagctgcagagctatgaggtgaacatcgaggccagagatgctggcaccttctctggaaaatgtactgtgctgatccaggtgattgatgtgaatgaccacgcccctgaggtgaccatgtctgccttcaccagccccatcccagaaaatgcccctgagaccgtggtggccctcttctctgtgtctgacctggacagcggggagaatggcaagatcagctgcagcatccaggaggacctgcccttcctgctgaagtctgctgagaacttctacaccctgctgacagagcggcccctggaccgggagagcagagctgagtacaacatcaccatcaccgtgacagacctgggcacccccatgctgatcacccagctgaacatgacagtgctgattgctgatgtgaatgacaatgccccagccttcacccagaccagctacaccctgtttgtgcgggagaacaacagccctgccctgcacatccgctctgtgtctgccacagaccgggacagcggcaccaatgcccaggtgacctacagcctgctgcccccccaggacccccacctgcccctgaccagcctggtgtccatcaatgctgacaatggccacctgtttgccctgcggagcctggactatgaggccctgcagggcttccagttccgggtgggcgccagtgaccacggcagccctgccctgagcagcgaggccctggtgcgggtggtggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagctgggcctgtttggagtgtgggcccacaatggagaggtgaggacagcccggctgctgtctgaaagagatgctgccaagcaccggctggtggtgctggtgaaggacaatggagagccccccaggtctgccacagccaccctgcacgtgctgctggtggatggcttcagccagccctacctgcccctgcctgaggccgcccccacccaggcccaggccgacctgctgactgtgtacctggtggtggccctggcctctgtgagcagcctcttcctgttctctgtgctgctgtttgtggccgtgcggctgtgcagaagaagcagagctgcctctgtgggccgctgcctggtgcctgagggccccctgcccggccacctggtggacatgagcggcaccaggaccctgagccagagctaccagtatgaggtgtgcctggccggcggcagcggcaccaatgagttcaagttcctgaagcccatcatccccaacttccccccccagtgccctgggaaggagatccagggcaacagcaccttccccaacaactttggcttcaacatccagtag

SEQ ID NO: 166524 - DNA, 2235 bp, Artificial Sequence
  Description of Artificial Sequence: Synthetic coding sequence
atggaggccagcggcaagctgatctgccggcagaggcaggtgctcttctccttcctgctgctgggcctgagcctggccggggctgctgagcccaggagctacagcgtggtggaggagacagagggcagcagctttgtgaccaacctggccaaggacctgggcctggagcagcgggagttcagccggcggggcgtgcgggtggtgtcccggggcaacaagctgcacctgcagctgaaccaggagacagctgacctgctgctgaatgagaagctggaccgggaggacctgtgtggccacacagagccctgtgtgctgcgcttccaggtgctgctggagagcccctttgagttcttccaggccgagctgcaggtgattgacatcaatgaccacagccctgtgttcctggacaagcagatgctggtgaaggtgtctgagagcagccccccaggcaccaccttccccctgaagaatgctgaggacctggatgtgggccagaacaacatcgagaactacatcatcagccccaacagctacttccgggtgctgaccaggaagagaagtgatggcaggaagtacccagagctggtgctggacaaggccctggaccgggaggaggaggccgagctgcggctgaccctgacagccctggatggcggcagccccccaagaagtggcacagcccaggtgtacatcgaggtgctggatgtgaatgacaatgcccctgagtttgagcagcccttctacagagtgcagatcagcgaggacagccctgtgggcttcctggtggtgaaggtgtctgccacagatgtggacaccggggtgaatggagagatctcctacagcctcttccaggccagcgaggagatcggcaagaccttcaagatcaaccccctgactggagaaattgagctgaagaagcagctggactttgagaagctgcagagctatgaggtgaacatcgaggccagagatgctggcaccttctctggaaaatgtactgtgctgatccaggtgattgatgtgaatgaccacgcccctgaggtgaccatgtctgccttcaccagccccatcccagaaaatgcccctgagaccgtggtggccctcttctctgtgtctgacctggacagcggggagaatggcaagatcagctgcagcatccaggaggacctgcccttcctgctgaagtctgctgagaacttctacaccctgctgacagagcggcccctggaccgggagagcagagctgagtacaacatcaccatcaccgtgacagacctgggcacccccatgctgatcacccagctgaacatgacagtgctgattgctgatgtgaatgacaatgccccagccttcacccagaccagctacaccctgtttgtgcgggagaacaacagccctgccctgcacatccgctctgtgtctgccacagaccgggacagcggcaccaatgcccaggtgacctacagcctgctgcccccccgggtggtggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagctgggcctgtttggagtgtgggcccacaatggagaggtgaggacagcccggctgctgtctgaaagagatgctgccaagcaccggctggtggtgctggtgaaggacaatggagagccccccaggtctgccacagccaccctgcacgtgctgctggtggatggcttcagccagccctacctgcccctgcctgaggccgcccccacccaggcccaggccgacctgctgactgtgtacctggtggtggccctggcctctgtgagcagcctcttcctgttctctgtgctgctgtttgtggccgtgcggctgtgcagaagaagcagagctgcctctgtgggccgctgcctggtgcctgagggccccctgcccggccacctggtggacatgagcggcaccaggaccctgagccagagctaccagtatgaggtgtgcctggccggcggcagcggcaccaatgagttcaagttcctgaagcccatcatccccaacttccccccccagtgccctgggaaggagatccagggcaacagcaccttccccaacaactttggcttcaacatccagtag

SEQ ID NO: 166525 - DNA, 2409 bp, Artificial Sequence
  Description of Artificial Sequence: Synthetic coding sequence
atggaggccagcggcaagctgatctgccggcagaggcaggtgctcttctccttcctgctgctgggcctgagcctggccggggctgctgagcccaggagctacagcgtggtggaggagacagagggcagcagctttgtgaccaacctggccaaggacctgggcctggagcagcgggagttcagccggcggggcgtgcgggtggtgtcccggggcaacaagctgcacctgcagctgaaccaggagacagctgacctgctgctgaatgagaagctggaccgggaggacctgtgtggccacacagagccctgtgtgctgcgcttccaggtgctgctggagagcccctttgagttcttccaggccgagctgcaggtgattgacatcaatgaccacagccctgtgttcctggacaagcagatgctggtgaaggtgtctgagagcagccccccaggcaccaccttccccctgaagaatgctgaggacctggatgtgggccagaacaacatcgagaactacatcatcagccccaacagctacttccgggtgctgaccaggaagagaagtgatggcaggaagtacccagagctggtgctggacaaggccctggaccgggaggaggaggccgagctgcggctgaccctgacagccctggatggcggcagccccccaagaagtggcacagcccaggtgtacatcgaggtgctggatgtgaatgacaatgcccctgagtttgagcagcccttctacagagtgcagatcagcgaggacagccctgtgggcttcctggtggtgaaggtgtctgccacagatgtggacaccggggtgaatggagagatctcctacagcctcttccaggccagcgaggagatcggcaagaccttcaagatcaaccccctgactggagaaattgagctgaagaagcagctggactttgagaagctgcagagctatgaggtgaacatcgaggccagagatgctggcaccttctctggaaaatgtactgtgctgatccaggtgattgatgtgaatgaccacgcccctgaggtgaccatgtctgccttcaccagccccatcccagaaaatgcccctgagaccgtggtggccctcttctctgtgtctgacctggacagcggggagaatggcaagatcagctgcagcatccaggaggacctgcccttcctgctgaagtctgctgagaacttctacaccctgctgacagagcggcccctggaccgggagagcagagctgagtacaacatcaccatcaccgtgacagacctgggcacccccatgctgatcacccagctgaacatgacagtgctgattgctgatgtgaatgacaatgccccagccttcacccagaccagctacaccctgtttgtgcgggagaacaacagccctgccctgcacatccgctctgtgtctgccacagaccgggacagcggcaccaatgcccaggtgacctacagcctgctgcccccccaggacccccacctgcccctgaccagcctggtgtccatcaatgctgacaatggccacctgtttgccctgcggagcctggactatgaggccctgcagggcttccagttccgggtgggcgccagtgaccacggcagccctgccctgagcagcgaggccctggtgcgggtggtggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagctgggcctgtttggagtgtgggcccacaatggagaggtgaggacagcccggctgctgtctgaaagagatgctgccaagcaccggctggtggtgctggtgaaggacaatggagagccccccaggtctgccacagccaccctgcacgtgctgctggtggatggcttcagccagccctacctgcccctgcctgaggccgcccccacccaggcccaggccgacctgctgactgtgtacctggtggtggccctggcctctgtgagcagcctcttcctgttctctgtgctgctgtttgtggccgtgcggctgtgcagaagaagcagagctgcctctgtgggccgctgcctggtgcctgagggccccctgcccggccacctggtggacatgagcggcaccaggaccctgagccagagctaccagtatgaggtgtgcctggccggcggcagcggcaccaatgagttcaagttcctgaagcccatcatccccaacttccccccccagtgccctgggaaggagatccagggcaacagcaccttccccaacctgtgtgtgtgcaacatcgtgcgcatctacagctag

SEQ ID NO: 166526 - DNA, 2397 bp, Artificial Sequence
  Description of Artificial Sequence: Synthetic coding sequence
atggagatccggggggccctggacctgaggaagaggcaggtgctgatcttcctggtgctgctgggcctgagccgggccggcacagagagcgcccactacagcgtggccgaggagacagaaattggcagctttgtggccaacctggcccgggacctgggcctgggcgtggaggagctgagcagccgggaggcccgggtggtgtctgatgacaacaagaagtacctgcacctggacctgctgactggaaacctgctgctgaatgagaagctggacagagatgagctgtgtggcagcacagagccctgtgtgctgcacttccaggtggtgctggagaaccccctgcagttcttccgctttgagctgtgtgtgaaggacatcaatgaccacagccccaccttcctggacaaggagatcctgatcaagatcagcgagggcaccaccgtgggcgccaccttcctgatggagagcgcccaggacctggatgtgggcagcaacagcctgcagaactacaccatcagccccaacagccacttctacatcaagatcccagacagcagtgacaggaagatctacccagagctggtgctggaccgggccctggactatgagcaggaggccgagctgcggctgaccctgacagctgtggatggcggcagcccccccaagagcggcaccaccctggtgctgatcaaggtgctggacatcaatgacaatgcccctgagttcccccagagcctgtatgaggtgcaggtgcctgaagatcggcccctgggctcctggatcgccaccatcagcgccaaggacctggatgctggcaactacggcaagatctcctacaccttcttccacgccagcgaggacatcaggaagacctttgagatcaaccccatcagcggggaggtgaacctgcggagccccctggactttgaagtcatccagagctacaccatcaacatccaggccacagatggcggcggcctgagcggcaagtgcaccctgctggtgaaggtgatggacatcaatgacaaccccccagaggtgaccatcagcagcatcaccaagagaattccagaaaatgccagcgagaccctggtggccctcttcagcatcctggaccaggacagcggggacaatggccgcatgatctgcagcatccaggacaacctgcccttcttcctgaagcccaccttcaagaacttcttcaccctggtgtctgagaaggccctggaccgggagagccaggccgagtacaacatcaccatcaccgtgacagacctgggcaccccccggctgaagacagagtacaacatcaccgtgctgctgagtgatgtgaatgacaatgcccccaccttcacccagaccagctacaccctgtttgtgcgggagaacaacagccctgccctgcacatcggctctgtgtctgccacagaccgggacagcggcaccaatgcccaggtgaactacagcctgctgcccccccaggacagacacctgcccctggccagcctggtgtccatcaatgctgacaatggccacctgtttgccctgcggagcctggactatgaggccctgcaggagtttgagttccgggtgggcgccacagaccggggcagccctgccctgagcagcgaggccctggtgcgggtgctggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagcccggcctgtttggagtgtgggcccacaatggagaggtgaggacagcccggctgctgtctgaaagagatgctgccaagcaccggctggtggtgctggtgaaggacaatggagagccccccaggtctgccacagccaccctgcacgtgctgctggtggatggcttcagccagccctacctgcccctgcctgaggccgccccagcccaggcccaggccgacagcctgactgtgtacctggtggtggccctggcctctgtgagcagcctcttcctgttctctgtgctgctgtttgtggccgtgcggctgtgcagaagaagcagagctgcctctgtgggccgctgcagcgtgcctgagggccccttccctggccacctggtggatgtgtctggcaccggcaccctgagccagagctaccagtatgaggtgtgcctgaccggcggcagcggcaccaatgagttcaagttcctgaagcccatcatccccaacttccaggtgcatgacacaggaagaaacatgggagaaattgagaacttcaggaacagctttggcctgaacatccagtag

SEQ ID NO: 166527 - DNA, 1938 bp, Artificial Sequence
  Description of Artificial Sequence: Synthetic coding sequence
atggagagcgcccaggacctggatgtgggcagcaacagcctgcagaactacaccatcagccccaacagccacttctacatcaagatcccagacagcagtgacaggaagatctacccagagctggtgctggaccgggccctggactatgagcaggaggccgagctgcggctgaccctgacagctgtggatggcggcagcccccccaagagcggcaccaccctggtgctgatcaaggtgctggacatcaatgacaatgcccctgagttcccccagagcctgtatgaggtgcaggtgcctgaggaccggcccctgggctcctggatcgccaccatcagcgccaaggacctggatgctggcaactacggcaagatctcctacaccttcttccacgccagcgaggacatcaggaagacctttgagatcaaccccatctctggagaggtgaacctgcggagccccctggactttgaggtgatccagagctacaccatcaacatccaggccacagatggcggcggcctgagcggcaagtgcaccctgctggtgaaggtgatggacatcaatgacaaccccccagaggtgaccatcagcagcatcaccaagaggatcccagaaaatgccagcgagaccctggtggccctcttcagcatcctggaccaggacagcggggacaatggaaggatgatctgcagcatccaggacaacctgcccttcttcctgaagcccaccttcaagaacttcttcaccctggtgtctgagaaggccctggaccgggagagccaggccgagtacaacatcaccatcaccgtgacagacctgggcaccccccggctgaagacagagtacaacatcaccgtgctgctgagtgatgtgaatgacaatgcccccaccttcacccagaccagctacaccctgtttgtgcgggagaacaacagccctgccctgcacatcggctctgtgtctgccacagaccgggacagcggcaccaatgcccaggtgaactacagcctgctgcccccccaggacagacacctgcccctggccagcctggtgtccatcaatgctgacaatggccacctgtttgccctgcggagcctggactatgaggccctgcaggagtttgagttccgggtgggcgccacagaccggggcagccctgccctgagcagcgaggccctggtgcgggtgctggtgctggatgccaatgacaacagcccctttgtgctgtaccccctgcagaatggcagcgccccctgcacagagctggtgcccagggctgctgagcccggctacctggtgaccaaggtggtggccgtggatggagacagcggccagaatgcctggctgagctaccagctgctgaaggccacagagcccggcctgtttggagtgtgggcccacaacggggaggtgaggacagcccggctgctgtctgaaagagatgctgccaagcaccggctggtggtgctggtgaaggacaacggggagcccccaagaagtgccacagccaccctgcacgtgctgctggtggatggcttcagccagccctacctgcccctgcctgaggccgccccagcccaggcccaggccgacagcctgactgtgtacctggtggtggccctggcctctgtgagcagcctcttcctgttctctgtgctgctgtttgtggccgtgcggctgtgccgccgcagccgggccgcctctgtgggccgctgcagcgtgcctgagggccccttccctggccacctggtggatgtgtctggaacaggcaccctgagccagagctaccagtatgaggtgtgcctgactggaggcagcggcaccaatgagttcaagttcctgaagcccatcatccccaacttccaggtgcatgacaccggcaggaacatgggagaaattgagaacttcagaaattcctttggcctgaacatccagtag

SEQ ID NO: 166528 - DNA, 2382 bp, Artificial Sequence
  Description of Artificial Sequence: Synthetic coding sequence
atggaggcccgggtggagagagctgtgcagaagaggcaggtgctcttcctgtgtgtgttcctgggcatgtcctgggccggggctgagcccctgcgctactttgtggccgaggagacagagcggggcaccttcctgaccaacctggccaaggacctgggcctgggcgtgggggagctgcgggcccggggcacccgcatcgtgtctgaccagaacatgcagatcctgctgctgagcagcctgactggagacctgctgctgaatgagaagctggaccgggaggagctgtgtggcccccgggagccctgtgtgctgcccttccagctgctgctggagaagcccttccagatcttccgggcagagctgtgggtgcgggacatcaatgaccacgcccctgtgttcctggaccgggagatcagcctgaagatcctggagagcaccacccctggggccgccttcctgctggagagcgcccaggacagtgatgtgggcaccaacagcctgagcaactacaccatcagccccaatgcctacttccacatcaacgtgcatgattctggagagggcaacatctacccagagctggtgctgaaccaggtgctggaccgggaggagatccctgagttcagcctgaccctgacagccctggatggcggcagcccccccaggtctggaacagccctggtgcgcatcctggtgctggatgtgaatgacaatgccccagactttgtgcgcagcctgtacaaggtgcaggtgcctgagaacagccctgtgggctccatggtggtgtctgtgtctgcccgggacctggacaccggcagcaatggagaaattgcctatgccttctcctatgccacagagcgcatcctgaagaccttccagatcaaccccaccagcggcagcctgcacctgaaggcccagctggactatgaggccatccagacctacaccctgaccatccaggccaaggatggcggcggcctgagcggcaagtgcaccgtggtggtggatgtgacagacatcaatgacaacagacctgagctgctgctgagcagcctgaccagccccatcgccgagaacagccctgagaccgtggtggccgtgttccgcatccgggaccgggacagcggcaacaacgggaagacagtgtgcagcatccaggatgatgtgcccttcatcctgaagcccagcgtggagaacttctacaccctggtgacagagaagcccctggaccgggagaggaacacagagtacaacatcaccatcaccgtgacagacctgggcaccccccggctgaagacagagcacaacatcaccgtgctggtgtctgatgtgaatgacaatgccccagccttcacccagaccagctacaccctgtttgtgcgggagaacaacagccctgccctgcccatcggctctgtgtctgccacagaccgggacagcggcaccaatgcccaggtgatctacagcctgctgcccagccaggacccccacctgcccctggccagcctggtgtccatcaatgctgacaatggccacctgtttgccctgcggagcctggactatgaggccctgcaggcctttgagttccgggtgggcgccacagaccggggcagccctgccctgagcagcgaggccctggtgcgggtgctggtgctggatgccaatgacaacagcccctttgtgctgtaccccctgcagaacagcagcgccccctgcacagagcccctgcccagggctgctgagcccggctacctggtgaccaaggtggtggccgtggatggagacagcggccagaatgcctggctgagctaccagctgctgaaggccacagagcccggcctgtttggagtgtgggcccacaatggagaggtgaggacagcccggctgctgtctgaaagagatgctgccaagcagaggctggtggtgctggtgaaggacaatggagagccccccaggtctgccacagccaccctgcacgtgctgctggtggatggcttcagccagccctacctgcggctgcctgaggccgccccagaccaggccaacagcctgactgtgtacctggtggtggccctggcctctgtgagcagcctcttcctgctgtctgtgctgctgtttgtggccgtgcggctgtgcagaagaagcagagctgcccctgtgggccgctgcagcgtgcctgagggccccttccccaggcacctggtggacctgagcggcaccggcaccctgagccagagctaccagtatgaggtgtgcctgaccggcggcagcggcaccaatgagttcaagttcctgaagcccatcatccccaacctgctgccccagagcacaggccgggaggtggaggagaaccggcccttccagaacaacctgggcttctag

SEQ ID NO: 166529 - DNA, 2331 bp, Artificial Sequence
  Description of Artificial Sequence: Synthetic coding sequence
atggagatcggctggatgcacaacagacggcagaggcaggtgctggtgttctttgtgctgctgagcctgagcggggccggggctgagctgggcagctacagcgtggtggaggagacagagcggggcagctttgtggccaacctgggcaaggacctgggcctgggcctgacagagatgagcaccaggaaggcccgcatcatcagccagggcaacaagcagcacctgcagctgaaggcccagacaggagacctgctgatcaatgagaagctggaccgggaggagctgtgtggccccacagagccctgcatcctgcacttccaggtgctgatggagaaccccctggagatcttccaggccgagctgcgggtcatcgacatcaatgaccacagccccatgttcacagagaaggagatgatcctgaagatccctgagaacagccccctgggcacagagttccccctgaaccacgccctggacctggatgtgggcagcaacaacgtgcagaactacaagatcagccccagcagccacttccgggtgctgattcatgagttcagagatggcaggaagtacccagagctggtgctggacaaggagctggaccgggaggaggagccccagctgcggctgaccctgacagccctggatggcggcagcccccccaggtctggaacagcccaggtgcgcatcgaggtggtggacatcaatgacaatgcccctgagtttgagcagcccatctacaaggtgcagatccctgagaacagccccctgggcagcctggtggccaccgtgtctgcccgggacctggatggaggagccaacgggaagatctcctacaccctcttccagcccagcgaggacatcagcaagaccctggaggtgaaccccatgaccggggaggtgcggctgaggaagcaggtggactttgagatggtgaccagctatgaggtgcgcatcaaggccacagatggcggcggcctgagcggcaagtgcaccctgctgctgcaggtggtggatgtgaatgacaaccccccccaggtgaccatgtctgccctgaccagccccatccctgagaacagccctgagatcgtggtggccgtgttttctgtgtctgaccctgattctggcaacaacgggaagaccatcagcagcatccaggaggacctgcccttcctgctgaagcccagcgtgaagaacttctacaccctggtgacagagcgggccctggaccgggaggcccgggcagagtacaacatcaccctgactgtgacagacatgggcaccccccggctgaagacagagcacaacatcaccgtgcagatcagtgatgtgaatgacaatgcccccaccttcacccagaccagctacaccctgtttgtgcgggagaacaacagccctgccctgcacatcggctctgtgtctgccacagaccgggacagcggcaccaatgcccaggtgacctacagcctgctgcccccccaggacccccacctgcccctggccagcctggtgtccatcaatgctgacaatggccacctgtttgccctgcggagcctggactatgaggccctgcgggagtttgagttccgggtgtctgccacagaccggggcagccctgccctgagcagcgaggccctggtgcgggtgctggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagcccggcctgtttggagtgtgggcccacaatggagaggtgaggacagcccggctgctgtctgaaagagatgctgccaagcagaggctggtggtgctggtgaaggacaatggagagccccccaggtctgccacagccaccctgcacgtgctgctggtggatggcttcagccagcccttcctgcccctgcctgaggccgcccctggccagacccaggccaacagcctgactgtgtacctggtggtggccctggcctctgtgagcagcctcttcctgttctctgtgctgctgtttgtggccgtgcggctgtgcagaagaagcagagctgcctctgtgggccgctgcagcatgcctgagggccccttccctggccgcctggtggatgtgtctggcaccggcaccctgagccagagctaccagtatgaggtgtgcctgaccggcggcagcgagaccagcgagttcaagttcctgaagcccatcatccccaacttcagcccctag

SEQ ID NO: 166530 - DNA, 2397 bp, Artificial Sequence
  Description of Artificial Sequence: Synthetic coding sequence
atggaggccggggagggcaaggagcgggtgcccaagcagaggcaggtgctgatcttctttgtgctgctgggcatcgcccaggccagctgccagcccaggcactacagcgtggccgaggagacagaaagtggcagctttgtggccaacctgctgaaggacctgggcctggagatcggggagctggccgtgcggggggcccgggtggtgtccaagggcaagaagatgcacctgcagtttgaccggcagacaggagacctgctgctgaatgagaagctggaccgggaggagctgtgtggccccacagagccctgtgtgctgcccttccaggtgctgctggagaaccccctgcagttcttccaggccgagctgcgcatcagagatgtgaatgaccacagccctgtgttcctggacaaggagatcctgctgaagatccctgagagcatcaccccaggcaccaccttcctgattgaaagagcccaggacctggatgtgggcaccaacagcctgcagaactacaccatcagccccaacttccacttccacctgaacctgcaggacagcctggatggcatcatcctgccccagctggtgctgaacagagccctggaccgggaggagcagcctgagatccggctgaccctgacagccctggatggcggcagcccccccaggtctggaacagccctggtgcgcatcgaggtggtggacatcaatgacaacgtgcctgagtttgccaagctgctgtatgaggtgcagatccctgaggacagccctgtgggcagccaggtggccatcgtgtctgcccgggacctggacatcggcaccaacggggagatctcctatgccttcagccaggccagcgaggacatcaggaagaccttccggctgagcgccaagagcggggagctgctgctgcggcagaagctggactttgagagcatccagacctacacagtgaacatccaggccacagatggcggcggcctgagcggcacctgtgtggtgtttgtgcaggtgatggacctgaatgacaaccccccagagctgaccatgagcaccctcatcaaccagatccctgagaacctgcaggacaccctgattgctgtgttttctgtgtctgaccctgattctggggacaatggccgcatggtgtgcagcatccaggatgacctgcccttcttcctgaagcccagcgtggagaacttctacaccctggtgatcagcacagccctggaccgggagaccaggtctgagtacaacatcaccatcaccgtgacagactttggcaccccccggctgaagacagagcacaacatcaccgtgctggtgtctgatgtgaatgacaatgccccagccttcacccagaccagctacaccctgtttgtgcgggagaacaacagccctgccctgcacatcggctctgtgtctgccacagaccgggacagcggcaccaatgcccaggtgacctacagcctgctgcccccccaggacccccacctgcccctggccagcctggtgtccatcaatgctgacaatggccacctgtttgccctgcagagcctggactatgaggccctgcaggcctttgagttccgggtgggcgctgctgaccggggcagccctgccctgagcagcgaggccctggtgcgggtgctggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagcccggcctgtttggagtgtgggcccacaatggagaggtgaggacagcccggctgctgcgggagagagatgctgccaagcagaggctggtggtgctggtgaaggacaatggagagccccccaggtctgccacagccaccctgcacgtgctgctggtggatggcttcagccagccctacctgctgctgcctgaggccgccccagcccaggcccaggccgacctgctgactgtgtacctggtggtggccctggcctctgtgagcagcctcttcctgttctctgtgctgctgtttgtggccgtgcggctgtgcagaagaagcagagctgcctctgtgggccgctgcagcgtgcctgagggccccttccctggccagatggtggatgtgtctggcaccggcaccctgagccagagctaccagtatgaggtgtgcctgaccggcggcagcggcaccaatgagttcaagttcctgaagcccatcatccccaactttgtggcccagggcgctgagcgggtgtctgaggccaaccccagcttcaggaagagctttgagttcacctag

SEQ ID NO: 166531 - DNA, 648 bp, Artificial Sequence
  Description of Artificial Sequence: Synthetic coding sequence
atgaacctggtgggcagctatgcccaccaccaccaccaccaccacccccacccagcccaccccatgctgcacgagcccttcctgtttggacctgccagccgctgccaccaggagcggccctacttccagagctggctgctgagccctgcagatgctgccccagacttccctgctgggggccccccacctgctgctgctgctgctgccacagcctacggcccagatgcccggcccggccagagccctggccgcctggaggccctgggcggccgcctgggccgcaggaagggcagcggccccaagaaggagaggagaagaacagagagcatcaacagcgcctttgctgagctgcgggagtgcatccccaacgtgcctgctgacaccaagctgagcaagatcaagaccctgcggctggccaccagctacatcgcctacctgatggatgtgctggccaaggatgcccagagcggggaccctgaggccttcaaggccgagctgaagaaggcagatggcggccgggagagcaagaggaagcgggagctgcagcagcacgagggcttccccccagccctgggccctgtggagaagaggatcaagggccgcacaggctggccccagcaggtgtgggccctggagctgaaccagtag

SEQ ID NO: 166532 - DNA, 2388 bp, Artificial Sequence
  Description of Artificial Sequence: Synthetic coding sequence
atgaagaagctgggccgcatccaccccaaccggcaggtgctggccttcatcctgatggtgttcctgagccaggtgcggctggagcccatccgctacagcgtgctggaggagacagagagcggcagctttgtggcccacctggccaaggacctgggcctgggcattggagagctggccagccgcagcgcccgggtgctgagtgatgatgacaagcagaggctgcagctggaccggcagacaggagacctgctgctgcgggagaagctggaccgggaggagctgtgtggccccatcgagccctgtgtgctgcacttccaggtgttcctggagatgcctgtgcagttcttccagggcgagctgctgatccaggacatcaatgaccacagccccatcttccctgagcgggaggtgctgctgaagatcctggagaacagccagcccggcaccctcttccccctgctgattgctgaggacctggatgtgggcagcaatggcctgcagaagtacaccatcagccccaacagccacttccacatcctgaccaggaaccacagcgagggcaagaagtacccagacctggtgcaggacaagcccctggaccgggaggagcagcctgagttcagcctgaccctggtggccctggatggcggcagccccccaagaagtggcaccgtgatggtgcgcatcctgatcatggacatcaatgacaatgcccctgagtttgtgcacaccccctacggcgtgcaggtgctggagaacagccccctggacagccccatcgtgcgggtgctggcccgggacattgatgctggcaactttggatctgtgtcctatggcctcttccaggccagtgatgagatcaagcagaccttcagcatcaatgaggtgactggagagatcctgctgaagaagaagctggactttgagaagatcaagagctaccacgtggagattgaggccacagatggcggcggcctgtctggaaaaggaacagtggtgattgaggtggtggatgtgaatgacaaccccccagagctgatcatcagcagcctgaccagcagcatcccagaaaatgcccctgagaccgtggtgtccatcttccgcatccgggaccgggacagcggggagaatggcaagatgatctgcagcatcccagacaacctgcccttcatcctgaagcccaccctgaagaacttctacaccctggtgacagagcggcccctggaccgggagaccagcgctgagtacaacatcaccatcgctgtgacagacctgggcaccccccggctgaagacccagcagaacatcaccgtgcaggtgtctgatgtgaatgacaatgccccagccttcacccagaccagctacaccctgtttgtgcgggagaacaacagccctgccctgcacatcggctctgtgtctgccacagaccgggacagcggcaccaatgcccaggtgacctacagcctgctgcccccccaggacccccacctgcccctggccagcctggtgtccatcaatgctgacaatggccacctgtttgccctgcggagcctggactatgaggccctgcaggcctttgagttccgggtgggcgccagtgaccggggcagccctgccctgagcagcgaggccctggtgcgggtgctggtgctggacaccaatgacaacagcccctttgtgctgtaccccctgcagaatggcagcgccccctgcacagagctggtgcccagggctgctgagcccggctacctggtgaccaaggtggtggccgtggatggagacagcggccagaatgcctggctgagctaccagctgctgaaggccacagagcccggcctgtttggagtgtgggcccacaacggggaggtgaggacagcccggctgctgtctgaaagagatgctgccaagcaccggctggtggtgctggtgaaggacaacggggagcccccaagaagtgccacagccaccctgcacgtgctgctggtggatggcttcagccagccctacctgcccctgcctgaggccgccccagcccaggcccaggccgacagcctgactgtgtacctggtggtggccctggcctctgtgagcagcctcttcctgttctctgtgctgctgtttgtggccgtgcggctgtgccgccgcagccgggccgcctctgtgggccgctgcagcgtgcctgagggccccttccctggccacctggtggatgtgtctggaacaggcaccctgagccagagctaccagtatgaggtgtgcctgactggagacagcggcaccggggagttcaagttcctgaagcccatcttccccaacctgctggtgcaggacaccggccgggaggtgaaggagaaccccaagttcaggaacagcctggtgttctcctag

SEQ ID NO: 166533 - DNA, 2391 bp, Artificial Sequence
  Description of Artificial Sequence: Synthetic coding sequence
atggaggccggcggggagcgcttcctgcggcagaggcaggtgctgctgctgtttgtgttcctgggcggcagcctggccggcagcgagagccgccgctacagcgtggccgaggagaaggagaagggcttcctgattgccaacctggccaaggacctgggcctgcgggtggaggagctggccgcccggggggcccaggtggtgtccaaaggaaacaagcagcacttccagctgagccaccagacaggagacctgctgctgaatgagaagctggaccgggaggagctgtgtggccccacagagccctgcatcctgcacttccagatcctgctgcagaaccccctgcagtttgtgaccaatgagctgcgcatcattgatgtgaatgaccacagccctgtgttctttgaaaatgagatgcacctgaagatcctggagagcaccctgcccggcaccgtcatccccctgggcaatgctgaggacctggatgtgggcaggaacagcctgcagaactacaccatcacccccaacagccacttccacgtgctgaccaggagcagaagagatggcaggaagtacccagagctggtgctggacaaggccctggaccgggaggagcagcctgagctgagcctgaccctgacagccctggatggcggcagcccccccaggtctggaacagcccagatcaacatccaggtgctggacatcaatgacaatgcccctgagtttgcccagcccctgtatgaggtggccgtgctggagaacacccctgtgaacagcgtgattgtgacagtgtctgccagtgacctggacaccggcagctttggcaccatctcctatgccttcttccacgccagcgaggagatcaggaagaccttccagctgaaccccatcaccggggacatgcagctggtgaagtacctgaactttgaggccatcaacagctatgaggtggacatcgaggccaaggatggcggcggcctgagcggcaagagcaccgtcatcgtgcaggtggtggatgtgaatgacaaccccccagagctgaccctgagctctgtgaacagccccatccctgagaacagcggggagaccgtgctggccgtgttttctgtgtctgacctggacagcggggacaatggccgggtgatgtgcagcattgagaacaacctgcccttcttcctgaagcccagcgtggagaacttctacaccctggtgtctgagggcgccctggaccgggagaccaggtctgagtacaacatcaccatcaccatcacagacctgggcaccccccggctgaagaccaagtacaacatcaccgtgctggtgtctgatgtgaatgacaatgccccagccttcacccagatctcctacaccctgtttgtgcgggagaacaacagccctgccctgcacatcggctctgtgtctgccacagaccgggacagcggcaccaatgcccaggtgacctacagcctgctgcccccccaggacccccacctgcccctgagcagcctggtgtccatcaatgctgacaatggccacctgtttgccctgcggagcctggactatgaggccctgcaggcctttgagttccgggtgggcgccacagaccggggcagccctgccctgagcagcgaggccctggtgcgggtgctggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagcccggcctgtttggagtgtgggcccacaatggagaggtgaggacagcccggctgctgtctgaaagagatgctgccaagcaccggctggtggtgctggtgaaggacaatggagagccccccaggtctgccacagccaccctgcacgtgctgctggtggatggcttcagccagccctacctgcccctgcctgaggccgccccagcccaggcccaggccgacctgctgactgtgtacctggtggtggccctggcctctgtgagcagcctcttcctgttctctgtgctgctgtttgtggccgtgcggctgtgcagaagaagcagagctgcctctgtgggccgctgcagcgtgcctgagggccccttccctggccagatggtggatgtgtctggcaccggcaccctgagccagagctaccagtatgaggtgtgcctgaccggcggcagcggcaccaatgagttcaagttcctgaagcccatcatccccaactttgtggcccagggcgctgagcgggtgtctgaggccaaccccagcttcaggaagagctttgagttctcctag

SEQ ID NO: 166534 - DNA, 1107 bp, Artificial Sequence
  Description of Artificial Sequence: Synthetic coding sequence
gggggcgccccacccaggagcggcaccaccaccatccgcatcgtggtgctggacaacaatgacaatgcccctgagttcctgcagagcttctatgaggtgcaggtgcctgagaacagccccctgaacagcctggtggtggtggtgtctgcccgggacctggatgctggggcctacggctctgtggcctatgccctcttccagggagatgaggtgacccagccctttgtgattgatgagaagacagctgagatccggctgaagagggccctggactttgaggccaccccctactacaacgtggagatcgtggccacagatggcggcggcctgtctggaaaatgtactgtggccatcgaggtggtggatgtgaatgacaatgcccctgagctgaccatgagcaccctgagcagccccaccccagaaaatgcccctgagaccgtggtggccgtgttttctgtgtctgaccctgacagcggggacaatggaaggatgatctgcagcatccagaatgacctgcccttcctgctgaagcccaccctgaagaacttctacaccctggtgacccagaggaccctggaccgggagagccaggccgagtacaacatcaccatcaccgtgacagacatgggcaccccccggctgaagacagagcacaacatcaccgtgctggtgtctgatgtgaatgacaatgccccagccttcacccagaccagctacaccctgtttgtgcgggagaacaacagccctgccctgcacatcggctctgtgtctgccacagaccgggacagcggcaccaatgcccaggtgacctacagcctgctgcccccccagaacccccacctgcggctggccagcctggtgtccatcaatgctgacaatggccacctgtttgccctgcggagcctggactatgaggccctgcaggcctttgagttccgggtgggcgccacagaccggggcagccctgccctgagcagcgaggccctggtgcgggtgctgtgctggacccccaccaccacccggcccagctgctgcatccgctgcaggacagcccggcggctggcccccagctggtgccccggccggcccagccgggccacctggtag

SEQ ID NO: 166535 - DNA, 2388 bp, Artificial Sequence
  Description of Artificial Sequence: Synthetic coding sequence
atggagacagccctggccaagaccccccagaagaggcaggtgatgttcctggccatcctgctgctgctgtgggaggccggcagcgaggccgtgcgctacagcatccctgaggagacagaaagtggctacagcgtggccaacctggccaaggacctgggcctgggcgtgggggagctggccaccaggggggccaggatgcactacaagggcaacaaggagctgctgcagctggacatcaagacaggcaacctgctgctgtatgagaagctggaccgggaggtgatgtgtggggccacagagccctgcatcctgcacttccagctgctgctggagaaccctgtgcagttcttccagacagacctgcagctgacagacatcaatgaccacgcccctgagttccctgagaaggagatgctgctgaagatccctgagagcacccagcccggcaccgtcttccccctgaagatcgcccaggactttgacatcggcagcaacacagtgcagaactacaccatcagccccaacagccacttccacgtggccacccacaacagaggagatggcaggaagtacccagagctggtgctggacaaggccctggaccgggaggagaggcctgagctgagcctgaccctgacagccctggatggaggagccccacccaggagcggcaccaccaccatccgcatcgtggtgctggacaacaatgacaatgcccctgagttcctgcagagcttctatgaggtgcaggtgcctgagaacagccccctgaacagcctggtggtggtggtgtctgcccgggacctggatgctggggcctacggctctgtggcctatgccctcttccagggagatgaggtgacccagccctttgtgattgatgagaagacagctgagatccggctgaagagggccctggactttgaggccaccccctactacaacgtggagatcgtggccacagatggcggcggcctgtctggaaaatgtactgtggccatcgaggtggtggatgtgaatgacaatgcccctgagctgaccatgagcaccctgagcagccccaccccagaaaatgcccctgagaccgtggtggccgtgttttctgtgtctgaccctgacagcggggacaatggaaggatgatctgcagcatccagaatgacctgcccttcctgctgaagcccaccctgaagaacttctacaccctggtgacccagaggaccctggaccgggagagccaggccgagtacaacatcaccatcaccgtgacagacatgggcaccccccggctgaagacagagcacaacatcaccgtgctggtgtctgatgtgaatgacaatgccccagccttcacccagaccagctacaccctgtttgtgcgggagaacaacagccctgccctgcacatcggctctgtgtctgccacagaccgggacagcggcaccaatgcccaggtgacctacagcctgctgcccccccagaacccccacctgcggctggccagcctggtgtccatcaatgctgacaatggccacctgtttgccctgcggagcctggactatgaggccctgcaggcctttgagttccgggtgggcgccacagaccggggcagccctgccctgagcagcgaggccctggtgcgggtgctggtgctggatgccaatgacaacagcccctttgtgctgtaccccctgcagaatggcagcgccccctgcacagagctggtgcccagggctgctgagcccggctacctggtgaccaaggtggtggccgtggatggagacagcggccagaatgcctggctgagctaccagctgctgaaggccacagagcccggcctcttctccatgtgggcccacaacggggaggtgaggacagcccggctgctgtctgaaagagatgctgccaagcaccggctggtggtgctggtgaaggacaacggggagcccccaagaagtgccacagccaccctgcacgtgctgctggtggatggcttcagccagccctacctgcccctgcctgaggccgccccagcccaggcccaggccgacagcctgactgtgtacctggtggtggccctggcctctgtgagcagcctcttcctgttctctgtgctgctgtttgtggccgtgcggctgtgccgccgcagccgggccgcctctgtgggccgctgcagcgtgcctgagggccccttccctggccacctggtggatgtgtctggaacaggcaccctgagccagagctaccactatgaggtgtgcctgactggagacagcggggccggggagttcaagttcctgaagcccatcatccccaacctgctgccccagggcgctggggaggagatcggcaagacagctgccttcagaaattcctttggcctgaactag

SEQ ID NO: 166536 - DNA, 1107 bp, Artificial Sequence
  Description of Artificial Sequence: Synthetic coding sequence
gggggcagcccccccaggagcggcaccagcgagatccagatccaggtgctggacatcaatgacaacgtgcctgagtttgcccaggagctgtatgaggcccaggtgcctgagaacaaccccctgggcagcctggtgatcaccgtgtctgcccgggacctggatgctggcagctttgggaaggtgtcctatgccctcttccaggtggatgatgtgaaccagccctttgagatcaatgccatcactggagagatccggctgaggaaggccctggactttgaggagatccagagctatgatgtggatgtggaggccacagatggcggcggcctgagcggcaagtgcagcctggtggtgcgggtgctggatgtgaatgacaatgcccctgagctgaccatgtccttcttcatcagcctcatccctgagaacctgcctgagatcaccgtggccgtgttttctgtgtctgatgctgacagcggccacaaccagcaggtgatctgcagcattgagaacaacctgcccttcctgctgcggcccagcgtggagaacttctacaccctggtgacagagggcgccctggaccgggagagcagagctgagtacaacatcaccatcaccgtgacagacctgggcaccccccggctgaagacccagcagagcatcaccgtgcaggtgtctgatgtgaatgacaacgtgcctgccttcacccagaccagctacaccctgtttgtgcgggagaacaacagccctgccctgcacatcggctctgtgtctgccacagaccgggacagcggcatcaatgcccaggtgacctacagcctgctgcccccccaggacccccacctgcccctgagcagcctggtgtccatcaatgctgacaatggccacctgtttgccctgcggagcctggactatgaggccctgcagagctttgagttccgggtgggcgccacagaccggggcagccctgccctgagcagcgaggccctggtgcggctgctgtgctggacccccaccaccacccggcccagctgctgcacccgctgcaggacagcccccaggcctgcccccagctggtgccccggccggcccagccgggccacctggtag

SEQ ID NO: 166537 - DNA, 1977 bp, Artificial Sequence
  Description of Artificial Sequence: Synthetic coding sequence
atgctgctgaagatcagcgagatcaccatgcctgggaagatcttccccctgaagatggcccatgacctggacaccggcagcaatggcctgcagcgctacaccatcagcagcaacccccacttccacgtgctgaccaggaacagaagtgagggcaggaagtttcctgagctggtgctggacaagcccctggaccgggaggagcagccccagctgcggctgaccctcatcgccctggatggcggcagccccccaagaagtggcaccagcgagatccagatccaggtgctggacatcaatgacaacgtgcctgagtttgcccaggagctgtatgaggcccaggtgcctgagaacaaccccctgggcagcctggtgatcaccgtgtctgcccgggacctggatgctggcagctttgggaaggtgtcctatgccctcttccaggtggatgatgtgaaccagccctttgagatcaatgccatcaccggggagatccggctgaggaaggccctggactttgaggagatccagagctatgatgtggatgtggaggccacagatggcggcggcctgagcggcaagtgcagcctggtggtgcgggtgctggatgtgaatgacaatgcccctgagctgaccatgtccttcttcatcagcctcatccctgagaacctgcctgagatcaccgtggccgtgttttctgtgtctgatgctgacagcggccacaaccagcaggtgatctgcagcattgagaacaacctgcccttcctgctgcggcccagcgtggagaacttctacaccctggtgacagaaggagccctggaccgggagagcagagctgagtacaacatcaccatcaccgtgacagacctgggcaccccccggctgaagacccagcagagcatcaccgtgcaggtgtctgatgtgaatgacaacgtgcctgccttcacccagaccagctacaccctgtttgtgcgggagaacaacagccctgccctgcacatcggctctgtgtctgccacagaccgggacagcggcatcaatgcccaggtgacctacagcctgctgcccccccaggacccccacctgcccctgagcagcctggtgtccatcaatgctgacaatggccacctgtttgccctgcggagcctggactatgaggccctgcagagctttgagttccgggtgggcgccacagaccggggcagccctgccctgagcagcgaggccctggtgcggctgctggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagctgggcctgtttggagtgtgggcccacaatggagaggtgaggacagcccggctgctgtctgaaagagatgctgccaagcaccggctggtggtgctggtgaaggacaatggagagccccccaggtctgccacagccaccctgcacgtgctgctggtggatggcttcagccagccctacctgcccctgcctgaggccgccccagcccaggcccaggccgacagcctgactgtgtacctggtggtggccctggcctctgtgagcagcctcttcctgttctctgtgctgctgtttgtggccgtgcggctgtgcagaagaagcagagctgcctctgtgggccgctacagcgtgcctgagggccccttccctggccacctggtggatgtgtctggcaccggcaccctgagccagagctaccagtacaaggtgtgcctgaccggcggcagcgagaccaatgagttcaagttcctgaagcccatcatgcccaacttccccccccagggcacagagcgggagatggaggagacccccaccagcaggaacagcttccccttctcctag

SEQ ID NO: 166538 - DNA, 2385 bp, Artificial Sequence
  Description of Artificial Sequence: Synthetic coding sequence
atgatgcagaccaaggtgcagaacaagaagaggcaggtggccttcttcatcctgctgatgctgtggggcgaggtgggcagcgagagcatccagtacagcgtgctggaggagacagagagcggcacctttgtggccaacctgaccaaggacctgggcctgcgggtgggggagctggccagcagaggagcccgggtggtgttcaagggcaaccggcagcacctgcagtttgacccccagacccatgacctgctgctgaatgagaagctggaccgggaggagctgtgtggcagcacagagccctgtgtgctgcccttccaggtgctgctggagaaccccctgcagttcttccaggccagcctgcgggtgcgggacatcaatgaccacgcccctgagttccctgcccgggagatgctgctgaagatcagcgagatcaccatgcctgggaagatcttccccctgaagatggcccatgacctggacaccggcagcaatggcctgcagcgctacaccatcagcagcaacccccacttccacgtgctgaccaggaacagaagtgagggcaggaagtttcctgagctggtgctggacaagcccctggaccgggaggagcagccccagctgcggctgaccctcatcgccctggatggcggcagccccccaagaagtggcaccagcgagatccagatccaggtgctggacatcaatgacaacgtgcctgagtttgcccaggagctgtatgaggcccaggtgcctgagaacaaccccctgggcagcctggtgatcaccgtgtctgcccgggacctggatgctggcagctttgggaaggtgtcctatgccctcttccaggtggatgatgtgaaccagccctttgagatcaatgccatcaccggggagatccggctgaggaaggccctggactttgaggagatccagagctatgatgtggatgtggaggccacagatggcggcggcctgagcggcaagtgcagcctggtggtgcgggtgctggatgtgaatgacaatgcccctgagctgaccatgtccttcttcatcagcctcatccctgagaacctgcctgagatcaccgtggccgtgttttctgtgtctgatgctgacagcggccacaaccagcaggtgatctgcagcattgagaacaacctgcccttcctgctgcggcccagcgtggagaacttctacaccctggtgacagaaggagccctggaccgggagagcagagctgagtacaacatcaccatcaccgtgacagacctgggcaccccccggctgaagacccagcagagcatcaccgtgcaggtgtctgatgtgaatgacaacgtgcctgccttcacccagaccagctacaccctgtttgtgcgggagaacaacagccctgccctgcacatcggctctgtgtctgccacagaccgggacagcggcatcaatgcccaggtgacctacagcctgctgcccccccaggacccccacctgcccctgagcagcctggtgtccatcaatgctgacaatggccacctgtttgccctgcggagcctggactatgaggccctgcagagctttgagttccgggtgggcgccacagaccggggcagccctgccctgagcagcgaggccctggtgcggctgctggtgctggatgccaatgacaacagcccctttgtgctgtaccccctgcagaatggaagtgccccctgcacagagctggtgcccagggctgctgagcccggctacctggtgaccaaggtggtggccgtggatggagacagcggccagaatgcctggctgagctaccagctgctgaaggccacagagctgggcctgtttggagtgtgggcccacaatggagaggtgaggacagcccggctgctgtctgaaagagatgctgccaagcaccggctggtggtgctggtgaaggacaatggagagccccccaggtctgccacagccaccctgcacgtgctgctggtggatggcttcagccagccctacctgcccctgcctgaggccgccccagcccaggcccaggccgacagcctgactgtgtacctggtggtggccctggcctctgtgagcagcctcttcctgttctctgtgctgctgtttgtggccgtgcggctgtgcagaagaagcagagctgcctctgtgggccgctacagcgtgcctgagggccccttccctggccacctggtggatgtgtctggcaccggcaccctgagccagagctaccagtacaaggtgtgcctgaccggcggcagcgagaccaatgagttcaagttcctgaagcccatcatgcccaacttccccccccagggcacagagcgggagatggaggagacccccaccagcaggaacagcttccccttctcctag

SEQ ID NO: 166539 - DNA, 1107 bp, Artificial Sequence
  Description of Artificial Sequence: Synthetic coding sequence
ggcagccccccaagaagtggcacagccctggtgcgcatcctggtgctggatgtgaatgacaatgccccagactttgtgcgcagcctgtacaaggtgcaggtgcctgagaacagccctgtgggctccatggtggtgtctgtgtctgcccgggacctggacaccggcagcaatggagagatcgcctatgccttctcctatgccacagagcgcatcctgaagaccttccagatcaaccccaccagcggcagcctgcacctgaaggcccagctggactatgaggccatccagacctacaccctgaccatccaggccaaggatggcggcggcctgtctggaaaatgtactgtggtggtggatgtgacagacatcaatgacaacagacctgagctgctgctgagcagcctgaccagccccatcgccgagaacagccctgagaccgtggtggccgtgttccgcatccgggaccgggacagcggcaacaacgggaagacagtgtgcagcatccaggatgatgtgcccttcatcctgaagcccagcgtggagaacttctacaccctggtgacagagaagcccctggaccgggagaggaacacagagtacaacatcaccatcaccgtgacagacctgggcaccccccggctgaagacagagcacaacatcaccgtgctggtgtctgatgtgaatgacaatgccccagccttcacccagaccagctacaccctgtttgtgcgggagaacaacagccctgccctgcccatcggctctgtgtctgccacagaccgggacagcggcaccaatgcccaggtgatctacagcctgctgcccagccaggacccccacctgcccctggccagcctggtgtccatcaatgctgacaatggccacctgtttgccctgcggagcctggactatgaggccctgcaggcctttgagttccgggtgggcgccacagaccggggcagccctgccctgagcagcgaggccctggtgcgggtgctgtgctggacccccaccaccacccggcccagctgctgcacccgctgcaggacagcccccaggcctgcccccagccgctgccccggccggcccagccgggccacctggtag

SEQ ID NO: 166540 - DNA, 2406 bp, Artificial Sequence
  Description of Artificial Sequence: Synthetic coding sequence
atggaggccagcggcaagctgatctgccggcagaggcaggtgctcttctccttcctgctgctgggcctgagcctggccggggctgctgagcccaggagctacagcgtggtggaggagacagagggcagcagctttgtgaccaacctggccaaggacctgggcctggagcagcgggagttcagccggcggggcgtgcgggtggtgtcccggggcaacaagctgcacctgcagctgaaccaggagacagctgacctgctgctgaatgagaagctggaccgggaggacctgtgtggccacacagagccctgtgtgctgcgcttccaggtgctgctggagagcccctttgagttcttccaggccgagctgcaggtgattgacatcaatgaccacagccctgtgttcctggacaagcagatgctggtgaaggtgtctgagagcagccccccaggcacagccttccccctgaagaatgctgaggacctggacatcggccagaacaacatcgagaactacatcatcagccccaacagctacttccgggtgctgaccaggaagagaagtgatggcaggaagtacccagagctggtgctggacaaggccctggaccgggaggaggaggccgagctgcggctgaccctgacagccctggatggcggcagccccccaagaagtggcacagcccaggtgtacatcgaggtggtggatgtgaatgacaatgcccctgagtttgagcagcccttctacagagtgcagatcagcgaggacagccccatctccttcctggtggtgaaggtgtctgccacagatgtggacaccggggtgaatggagagatctcctacagcctcttccaggccagtgatgagatcagcaagaccttcaaggtggacttcctgactggagagatccggctgaagaagcagctggactttgagaagttccagagctatgaggtgaacatcgaggccagagatgctgggggcttctctggaaaatgtactgtgctgatccaggtgattgatgtgaatgaccacgcccctgaggtgaccatgtctgccttcaccagccccatcccagaaaatgcccctgagaccgtggtggccctcttctctgtgtctgacctggacagcggggagaatggcaagatcagctgcagcatccaggaggacctgcccttcctgctgaagagctctgtgggcaacttctacaccctgctgacagagacccccctggaccgggagagcagagctgagtacaacgtgaccatcaccgtgacagacctgggcaccccccggctgaccacccacctgaacatgacagtgctggtgtctgatgtgaatgacaatgccccagccttcacccagaccagctacaccctgtttgtgcgggagaacaacagccctgccctgcacatcggctctgtgtctgccacagaccgggacagcggcaccaatgcccaggtgacctacagcctgctgcccccccaggacccccacctgcccctggccagcctggtgtccatcaacacagacaatggccacctgtttgccctgcggagcctggactatgaggccctgcaggcctttgagttccgggtgggcgccagtgaccggggcagccctgccctgagcagcgaggccctggtgcgggtgctggtgctggatgccaatgacaacagcccctttgtgctgtaccccctgcagaatggcagcgccccctgcacagagctggtgcccagggctgctgagcccggctacctggtgaccaaggtggtggccgtggatggagacagcggccagaatgcctggctgagctaccagctgctgaaggccacagagcccggcctgtttggagtgtgggcccacaacggggaggtgaggacagcccggctgctgtctgaaagagatgctgccaagcagaggctggtggtgctggtgaaggacaacggggagcccccctgcagcgccacagccaccctgcacctgctgctggtggatggcttcagccagccctacctgcccctgcctgaggccgccccagcccagggccaggccgacagcctgactgtgtacctggtggtggccctggcctctgtgagcagcctcttcctgttctctgtgctgctgtttgtggccgtgctgctgtgccgccgcagccgggccgcctctgtgggccgctgcagcgtgcctgagggccccttccctggccacctggtggatgtgcggggcaccggcagcctgagccagaactaccagtatgaggtgtgcctggccggcggcagcggcaccaatgagttccagttcctgaagcctgtgctgcccaacatccagggccacagctttggacctgagatggagcagaacagcaacttcagaaatggcttcggcttcagcctgcagctgaagtag

SEQ ID NO: 166541 - DNA, 2472 bp, Artificial Sequence
  Description of Artificial Sequence: Synthetic coding sequence
atgaagatccagaagaagctgaccggctgcagccggctgatgctgctgtgcctgagcctggagctgctgctggaggccggggccggcaacatccactacagcgtgcctgaggagacagacaagggcagctttgtgggcaacatcgccaaggacctgggcctgcagccccaggagctggctgatggaggagtgcgcatcgtgtcccggggccgcatgcccctgtttgccctgaaccccaggagcggcagcctcatcacagccaggagaattgaccgggaggagctgtgtgcccagagcatgccctgcctggtgtccttcaacatcctggtggaggacaagatgaagctgtttcctgtggaggtggagatcatcgacatcaatgacaacaccccccagttccagctggaggagctggagttcaagatgaatgagatcaccaccccaggcaccagggtgtccctgcccttcggccaggacctggatgtgggcatgaacagcctgcagagctaccagctgagcagcaacccccacttcagcctggatgtgcagcagggcgcagatggcccccagcaccctgagatggtgctgcagagccccctggaccgggaggaggaggccgtgcaccacctgatcctgacagccagtgatggaggagagcctgtgcgcagcggcaccctgcgcatctacatccaggtggtggatgccaatgacaaccccccagccttcacccaggcccagtaccacatcaacgtgcctgaaaatgtgcccctgggcacccagctgctgatggtgaatgccacagatcctgatgagggcgccaacggggaggtgacctacagcttccacaacgtggaccaccgggtggcccagatcttccggctggacagctacaccggggagatcagcaacaaggagcccctggactttgaggagtacaagatgtacagcatggaggtgcaggcccaggatggagctggcctgatggccaaggtgaaggtgctgatcaaggtgctggatgtgaatgacaatgcccctgaggtgaccatcacctctgtgaccacagctgtgcctgagaacttccccccaggcaccatcatcgccctgatctctgtgcatgaccaggacagcggggacaatggctacaccacctgcttcatccctggcaacctgcccttcaagctggagaagctggtggacaactactaccgcctggtgacagagaggaccctggaccgggagctgatcagcggctacaacatcaccatcacagccatcgaccagggcaccccagccctgagcacagagacccacatcagcctgctggtgacagacatcaatgacaacagccctgtgttccaccaggacagctacagcgcctacatccctgagaacaaccccaggggggccagcatcttctctgtgcgggcccatgacctggacagcaatgaaaatgcccagatcacctacagcctgattgaggacaccatccagggcgcccccctgagcgcctacctgagcatcaacagcgacacaggagtgctgtatgccctgcggagctttgattatgagcagttccgggacatgcagctgaaggtgatggcccgggacagcggggacccccccctgagcagcaatgtgtccctgagcctcttcctgctggaccagaatgacaatgcccctgagatcctgtacccagccctgcccacagatggcagcactggagtggagctggcccccctgtctgctgagcccggctacctggtgaccaaggtggtggccgtggaccgggacagcggccagaatgcctggctgagctaccgcctgctgaaggccagcgagcccggcctcttctctgtgggcctgcacactggagaggtgaggacagcccgggccctgctggacagagatgccctgaagcagagcctggtggtggccgtgcaggaccacggccagccccccctgagcgccaccgtgaccctgactgtggccgtggccgaccgcatcagtgacatcctggccgacctgggcagcctggagcccagcgccaagcccaatgacagcgacctgaccctgtacctggtggtggccgctgctgctgtgtcctgtgtgttcctggcctttgtgattgtgctgctggcccaccggctgcggcgctggcacaagagccggctgctgcaggccagcggcggcggcctggcctccatgcctggcagccactttgtgggcgtggatggagtgcgggccttcctgcagacctacagccatgaggtgtccctgacagctgacagcaggaagagccacctgatcttcccccagcccaactatgctgacaccctcatcagccaggagagctgtgagaagaagggcttcctgagcgccccccagagcctgctggaggacaagaaggagcccttcagccaggtgaacttctgtgatgagtgcatctcctacctggagaagaacaacagctag

SEQ ID NO: 166542 - DNA, 2796 bp, Artificial Sequence
  Description of Artificial Sequence: Synthetic coding sequence
atgaagatccagaagaagctgaccggctgcagccggctgatgctgctgtgcctgagcctggagctgctgctggaggccggggccggcaacatccactacagcgtgcctgaggagacagacaagggcagctttgtgggcaacatcgccaaggacctgggcctgcagccccaggagctggctgatggaggagtgcgcatcgtgtcccggggccgcatgcccctgtttgccctgaaccccaggagcggcagcctcatcacagccaggagaattgaccgggaggagctgtgtgcccagagcatgccctgcctggtgtccttcaacatcctggtggaggacaagatgaagctgtttcctgtggaggtggagatcatcgacatcaatgacaacaccccccagttccagctggaggagctggagttcaagatgaatgagatcaccaccccaggcaccagggtgtccctgcccttcggccaggacctggatgtgggcatgaacagcctgcagagctaccagctgagcagcaacccccacttcagcctggatgtgcagcagggcgcagatggcccccagcaccctgagatggtgctgcagagccccctggaccgggaggaggaggccgtgcaccacctgatcctgacagccagtgatggaggagagcctgtgcgcagcggcaccctgcgcatctacatccaggtggtggatgccaatgacaaccccccagccttcacccaggcccagtaccacatcaacgtgcctgaaaatgtgcccctgggcacccagctgctgatggtgaatgccacagatcctgatgagggcgccaacggggaggtgacctacagcttccacaacgtggaccaccgggtggcccagatcttccggctggacagctacaccggggagatcagcaacaaggagcccctggactttgaggagtacaagatgtacagcatggaggtgcaggcccaggatggagctggcctgatggccaaggtgaaggtgctgatcaaggtgctggatgtgaatgacaatgcccctgaggtgaccatcacctctgtgaccacagctgtgcctgagaacttccccccaggcaccatcatcgccctgatctctgtgcatgaccaggacagcggggacaatggctacaccacctgcttcatccctggcaacctgcccttcaagctggagaagctggtggacaactactaccgcctggtgacagagaggaccctggaccgggagctgatcagcggctacaacatcaccatcacagccatcgaccagggcaccccagccctgagcacagagacccacatcagcctgctggtgacagacatcaatgacaacagccctgtgttccaccaggacagctacagcgcctacatccctgagaacaaccccaggggggccagcatcttctctgtgcgggcccatgacctggacagcaatgaaaatgcccagatcacctacagcctgattgaggacaccatccagggcgcccccctgagcgcctacctgagcatcaacagcgacacaggagtgctgtatgccctgcggagctttgattatgagcagttccgggacatgcagctgaaggtgatggcccgggacagcggggacccccccctgagcagcaatgtgtccctgagcctcttcctgctggaccagaatgacaatgcccctgagatcctgtacccagccctgcccacagatggcagcactggagtggagctggcccccctgtctgctgagcccggctacctggtgaccaaggtggtggccgtggaccgggacagcggccagaatgcctggctgagctaccgcctgctgaaggccagcgagcccggcctcttctctgtgggcctgcacactggagaggtgaggacagcccgggccctgctggacagagatgccctgaagcagagcctggtggtggccgtgcaggaccacggccagccccccctgagcgccaccgtgaccctgactgtggccgtggccgaccgcatcagtgacatcctggccgacctgggcagcctggagcccagcgccaagcccaatgacagcgacctgaccctgtacctggtggtggccgctgctgctgtgtcctgtgtgttcctggcctttgtgattgtgctgctggcccaccggctgcggcgctggcacaagagccggctgctgcaggccagcggcggcggcctggcctccatgcctggcagccactttgtgggcgtggatggagtgcgggccttcctgcagacctacagccatgaggtgtccctgacagctgacagcaggaagagccacctgatcttcccccagcccaactatgctgacaccctcatcagccaggagagctgtgagaagaagggcttcctgagcgccccccagagcctgctggaggacaagaaggagcccttcagccagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166543 - DNA, 2811 bp, Artificial Sequence
  Description of Artificial Sequence: Synthetic coding sequence
atggccgcccagaggaacagaagcaaggagagcaaggactgcagcggcctggtgctgctgtgcctcttcttcggcatcccctgggaggccggggcccggcagatctcctacagcatccctgaggagctggagaagggcagctttgtgggcaacatcagcaaggacctgggcctggccccccgggagctggccgagcggggcgtgcgcatcgtgtcccggggccgcacccagctgttcagcctgaaccccaggagcggcagcctcatcacagctggaagaattgaccgggaggagctgtgtgcccagagcgcccgctgtgtggtgtccttcaacatcctggtggaggacagagtgaagctgtttggaattgaaattgaggtgacagacatcaatgacaatgcccccaagttccaggccgagaacctggatgtgaagatcaatgaaaatgtggccgccggcatgaggttccccctgcctgaggccatcgaccctgatgtgggcgtgaacagcctgcagagctaccagctgagccccaacaagcacttcagcctgcgggtgcagagccgggccaatggagtgaagtacccagagctggtgctggagcacagcctggaccgggaggaggaggccatccaccacctggtgctgacagccagtgatggaggagaccccctgcggtctggaacagtgctggtgtctgtgacagtgtttgatgccaatgacaatgcccctgtgttcaccctgcctgagtacagagtgtctgtgcctgagaacctgcctgtgggcacccagctgctgactgtgacagccacagacagagatgagggcgccaacggggaggtgacctacagcttcaggaagctgcctgacacccagctgctgaagttccagctgaacaagtacaccggggagatcaagatcagcgagaacctggactatgaggagaccggcttctatgaaattgagatccaggccgaggatggaggagcctacctggccacagccaaggtgctgatcaccgtggaggatgtgaatgacaacagccctgagctgaccatcaccagcctcttcagccctgtgacagaggacagccccctgggcaccgtggtggccctgctgaatgtgcatgacctggacagcgagcagaatggccaggtgacctgcagcatcctggcctacctgcccttcaagctggagaagagcattgacagctactaccgcctggtgatccaccgggccctggaccgggagcaggtgtcctcctacaacatcaccgtgacagccacagatggcggcagcccccccctgagcacagaggcccacttcatgctgcaggtggccgacatcaatgacaacccccccaccttcagccaggtgtcctacttcacctacatcccagaaaataatgcccggggggccagcatcttctctgtgacagccctggaccctgacagcaaagaaaatgcccagatcatctacagcctggccgaggacaccatccagggcgtgcccctgagcagctacatcagcatcaacagcgacacaggagtgctgtatgccctgcggagctttgattatgagcagttccacgagctgcagatgcaggtgacagccagtgacagcggggacccccccctgagcagcaatgtgtccctgagcctgtttgtgctggaccagaatgacaatgcccctgagatcctgtacccagccctgcccacagatggcagcactggagtggagctggcccccaggtctgctgagcccggctacctggtgaccaaggtggtggccgtggaccgggacagcggccagaatgcctggctgagctaccgcctgctgaaggccagcgagcccggcctgtttgctgtgggggagcacactggagaggtgaggacagcccgggccctgctggacagagatgccctgaagcagagcctggtggtggccgtgcaggaccacggccagccccccctgagcgccaccgtgaccctgactgtggccgtggccgacagcatcccccaggtgctggccgacctgggcagctttgagagccctgccaacagcgagaccagtgacctgaccctgtacctggtggtggccgtggccgctgtgtcctgtgtgttcctggcctttgtgattgtgctgctggcccaccggctgcggcgctggcacaagagccggctgctgcaggccagcggcggcggcctgactggagtgtctggcagccactttgtgggcgtggatggagtgcgggccttcctgcagacctacagccatgaggtgtccctgacagctgacagcaggaagagccacctgatcttcccccagcccaactatgctgacaccctcatcagccaggagagctgtgagaagaatgaccccctgagcctgctggatgacagcaagttccccatcgaggacacccccctggtgccccaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166544 - DNA, 2808 bp, Artificial Sequence
  Description of Artificial Sequence: Synthetic coding sequence
atggccaaccggctgcagagaggagacaggagccggctgctgctgctgctgtgcatcttcctgggcaccctgcggggcttccgggcccggcagatccgctacagcgtgcctgaggagacagagaagggcagctttgtgggcaacatcagcaaggacctgggcctggagccccgggagctggccaagaggggcgtgagaattgtgtcccggggcaagacccagctgtttgctgtgaaccccaggagcggcagcctcatcacagctggaagaattgaccgggaggagctgtgtgaaacagtgagcagctgcttcctgaacatggagctgctggtggaggacaccctgaagatctacggcgtggaggtggagatcatcgacatcaatgacaatgcccccagcttccaggaggatgaggtggagatcaaggtgtctgagcacgccatccctggggccaggtttgccctgcccaatgcccgggaccctgatgtgggcgtgaacagcctgcagagctaccagctgagccccaacaactacttcagcctgcagctgcggggccgcacagatggagccaagaaccctgagctggtgctggagggcagcctggaccgggagaaggaggccgcccacctgctgctgctgacagccctggatggaggagaccccatcagaaaaggagctgtgcccatccgggtggtggtgctggatgtgaatgaccacatccccatgttcacccagagcgtgtacagagtgtctgtgcctgagaacatcagcagcggcaccagggtgctgatggtgaatgccacagatcctgatgagggcatcaatggagaggtgatgtacagcttcaggaacatggagagcaaggccagcgagatcttccagctggacagccagacaggagaggtgcaggtgcggggcagcctggactttgagaagtaccgcttctatgagatggagatccagggccaggacggcggcggcctcttcaccaccaccaccatgctgatcaccgtggtggatgtgaatgacaatgcccctgagatcaccatcaccagcagcatcaacagcatcctggagaacagccccccaggcaccgtgattgccctgctgaatgtgcaggaccaggacagcggagaaaatggccaggtgtcctgcttcatccccaaccacctgcccttcaagctggagaagacctacggcaactactacaagctgatcaccagccgggtgctggaccgggagctggtgcagagctacaacatcaccctgacagccacagaccagggcagcccccccctgtctgctgagacccacgtgtggctgaatgtggctgatgacaatgacaacccccctgtgttcccccacagcagctacagcgcctacatccctgagaacaaccccaggggggccagcatcttctctgtgacagccctggaccctgacagcaagcagaatgccctggtgacctacagcctgacagatgacacagtgcagggcgtgcccctgagcagctatgtgtccatcaacagcaacacaggagtgctgtatgccctgcagagctttgattatgagcagttccgggacctggagctgcgggtcatcgcccgggacagcggggacccccccctgagcagcaatgtgtccctgagcctgtttgtgctggaccagaatgacaatgcccctgagatcctgtacccagccctgcccacagatggcagcactggagtggagctggcccccaggtctgctgagcccggctacctggtgaccaaggtggtggccgtggacaaggacagcggccagaatgcctggctgagctaccgcctgctgaaggccagcgagcccggcctgtttgctgtgggggagcacactggagaggtgaggacagcccgggccctgctggacagagatgccctgaagcagagcctggtggtggccgtgcaggaccacggccagccccccctgagcgccaccgtgaccctgactgtggccgtggccgacagcatccctgaggtgctggccgacctgggcagcctggagagcctggccaacagcgagaccagtgacctgagcctgtacctggtggtggccgtggccgctgtgtcctgcatcttcctggtgtttgtgattgtgctgctggccctgcggctgtggcgctggcacaagagccggctgctgcaggccagcgagggcggcctggccggcatgcccaccagccactttgtgggcgtggatggagtgcaggccttcctgcagacctacagccatgaggtgtccctgattgctgacagccagaagagccacctgatcttcccccagcccaactacggggacaccctcatcagccaggagagctgtgagaagtctgagcccctgctgattgctgaggacagcgccatcatcctgggcaaatgtgaccccaccagcaaccagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166545 - DNA, 2253 bp, Artificial Sequence
  Description of Artificial Sequence: Synthetic coding sequence
atggccaaccggctgcagagaggagacaggagccggctgctgctgctgctgtgcatcttcctgggcaccctgcggggcttccgggcccggcagatccgctacagcgtgcctgaggagacagagaagggcagctttgtgggcaacatcagcaaggacctgggcctggagccccgggagctggccaagaggggcgtgagaattgtgtcccggggcaagacccagctgtttgctgtgaaccccaggagcggcagcctcatcacagctggaagaattgaccgggaggagctgtgtgaaacagtgagcagctgcttcctgaacatggagctgctggtggaggacaccctgaagatctacggcgtggaggtggagatcatcgacatcaatgacaatgcccccagcttccaggaggatgaggtggagatcaaggtgtctgagcacgccatccctggggccaggtttgccctgcccaatgcccgggaccctgatgtgggcgtgaacagcctgcagagctaccagctgagccccaacaactacttcagcctgcagctgcggggccgcacagatggagccaagaaccctgagctggtgctggagggcagcctggaccgggagaaggaggccgcccacctgctgctgctgacagccctggatggaggagaccccatcagaaaaggagctgtgcccatccgggtggtggtgctggatgtgaatgaccacatccccatgttcacccagagcgtgtacagagtgtctgtgcctgagaacatcagcagcggcaccagggtgctgatggtgaatgccacagatcctgatgagggcatcaatggagaggtgatgtacagcttcaggaacatggagagcaaggccagcgagatcttccagctggacagccagacaggagaggtgcaggtgcggggcagcctggactttgagaagtaccgcttctatgagatggagatccagggccaggacggcggcggcctcttcaccaccaccaccatgctgatcaccgtggtggatgtgaatgacaatgcccctgagatcaccatcaccagcagcatcaacagcatcctggagaacagccccccaggcaccgtgattgccctgctgaatgtgcaggaccaggacagcggagaaaatggccaggtgtcctgcttcatccccaaccacctgcccttcaagctggagaagacctacggcaactactacaagctgatcaccagccgggtgctggaccgggagctggtgcagagctacaacatcaccctgacagccacagaccagggcagcccccccctgtctgctgagacccacgtgtggctgaatgtggctgatgacaatgacaacccccctgtgttcccccacagcagctacagcgcctacatccctgagaacaaccccaggggggccagcatcttctctgtgacagccctggaccctgacagcaagcagaatgccctggtgacctacagcctgacagatgacacagtgcagggcgtgcccctgagcagctatgtgtccatcaacagcaacacaggagtgctgtatgccctgcagagctttgattatgagcagttccgggacctggagctgcgggtcatcgcccgggacagcggggacccccccctgagcagcaatgtgtccctgagcctgtttgtgctggaccagaatgacaatgcccctgagatcctgtacccagccctgcccacagatggcagcactggagtggagctggcccccaggtctgctgagcccggctacctggtgaccaaggtggtggccgtggacaaggacagcggccagaatgcctggctgagctaccgcctgctgaaggccagcgagcccggcctgtttgctgtgggggagcacactggagagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166546 - DNA, 2799 bp, Artificial Sequence
  Description of Artificial Sequence: Synthetic coding sequence
atgatcccagcccggctgcaccgggactacaagggcctggtgctgctgggcatcctgctgggcaccctgtgggagaccggctgcacccagatccgctacagcgtgcctgaggagctggagaagggcagccgggtgggggacatcagccgggacctgggcctggagccccgggagctggccgagcggggcgtgcgcatcatcccccggggccgcacccagctgtttgccctgaaccccaggagcggcagcctggtgacagctggaagaattgaccgggaggagctgtgcatgggcgccatcaagtgccagctgaacctggacatcctgatggaggacaaggtgaagatctatggagtggaggtggaggtgcgggacatcaatgacaatgccccctacttccgggagagcgagctggagatcaagatcagtgaaaatgctgccacagagatgaggttccccctgccccacgcctgggaccctgacatcggcaagaacagcctgcagagctatgagctgagccccaacacccacttcagcctgattgtgcagaatggagcagatggcagcaagtacccagagctggtgctgaagagggccctggaccgggaggagaaggccgcccaccacctggtgctgacagccagtgatggaggagaccctgtgaggactggaacagcccgcatccgggtgatggtgctggatgccaatgacaatgccccagcctttgcccagcctgagtaccgggcctctgtgcctgagaacctggccctgggcacccagctgctggtggtgaatgccacagatcctgatgagggcgtgaatgctgaggtgcgctacagcttccgctacgtggatgacaaggccgcccaggtgttcaagctggactgcaacagcggcaccatcagcaccatcggggagctggaccacgaggagagcggcttctaccagatggaggtgcaggccatggacaatgccggctacagcgcccgggccaaggtgctgatcaccgtgctggatgtgaatgacaatgcccctgaggtggtgctgaccagcctggccagctctgtgcctgagaacagcccccggggcaccctcatcgccctgctgaatgtgaatgaccaggacagcgaggagaatggccaggtgatctgcttcatccagggcaacctgcccttcaagctggagaagagctatggcaactactacagcctggtgacagacatcgtgctggaccgggagcaggtgcccagctacaacatcaccgtgacagccacagaccggggcaccccacccctgagcacagagacccacatcagcctgaatgtggccgacaccaatgacaacccccctgtgttcccccaggccagctacagcgcctacatccctgagaacaacccccggggcgtgtccctggtgtctgtgacagcccatgaccctgactgtgaagaaaatgcccagatcacctacagcctggccgagaacaccatccagggcgccagcctgagcagctatgtgtccatcaacagcgacacaggagtgctgtatgccctgagcagctttgattatgagcagttccgggacctgcaggtgaaggtgatggcccgggacaatggccacccccccctgagcagcaatgtgtccctgagcctgtttgtgctggaccagaatgacaatgcccctgagatcctgtacccagccctgcccacagatggcagcactggagtggagctggcccccaggtctgctgagcccggctacctggtgaccaaggtggtggccgtggaccgggacagcggccagaatgcctggctgagctaccgcctgctgaaggccagcgagcccggcctcttctctgtgggcctgcacactggagaggtgaggacagcccgggccctgctggacagagatgccctgaagcagagcctggtggtggccgtgcaggaccacggccagccccccctgagcgccaccgtgaccctgactgtggccgtggccgacagcatcccccaggtgctggccgacctgggcagcctggagagccctgccaacagcgagaccagtgacctgaccctgtacctggtggtggccgtggccgctgtgtcctgtgtgttcctggcctttgtgatcctgctgctggccctgcggctgcggcgctggcacaagagccggctgctgcaggccagcggcggcggcctgactggagccccagccagccactttgtgggcgtggatggagtgcaggccttcctgcagacctacagccatgaggtgtccctgaccacagacagcaggaagagccacctgatcttcccccagcccaactatgctgacatgctggtgtcccaggagagctttgagaagtctgagcccctgctgctgagcggggacagcgtcttcagcaaggacagccacggcctgattgagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166547 - DNA, 2799 bp, Artificial Sequence
  Description of Artificial Sequence: Synthetic coding sequence
atggccgccctgcagaagctgccccactgcaggaagctggtgctgctgtgcttcctgctggccaccctgtgggaggcccgggccggccagatccgctacagcgtgcgggaggagattgaccggggcagctttgtgggcaacatcgccaaggacctgggcctggagcccctggccctggccgagcagggcgtgcgcatcgtgtcccggggccgcagccagctgtttgccctgaaccccaggagcggcagcctggtgacagccaacagaattgaccgggaggagctgtgtgcccagagcgccccctgcctgctgaacttcaacatcctgctggaggacaagctgaccatctacagcgtggaggtggagatcacagacatcaatgacaatgcccccaggtttggagtggaggagctggagctgaagatcagcgagaccaccaccccaggcttccgcatccccctgaagaatgcccatgatgctgatgtgggggagaatgccctgcagaagtatgccctgaaccccaatgaccacttcagcctggatgtgagaagaggagcagatggcaacaagtacccagagctggtgctggagaggagcctggaccgggaggaggaggccgtgcaccacctggtgctggtggccagtgatggaggagaccctgtgctgagcggcaccagccgcatctgtgtgaaggtgctggatgccaatgacaatgcccctgtgttcacccagcctgagtaccgcatcagcatccctgagaacaccctggtgggcacccgcatcctgactgtgacagccacagatgctgatgagggctactatgcccaggtggtgtacttcctggagaagagccctggagagaccagcgaggtgtttgagctgaagagcaccagcggggagctgaccatcatcaaggacctggactatgaagatgccaccttccatgaaattgatattgaggcccaggacggccctggcctgctgacccgggccaaggtgattgtgacagtgctggatgtgaatgacaatgcccctgagttctacatgaccagcgccaccagctctgtgtctgaggacagcctgcccggcaccatcatcggcctcttcaacgtgcatgaccgggacagcggccagaatgccttcaccacctgcagcctgcctgaggacctgcccttcaagctggagaagtctgtggacaactactaccgcctggtgaccacccgggccctggaccgggagcagttctccttctacaacatcaccctgacagccaaggatggcggcaaccccagcctgagcacagatgcccacatcctgctgcaggtggccgacatcaatgacaatgccccagccttcagcaggaccagctacagcacctacatccctgagaacaaccccaggggggccagcgtcttctctgtgacagcccatgaccctgacagcaatgacaatgcccacgtgacctacagctttgctgaagatactgtgcagggcgcccccctgagcagctacatcagcatcaacagcgacacaggagtgctgtatgccctgcggagctttgattatgagcagctgcgggacctgcaggtgtgggtgattgcccgggacagcggcaacccccccctgagcagcaatgtgtccctgagcctgtttgtgctggaccagaatgacaatgcccctgagatcctgtacccagccttccccacagatggcagcactggagtggagctggcccccaggtctgctgagcccggctacctggtgaccaaggtggtggccgtggaccgggacagcggccagaatgcctggctgagctaccacctgctgaaggccagcgagcccggcctcttctctgtgggcctgcacactggagaggtgaggacagcccgggccctgctggacagagatgccctgaagcagagcctggtggtggccatccaggaccacggccagccccccctgagcgccaccgtgaccctgactgtggccgtggccgaccgcatcccagacatcctggccgacctgggcagcctggagcccagcgccatccccaatgacagcgacctgaccctgtacctggtggtggccgtggccgctgtgtcctgtgtgttcctggcctttgtgattgtgctgctggcccaccggctgcggcgctggcacaagagccggctgctgcaggccagcggcggcagcctgaccggcatgcagagcagccactttgtgggcgtggatggagtgcgggccttcctgcagacctacagccatgaggtgtccctgacagctgacagcaggaagagccacctgatcttcccccagcccaactatgctgacaccctcatcagccaggagagctgtgagaagaaggacttcctgagcgccccccagagcctgctggaggaggagcgggaggagaccttcagccagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166548 - DNA, 2799 bp, Artificial Sequence
  Description of Artificial Sequence: Synthetic coding sequence
atgaccaactgcctgtccttcagaaatggccggggcctggccctgctgtgtgccctgctgggcaccctgtgtgagaccggcagcggccagatccgctacagcgtgtctgaggagctggacaagggcagctttgtgggcaacatcgccaatgacctgggcctggagccccgggagctggccgagcggggcgtgcgcatcgtgtcccggggccgcacccagctgttcagcctgaacccccagagcggcagcctggtgacagctgagagaattgaccgggaggagctgtgtgcccagatccccctgtgcctggtgaagatcaacatcctggtggaggacaagctgaagatctttgaggtggagattgagatcaaggacatcaatgacaatgcccccaacttccccacagaggagctggagatcaagatcggggagctgactgtgcccggcacccgcttccccatcaagacagcctttgatcctgatgtgggcatcaacagcctgcagaactacaagctgagccccaatgactacttcagcctggccgtgaacagcgtgtctgagggcgccaagtacccagagctggtgctggagcgggccctggaccgggagaagaaggagatccaccagctggtgctggtggccagtgatggaggagaccctgtgcacagcggcaacctgcacatccaggtgattgtgctggatgccaatgacaacccccccatgttcacccagcctgagtacagagtgtctgtgtgggagaatgtgcctgtgggcacccggctgctgactgtgaatgccacagatcctgatgagggcttcaatgcccaggtgtcctacatcctggacaagatgcctgggaagattgctgagatcttccacctgaacagcgtgtctggagaggtgtccatcctgaagagcctggactatgaagatgccatgttttatgagatcaagattgaggcccaggacggccctggcctgctgagccgggccaagatcctggtgacagtgctggatgtgaatgacaatgcccctgagatcaccatcaccagcctgaccagctctgtgcctgaggagggcaccgtgggccgggagatcgccctgattgatgtgcatgaccgggacagcggccagaatggccaggtggaggtgtttgtgctgggcaacctgcccttcaagctggagaagagcattgaccagtactaccgcctggtgacagccaccagcctggaccgggagcagatcagcgagtacaacatcagcctgcgggccagtgatggcggcagcccccccctgagcacagagacccacatcaccctgcacgtgattgacatcaatgacaacccccccaccttcccccacctgagctacagcgcctacatccctgagaacaaccccaggggggccagcatcttctctgtgacagcccaggaccctgacagcaacaacaatgcccgcatcacctacgccctgacagaggacaccctgcagggcgcccccctgagcagctttgtgtccatcaacagcaacacaggagtgctgtatgccctgcggagctttgattatgagcagttccgggacctgaagctgctggtgacagccagtgacagcggcaacccccccctgagcagcaatgtgtccctgaacctgtttgtgctggaccagaatgacaatgcccctgagatcctgtacccagccctgcccacagatggcagcactggagtggagctggcccccaggtctgctgagcccggctacctggtgaccaaggtggtggccgtggaccgggacagcggccagaatgcctggctgagctaccgcctgctgaaggccagcgagcccggcctcttctctgtgggcctgcacactggagaggtgaggacagcccgggccctgctggacagagatgccctgaagcagagcctggtggtggccgtgcaggaccacggccagccccccctgagcgccaccgtgaccctgactgtggccgtggccgaccgcatcccagacatcctggccgacctgggcagcctggagcccagcgccaagcccaatgacagcgacctgaccctgtacctggtggtggccgtggccgctgtgtcctgtgtgttcctggcctttgtgattgtgctgctggccctgcggctgcggcgctggcacaagagccggctgctgcaggccagcggcggcggcctggccagcaccccaggcagccactttgtgggcgcagatggagtgcgggccttcctgcagacctacagccatgaggtgtccctgacagctgacagcaggaagagccacctgatcttcccccagcccaactatgctgacaccctcatcagccaggagagctgtgagaagtctgagcccctgctgatcacccaggacctgctggagatgaagggggacagcaacctgctgcagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166549 - DNA, 2796 bp, Artificial Sequence
  Description of Artificial Sequence: Synthetic coding sequence
atggccagccccccccggggctggggctgtggggagctgctgctgcccttcatgctgctgggcaccctgtgtgagcccggcagcggccagatccgctacagcatgcctgaggagctggacaagggcagctttgtgggcaacatcgccaaggacctgggcctggagccccaggagctggccgagcggggcgtgcgcatcgtgtcccggggccgcacccagctgtttgccctgaaccccaggagcggcagcctggtgacagctggaagaattgaccgggaggagctgtgtgcccagagccccctgtgtgtggtgaacttcaacatcctggtggagaacaagatgaagatctatggagtggaggtggagatcatcgacatcaatgacaacttcccccgcttcagagatgaggagctgaaggtgaaggtgaatgaaaatgctgctgctggcacccggctggtgctgccctttgccagagatgctgatgtgggcgtgaacagcctgcggagctaccagctgagcagcaacctgcacttcagcctggatgtggtgtctggaacagatggccagaagtacccagagctggtgctggagcagcccctggaccgggagaaggagaccgtgcatgacctgctgctgacagccctggatggaggagaccctgtgctgagcggcaccacccacatccgggtgacagtgctggatgccaatgacaatgcccccctcttcaccccatctgagtacagcgtgtctgtgcctgagaacatccctgtgggcacccggctgctgatgctgacagccacagatcctgatgagggcatcaacgggaagctgacctacagcttcagaaatgaggaggagaagatcagcgagaccttccagctggacagcaacctgggggagatcagcaccctgcagagcctggactatgaggagagccgcttctacctgatggaggtggtggcccaggatggaggagccctggtggccagcgccaaggtggtggtgacagtgcaggatgtgaatgacaatgcccctgaggtgatcctgaccagcctgaccagcagcatcagcgaggactgcctgcccggcaccgtcatcgccctcttctctgtgcatgatggagacagcggggagaatggagagatcgcctgcagcatccccaggaacctgcccttcaagctggagaagtctgtggacaactactaccacctgctgaccacccgggacctggaccgggaggagaccagtgactacaacatcaccctgactgtgatggaccacggcaccccacccctgagcacagagagccacatccccctgaaggtggctgatgtgaatgacaacccccccaacttcccccaggccagctacagcacctctgtgacagagaacaacccccggggcgtgtccatcttctctgtgacagcccatgaccctgattctggggacaatgcccgggtgacctacagcctggccgaggacaccttccagggcgcccccctgagcagctatgtgtccatcaacagcgacacaggagtgctgtatgccctgcggagctttgattatgagcagctgcgggacctgcagctgtgggtgacagccagtgacagcggcaacccccccctgagcagcaatgtgtccctgagcctgtttgtgctggaccagaatgacaacaccccagagatcctgtacccagccctgcccacagatggcagcactggagtggagctggcccccaggtctgctgagcccggctacctggtgaccaaggtggtggccgtggacaaggacagcggccagaatgcctggctgagctaccgcctgctgaaggccagcgagcccggcctgtttgctgtgggcctgcacactggagaggtgaggacagcccgggccctgctggacagagatgccctgaagcagagcctggtggtggccgtggaggaccacggccagccccccctgagcgccaccttcaccgtgacagtggccgtggccgaccgcatcccagacatcctggccgacctgggcagcatcaagacccccatcgaccctgaggacctggacctgaccctgtacctggtggtggccgtggccgctgtgtcctgtgtgttcctggcctttgtgattgtgctgctggtgctgcggctgcggcgctggcacaagagccggctgctgcaggccgagggcagccggctggccggcgtgcctgccagccactttgtgggcgtggatggagtgcgggccttcctgcagacctacagccatgaggtgtccctgacagctgacagcaggaagagccacctgatcttcccccagcccaactatgctgacaccctgctgtctgaggagagctgtgagaagtctgagcccctgctgatgtctgacaaggtggatgccaacaaggaggagcggcgggtgcagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166550 - DNA, 2799 bp, Artificial Sequence
  Description of Artificial Sequence: Synthetic coding sequence
atggccccaccccagaggcacccccagaggtctgagcaggtgctgctgctgaccctgctgggcaccctgtggggcgctgctgctgcccagatccgctacagcatccctgaggagctggagaagggcagctttgtgggcaacatcgtgaaggacctgggcctggagccccaggagctggccgagcacggcgtgcgcatcgtgtcccggggccgcatgcagctgttcagcctgaaccccagaaatggcagcctggtgacagctggaagaattgaccgggaggagctgtgtgcccagagcccccgctgcctggtgtccttcaacatcctggtggaggacaagctgaacctgtaccctgtggaggtggagatcgtggacatcaatgacaacaccccccgcttcctgaaggaggagctggaggtgaagatcctggagaatgctgcccccagcagccgcttccccctgatggaggtgtatgaccctgatgtgggcatgaacagcctgcagggcttcaagctgagcggcaacagccacttctctgtggatgtgcagagcgaggcccacggccccaagtacccagagctggtgctggagggcaccctggaccgggagggggaggccgtgtaccgcctggtgctgacagccatggatggaggagaccctgtgcgcagctctgtggcccagatcctggtgacagtgctggatgtgaatgacaacacccccatgttcacccagcctgtgtacagagtgtctgtgcctgagaacctgcctgtgggcacccctgtgctggccgtgacagccacagaccaggatgagggcgtgcacggggaggtgacctacagctttgtgaagatcacagagaagatcagccagatcttctgcctgaatgtgctgaccggggagatcagcaccagcgccaacctggactatgaggacagcagcttctatgagctgggcgtggaggccagagatggccctggcctgcgggaccgggccaaggtgctgatcaccatcctggatgtgaatgacaacgtgcctgaggtggtggtgaccagcggcagcaggaccatcgccgagagcgcccctcctggcaccgtcatcgccctcttccaggtgtttgaccgggacagcggcctgaatggcctggtgacctgcagcatccccaggagcctgccctttgagctggagaagtctgtgggcaactactaccgcctggtgaccaatgctgccctggaccgggaggaggtgttcctgtacaacatcaccgtgacagccacagacaagggcaccccacccctgagcacagagaccatcatcagcctgaatgtggccgacaccaatgacaacccccccaccttcccccacagcagctacagcgtgtatgtgctggagaacaaccccaggggggccagcatcttctctgtgaatgccctggaccctgatgtggaccagaatgcccaggtgtcctacagcctggccgaggacaccctgcagggcgcccccctgagcagctatgtgtccatcaacagcgacaccggcatcctgtatgccctgcggagctttgattatgagcagctgcgggacctgcagctgtgggtgacagccagtgacagcggggacccccccctgagcagcaatgtgtccctgagcctgtttgtgctggaccagaatgacaatgcccctgagatcctgtacccagccctgcccacagatggcagcactggagtggagctggcccccaggtctgctgagcccggctacctggtgaccaaggtggtggccgtggaccgggacagcggccagaatgcctggctgagctaccgcctgctgaaggccagcgagcccggcctcttctctgtgggcctgcacactggagaggtgaggacagcccgggccctgctggacagagatgccctgaagcagagcctggtggtggccgtgcaggaccacggccagccccccctgagcgccaccgtgaccctgactgtggccgtggccgaccgcatcccagacatcctggccgacctgggcagcctggagcccagcgccaagcccaatgacagcgacctgaccctgtacctggtggtggccgtggccgctgtgtcctgtgtgttcctggcctttgtgattgtgctgctggccctgcggctgcagcgctggcacaagagccggctgctgcaggccagcggcggcggcctggcctccatgcctggcagccactttgtgggcgtggagggcgtgcgggccttcctgcagacctacagccatgaggtgtccctgacagctgacagcaggaagagccacctgatcttcccccagcccaactatgctgacaccctcatcaaccaggagagctatgagaagtctgagcccctgctgatcacccaggacctgctggagaccaagggggagccccggcagctgcagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166551 - DNA, 2799 bp, Artificial Sequence
  Description of Artificial Sequence: Synthetic coding sequence
atggccgcccagccccggggcggggactaccggggcttcttcctgctgagcatcctgctgggcaccccctgggaggcctgggccggccgcatcctgtacagcgtgtctgaggagacagacaagggcagctttgtgggggacatcgccaaggacctgggcctggagccccgggagctggccgagcggggcgtgcgcatcatcagccggggccgcacccagctgtttgccctgaaccagaggagcggcagcctggtgacagctggaagaattgaccgggaggagatctgtgcccagagcgcccgctgcctggtgaacttcaacatcctgatggaggacaagatgaacctgtaccccattgatgtggagatcatcgacatcaatgacaacgtgccccgcttcctgacagaggagatcaacgtgaagatcatggagaacacagcccctggggtgcgcttccccctgtctgaggccggggaccctgatgtgggcaccaacagcctgcagagctaccagctgagccccaacagacacttcagcctggccgtgcagagcggagatgatgagaccaagtacccagagctggtgctggagcgggtgctggaccgggaggaggagcgggtgcaccacctggtgctgacagccagtgatggaggagacccccccaggagcagcacagcccacatccaggtgacagtggtggatgtgaatgaccacacccctgtgttcagcctgccccagtaccaggtgacagtgcctgaaaatgtgcctgtgggcacccggctgctgactgtgcacgccatcgacctggatgagggcgtgaatggagaggtgacctacagcttcaggaagatcacccccaagctgcccaagatgttccacctgaacagcctgaccggggagatcagcaccctggagggcctggactatgaggagacagccttctatgagatggaggtgcaggcccaggacggccctggcagcctgaccaaggccaaggtgctgatcaccgtgctggatgtgaatgacaatgcccctgaggtgaccatgaccagcctgagcagcagcatccctgaggacacccccctgggcaccgtcatcgccctcttctacctgcaggaccgggacagcggcaagaatggagaggtgacctgcaccatccctgagaacctgcccttcaagctggagaagagcattgacaactactaccgcctggtgaccaccaagaacctggaccgggagaccctgagcctgtacaacatcaccctgaaggccacagatggcggcaccccacccctgagccgggagacccacatcttcatgcaggtggccgacaccaatgacaacccccccaccttcccccacagcagctacagcgtgtacatcgccgagaacaaccccaggggggccagcatcttcctggtgacagcccaggaccatgattctgaggacaatgcccagatcacctacagcctggccgaggacaccatccagggcgcccctgtgtcctcctatgtgtccatcaacagcgacacaggagtgctgtatgccctgcagagctttgattatgagcagctgcgggagctgcagctgcgggtgacagcccatgattctggggacccccccctgagcagcaacatgagcctgagcctgtttgtgctggaccagaatgacaaccccccagagatcctgtacccagccctgcccacagatggcagcacaggcatggagctggcccccaggtctgctgagcccggctacctggtgaccaaggtggtggccgtggacaaggacagcggccagaatgcctggctgagctacctgctgctgaaggccagcgagcccggcctgtttgctgtgggcctgtacacaggagaggtgaggacagcccgggccctgctggacagagatgccctgaagcagagcctggtggtggccgtgcaggaccacggccagccccccctgagcgccaccgtgaccctgactgtggccgtggccgacagcatccctgaggtgctggccgacctgggcagcctggagcccagtgatggcccctacaactatgacctgaccctgtacctggtggtggccgtggccaccgtgtcctgtgtgttcctggcctttgtgctggtgctgctggccctgcggctgcggcgctggcacaagagccggctgctgcaggccagcgagggcggcctggccaacgtgcccaccagccactttgtgggcatggatggagtgcaggccttcctgcagacctacagccatgaggtgtccctgacagctgacagcaggaagagccacctgatcttcccccagcccaactacgtggacatgctgatcagccaggagagctgtgagaagaatgacagcctgctgacctctgtggacttccaggagtgcaaggagaacctgcccagcatccagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166552 - DNA, 2799 bp, Artificial Sequence
  Description of Artificial Sequence: Synthetic coding sequence
atggccgccccccagagccggcccaggagaggagagctgatcctgctgtgtgccctgctgggcaccctgtgggagatcggccggggccagatccgctacagcgtgcctgaggagacagacaagggcagctttgtgggcaacatcagcaaggacctgggcctggaccccaggaagctggccaagcacggcgtgcgcatcgtgtcccggggccgcacccagctgtttgccctgaaccccaggagcggcagcctcatcacagctggaagaattgaccgggaggagctgtgtgcccagagcccccgctgcctgatcaacatcaacaccctggtggaggacaagggcaagctgtttggagtggagattgagatcatcgacatcaatgacaacaaccccaagttccaggtggaggacctggaggtgaagatcaatgaaattgctgtgcctggggcccgctaccccctgcctgaggccgtggaccctgatgtgggcgtgaacagcctgcagagctaccagctgagccccaaccaccacttcagcctggatgtgcagacaggagacaatggagccatcaaccctgagctggtgctggagcgggccctggaccgggaggaggaggccgcccaccacctggtgctgacagccagtgatggcggcaagccacccaggagcagcacagtgcgcatccacgtgacagtgctggacaccaatgacaatgcccctgtgttcccccaccccatctacagagtgaaggtgctggagaacatgcctcctggcacccggctgctgactgtgacagccagtgaccctgatgagggcatcaacgggaaggtggcctacaagttcaggaagatcaatgagaagcagacccccctcttccagctgaatgaaaatactggagagatcagcatcgccaagagcctggactatgaagaatgttccttctatgagatggagatccaggccgaggatgtgggcgccctgctgggccgcaccaagctgctgatctctgtggaggatgtgaatgacaacagacctgaggtgatcatcaccagcctcttcagccctgtgctggagaacagcctgcccggcaccgtcatcgccttcctgtctgtgcatgaccaggacagcggcaagaatggccaggtggtgtgctacacccgggacaacctgcccttcaagctggagaagagcatcggcaactactaccgcctggtgaccaggaagtacctggacagagaaaatgtgtccatctacaacatcaccgtgatggccagtgacctgggcaccccacccctgagcacagagacccagatcgccctgcacgtggccgacatcaatgacaacccccccaccttcccccacgccagctacagcgcctacatcctggagaacaacctgcggggggccagcatcttcagcctgacagcccatgaccctgacagccaggagaatgcccaggtgacctacagcgtgacagaggacaccctgcagggcgcccccctgagcagctacatcagcatcaacagcgacacaggagtgctgtatgccctgcagagctttgattatgagcagatccgggacctgcagctgctggtgacagccagtgacagcggggacccccccctgagcagcaacatgagcctgagcctgtttgtgctggaccagaatgacaatgcccctgagatcctgtacccagccctgcccacagatggcagcactggagtggagctggcccccaggtctgctgagcggggctacctggtgaccaaggtggtggccgtggaccgggacagcggccagaatgcctggctgagctaccgcctgctgaaggccagcgagcccggcctcttctctgtgggcctgcacactggagaggtgaggacagcccgggccctgctggacagagatgccctgaagcagagcctggtggtggccgtgcaggaccacggccagccccccctgagcgccaccgtgaccctgactgtggccgtggccgacagcatccctgaggtgctgacagagctgggcagcctgaagcccagcgtggaccccaatgacagcagcctgaccctgtacctggtggtggccgtggccgccatcagctgtgtgttcctggcctttgtggccgtgctgctgggcctgcggctgcggcgctggcacaagagccggctgctgcaggacagcggcggccgcctggtgggcgtgcctgccagccactttgtgggcgtggaggaggtgcaggccttcctgcagacctacagccaggaggtgtccctgacagctgacagcaggaagagccacctgatcttcccccagcccaactatgctgacatgctgatcagccaggagggctgtgagaagaatgacagcctgctgacctctgtggacttccacgagtacaagaatgaggccgaccacggccagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166553 - DNA, 2784 bp, Artificial Sequence
  Description of Artificial Sequence: Synthetic coding sequence
atgcagagggcccgggaggccgagatgatgaagagccaggtgctcttccccttcctgctgagcctcttctgtggggccatcagccagcagatccgctacaccatccctgaggagctggccaacggcagccgggtgggcaagctggccaaggacctgggcctgtctgtgcgggagctgcccaccaggaagctgcgggtgtctgctgaggactacttcaacgtgtccctggagagcggggacctgctggtgaatggaagaattgaccgggagaagatctgtggcaggaagctggagtgtgccctggagtttgaaacagtggccgagaaccccatgaatgtgttccacgtggtggtggtgatccaggacatcaatgacaatgcccccaggtttgtggccaagggcatcgacctggagatctgtgagagcgccctgcccggggtgaagttcagcctggacagcgcccaggatgctgatgtggagggcaacagcctgaagctgtacaccatcaaccccaaccagtacttcagcctgagcaccaaggagagcccagatggcagcaagtaccctgtgctgctgctggagaagcccctggaccgggagcaccagagcagccacaggctcatcctgacagccatggatggaggagacccccccctgagcggcaccacccacatctggatccgggtgacagatgccaatgacaatgcccctgtgttcagccaggaggtgtacagagtgtccctgcaggagaatgtgccctggggcacctctgtgctgcgggtgatggccacagaccaggatgagggcatcaatgctgagatcacctacgccttcctgaacagccccatcagcaccagcctcttcaacctgaaccccaacacaggagacatcaccaccaacggcaccctggactttgaggagaccagccgctacgtgctgtctgtggaggccaaggatggaggagtgcacacagcccactgcaatgtgcagattgaaattgtggatgaaaatgacaatgcccctgaggtgaccttcatgtccttcagcaaccagatccctgaggacagcgacctgggcaccgtcatcgccctgatcaaggtgcgggacaaggacagcggccagaatggcatggtgacctgctacacccaggaggaggtgcccttcaagctggagagcaccagcaagaactactacaagctggtgattgctggggccctgaaccgggagcagacagctgactacaacgtgaccatcatcgccacagacaagggcaagccagccctgagcagcaggaccagcatcaccctgcacatcagtgacatcaatgacaatgcccctgtgttccaccaggccagctatgtggtgcacgtgtctgagaacaaccccccaggggccagcatcgcccaggtgtctgccagtgaccctgacctgggccccaacggccgggtgtcctacagcatcctggccagtgacctggagccccgggagctgctgtcctatgtgtctgtgagcccccagagcggcgtggtgtttgcccagagggcctttgaccacgagcagctgcgggcctttgagctgaccctgcaggcccgggaccagggcagccctgccctgagcgccaacgtgtccctgcgggtgctggtgggggacctgaatgacaatgccccccgggtgctgtacccagccctgggcccagatggcagcgccctgtttgacatggtgcccagggctgctgagcccggctacctggtgaccaaggtggtggccgtggatgctgacagcggccacaatgcctggctgagctaccacgtgctgcaggccagcgagcccggcctcttcagcctgggcctgaggactggagaggtgaggacagcccgggccctgggggacagagatgctgcccggcagaggctgctggtggccgtgagagatggcggccagccccccctgagcgccacagccaccctgcacctgatctttgctgacagcctgcaggaggtgctgcctgacctgagtgacaggcctgagcccagcgacccccagacagagctgcagttctacctggtggtggccctggccctgatctctgtgctcttcctgctggccgtcatcctggccatcgccctgcggctgcggcgcagcagcagcctggacacagagggctgcttccagacaggcctgtgcagcaagagcggccctggggtgccccccaaccacagcgagggcaccctgccctacagctacaacctgtgcatcgccagccacagcgccaagacagagttcaacagcctgaacctgaccccagagatggccccaccccaggacctgctgtgtgatgaccccagcatggtggtgtgtgccagcaatgaagaccacaagatcgcctatgaccccagcctgagcagccaccaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166554 - DNA, 2796 bp, Artificial Sequence
  Description of Artificial Sequence: Synthetic coding sequence
atgaaggccagcagcggccgctgtggcctggtgcgctggctgcaggtgctgctgcccttcctgctgagcctcttccctggggccctgcctgtgcagatccgctacagcatccctgaggagctggccaagaacagcgtggtgggcaacctggccaaggacctgggcctgtctgtgcgggacctgcctgccaggaagctgcgggtgtctgctgagaaggagtacttcaccgtgaaccctgagagcggggacctgctggtgtctgacagaattgaccgggagcagatctgtgggaagcagcccctgtgtgtgctggactttgacacagtggccgagaaccccctgaacatcttctacatcgccgtcatcgtgcaggacatcaatgacaacacccccctcttcaagcagaccaagatcaacctgaagatcggggagagcaccaagccaggcaccaccttccccctggaccctgccctggacagtgatgtgggccccaacagcctgcagcgctaccacctgaatgacaatgagtactttgacctggccgagaagcagaccccagatggcaggaagtacccagagctgatcctgaagcacagcctggaccgggaggagcacagcctgcaccagctggtgctgacagctgtggatggaggagaccccccccagagcggcaccacccagatccgcatcaaggtgacagatgccaatgacaacccccctgtgttcagccaggatgtgtacagagtgaccctgagagaagatgtgcccccaggcttctttgtgctgcaggtgacagccacagacagagatgagggcatcaatgctgagatcacctacagcttccacaacgtggatgagcaggtgaagcacttcttcaacctgaatgagaagacaggagagatcaccaccaaggatgacctggactttgaaattgccagcagctacaccctgagcattgaggccaaggaccccggggacctggccgcccactgcagcatccaggtggagatcctggatgacaatgactgtgcccctgaggtgattgtgacctctgtgtccacccccctgcctgaggacagccccccaggcaccgtcatcgccctgatcaagacccgggaccgggacagcggggagaatggagaggtgtactgccaggtgctgggcaatgccaagttcatcctgaagagcagcagcaagaactactacaagctggtgacagatggagccctggaccgggaggagatccctgagtacaacctgaccatcacagccacagatggcggcaagccacccctgagcagcagcatcatcgtgaccctgcacatcagtgatgtgaatgacaatgcccctgtgttccagcagaccagctacatggtgcacgtggccgagaacaaccccccaggggccagcatcgcccagatcagcgccagtgaccctgacctgggccccagcggccaggtgtcctacagcatcgtggccagtgacctgaagccccgggagatcctgtcctatgtgtctgtgtctgcccagagcggcgtggtgtttgcccagagggcctttgaccacgagcagctgcgggcctttgagctgaccctgcaggcccgggaccagggcagccctgccctgagcgccaacgtgtccctgcgggtgctggtgggggacctgaatgacaatgccccccgggtgctgtacccagccctgggcccagatggcagcgccctgtttgacatggtgcccagggctgctgagcccggctacctggtgaccaaggtggtggccgtggatgctgacagcggccacaatgcctggctgagctaccacgtgctgcaggccagcgagcccggcctcttcagcctgggcctgaggactggagaggtgaggacagcccgggccctgggggacagagatgctgcccggcagaggctgctggtggccgtgagagatggcggccagccccccctgagcgccacagccaccctgcacctgatctttgctgacagcctgcaggaggtgctgcctgacctgagtgaccggcgggagcccagcgacccccaggccaagctgcagttctacctggtggtggccctggccctgatctctgtgctcttcttcctggccgtcatcctggccatcagcctgcggctgcggctgagcagcagaagtgatgcctgggactgcttccagcccggcctgagcagcaagccaggccctggggtgctgcccaactacagcgagggcaccctgccctacagctacaacctgtgtgtggccagccagagcgccaagacagagttcaacttcctgaacatcaccccagagctggtgcctgcccaggacctggtgtgtgacaatgcctcctgggagcagaacaccaaccacggggccgccggcgtgccctttgccagtgacaccatcctgaagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166555 - DNA, 2772 bp, Artificial Sequence
  Description of Artificial Sequence: Synthetic coding sequence
atgggcagcggggccggggagctgggccgggcagagcggctgcctgtgctcttcctgttcctgctgagcctcttctgcccagccctgtgtgagcagatccgctaccgcatccctgaggagatgcccaagggctctgtggtgggcaacctggccacagacctgggcttctctgtgcaggagctgcccaccaggaagctgcgggtgagcagcgagaagccctacttcaccgtgtctgctgagagcggggagctgctggtgagcagccggctggaccgggaggagatctgtgggaagaagccagcctgtgccctggagtttgaggccgtggccgagaaccccctgaacttctaccacgtgaatgtggagattgaggacatcaatgaccacacccccaagttcacccagaacagctttgagctgcagatcagcgagagcgcccagcccggcacccgcttcatcctgggcagcgcccatgatgctgacatcggcagcaacaccctgcagaactaccagctgagccccagcgaccacttcagcctcatcaacaaggagaagagtgatggcagcaagtacccagagatggtgctgaagacccccctggaccgggagaagcagaagagctaccacctgaccctgacagccctggactttggagccccacccctgagcagcacagcccagatccacgtgctggtgacagatgccaatgacaatgcccctgtgttcagccaggatgtgtacagagtgtccctgtctgaaaatgtgtacccaggcaccaccgtgctgcaggtgacagccacagaccaggatgagggcgtgaatgctgagatcaccttctccttcagcgaggccagccagatcacccagtttgacctgaacagcaacacaggagagatcaccgtgctgaacaccctggactttgaggaggtgaaggagtacagcatcgtgctggaggccagagatggcggcggcatgattgcccagtgcaccgtggaggtggaggtgattgatgaaaatgacaatgcccctgaggtgatcttccagagcctgcccaacctgatcatggaggatgctgagctgggcacccacatcgccctgctgaaggtgcgggacaaggacagccgccacaatggagaggtgacctgcaagctggagggagatgtgcccttcaagatcctgaccagcagcaggaacacctacaagctggtgacagatgctgtgctggaccgggagcagaaccctgagtacaacatcaccgtgacagccacagaccggggcaagccacccctgagcagcagcagcagcatcaccctgcacatcggagatgtgaatgacaatgcccctgtgttcagccagagcagctacatcgtgcacgtggccgagaacaaccccccaggggccagcatcagccaggtgcgggccagtgaccctgacctgggccccaacggccaggtgtcctactgcatcatggccagtgacctggagcagcgggagctgagcagctatgtgtccatctctgctgagagcggcgtggtgtttgcccagagggcctttgaccacgagcagctgcgggcctttgagctgaccctgcaggcccgggaccagggcagccctgccctgagcgccaacgtgtccctgcgggtgctggtggatgacagaaatgacaatgccccccgggtgctgtacccagccctgggcccagatggcagcgccctgtttgacatggtgccccatgctgctgagcccggctacctggtgaccaaggtggtggccgtggatgctgacagcggccacaatgcctggctgagctaccacgtgctgcaggccagcgagcccggcctcttcagcctgggcctgaggactggagaggtgaggacagcccgggccctgggggacagagatgctgtgcggcagaggctgctggtggccgtgagagatggcggccagccccccctgagcgccacagccaccctgcacctggtgtttgctgacagcctgcaggaggtgctgcctgacatcacagacagaccagaccccagcgacctgcaggccgagctgcagttctacctggtggtggccctggccctgatctctgtgctcttcctggtggccatgatcctggccatcgccctgcggctgcggcgcagcagcagccctgcctcctggagctgcttccagcccggcctgtgtgtgaagtctgagagcgtggtgccccccaactacagcgagggcaccctgccctacagctacaacctgtgtgtggcccacacaggcaagacagagttcaacttcctgaagtgcagcgagcagctgagcagcggccaggacatcctgtgtggggacagcagcggggccctcttccccctgtgcaacagcagcgagctgaccagccaccagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166556 - DNA, 2793 bp, Artificial Sequence
  Description of Artificial Sequence: Synthetic coding sequence
atgggcggcagctgtgcccagaggagaagagctggcccccggcaggtgctcttccccctgctgctgcccctcttctaccccaccctgtctgagcccatccgctacagcatccctgaggagctggccaagggctctgtggtgggcaacctggccaaggacctgggcctgtctgtgctggatgtgtctgccaggaagctgcgggtgtctgctgagaagctgcacttctctgtggatgctgagagcggggacctgctggtgaagaacagaattgaccgggagcagatctgcaaggagcggcggcgctgtgagctgcagctggaggccgtggtggagaaccccctgaacatcttccacgtgattgtggtgattgaagatgtgaatgaccacgccccccagtttgacaagaaggagatccacctggagatctttgaaagtgccagcgctggcacccggctgagcctggaccctgccacagatcctgacatcaacatcaacagcatcaaggactacaagatcaacagcaacccctacttcagcctgatggtgcgggtgaacagtgatggcggcaagtacccagagctgagcctggagaagctgctggaccgggaggagcagaggagccacagcctcatcctgacagccctggatggaggagacccccccaggtctgccacagcccacatcgagatctctgtgaaggacaccaatgacaacccccctgtgttcagcagagatgagtaccgcatcagcctgtctgagaacctgcccccaggcagccctgtgctgcaggtgacagccacagaccaggatgagggcgtgaatgctgagatcaactactacttccgcagcacagcccagagcaccaagcacatgttcagcctggatgagaagacaggcatgatcaagaacaaccagagctttgattttgaagatgtggagcgctacaccatggaggtggaggccaaggatggcggcggcctgagcacccagtgcaaggtgatcatcgagatcctggatgaaaatgacaacagccctgagatcatcatcaccagcctgagtgaccagatcctggagaacagccccccaggcatggtggtggccctcttcaagacccgggacctggactttggaggaaatggagaggtgcgctgcaacatcgagacagacatccccttcaagatctacagcagcagcaacaactactacaagctggtgacagatggagccctggaccgggagcagaccccagagtacaacgtgaccatcgtggccacagaccggggcaagccacccctgagcagcagccgcagcatcaccctgtatgtggccgacatcaatgacaatgcccctgtgtttgaccagaccagctatgtggtgcacgtggccgagaacaaccccccaggggccagcatcgcccaggtgtctgccagtgaccctgacctgggcctgaatggccacatctcctacagcatcgtggccagtgacctggagcccctggccgtgtcctcctatgtgtctgtgtctgcccagagcggcgtggtgtttgcccagagggcctttgaccacgagcagctgcgggcctttgccctgaccctgcaggcccgggaccacggcagccccaccctgagcgccaacgtgtccctgcgggtgctggtgggggacagaaatgacaatgccccccgggtgctgtacccagccctgggcccagatggcagcgccttctttgacatggtgcccaggtctgctgagcccggctacctggtgaccaaggtggtggccgtggatgctgacagcggccacaatgcctggctgagctaccacgtgctgcaggccagcgagcccggcctcttcagcctgggcctgaggactggagaggtgaggacagcccgggccctgggggacagagatgctgcccggcagaggctgctggtggccgtgagagatggcggccagccccccctgagcgccacagccaccctgcacctggtgtttgctgacaacctgcaggagatcctgcctgacctgagtgacaggcctgtgctgagtgacccccaggccgagctgcagttctacctggtggtggccctggccctgatctctgtgctcttcctgctggccgtcatcctggccatcgccctgcggctgcggcgcagcctgagccctgccacctgggactgcttccaccctggcctgtgtgtgaagagcggccctgtggtgccccccaactacagcgagggcaccctgccctacagctacaacctgtgcatcgcccacacaggcaccaaggagttcaacttcctgaagtgcagcgtgcccctgcacagcaatgaagacatggtgtgcagcgtgtcccctggggccctgatccccccccacggcggggaggacctgaccagccaccctgagaccctgaccagccaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166557 - DNA, 2790 bp, Artificial Sequence
  Description of Artificial Sequence: Synthetic coding sequence
atgggcggcagctgtgcccagaggagaagagctggcccccggcaggtgctcttccccctgctgctgcccctcttctaccccaccctgtgtgagcccatccgctacagcatccctgaggagctggccaagggctctgtggtgggcaacctggccaaggacctgggcctgtctgtgctggatgtgtctgcccgggagctgcgggtgtctgctgagaagctgcacttctctgtggatgcccagagcggggacctgctggtgaaggacagaattgaccgggagcagatctgcaaggagcggcggcgctgtgagctgcagctggaggccgtggtggagaaccccctgaacatcttccacgtgattgtggtgattgaagatgtgaatgaccacgccccccagttcaggaaggatgagatcaacctggagatcagcgagagcgtgtccctgggcatgggcaccatcctggagagcgctgaggaccctgacatctccatgaacagcctgagcaagtaccagctgagccccaatgagtacttcagcctggtggagaaggacaacccagatggcggcaagtacccagagctggtgctgcagaagaccctggaccgggagacccagagcgcccaccacctggtgctgacagccctggatggaggagacccccccaggtctggaacagcccagatccgcatcctggtgattgatgccaatgacaacccccctgtgttcagccaggatgtgtacagagtgtccctgagagaagatgtgcccccaggcaccagcatcctgcgggtgaaggccacagaccaggatgagggcatcaacagcgagatcacctacagcttcttcggcgtggccgacaaggcccagcacgtgttcagcctggactacaccaccggcaacatcctgacccagcagcccctggactttgaggaggtggagcgctacaccatcaacatcgaggccaaggaccggggcagcctgagcacccgctgcaaggtgattgtggaggtggtggatgaaaatgacaacagccctgagatcatcatcaccagcctgagtgaccagatcatggaggacagccccccaggagtggtggtggccctcttcaagacccgggaccaggacagcggggagaatggagaggtgcgctgcagcctgagcagaggagtgcccttcaagatccacagcagcagcaacaactactacaagctggtgacagatgaggccctggaccgggagcagaccccagagtacaacgtgaccatcgccgccacagaccggggcaagccacccctgagcagcagcaagaccatcaccctgcacatcacagatgtgaatgacaatgcccctgtgtttggccagagcgcctacctggtgcacgtgcctgagaacaaccagcccggggccagcatcgcccaggtgtctgccagtgaccctgactttggcctgaatggccgggtgtcctacagcctcatcgccagtgacctggagagcaggaccctgagcagctatgtgtctgtgtctgcccagagcggcgtggtgtttgcccagagggcctttgaccacgagcagctgcggacctttgagctgaccctgcaggcccgggaccagggcagccctgccctgagcgccaacgtgtccctgcgggtgctggtgggggacagaaatgacaatgccccccgggtgctgtacccagccctgggcccagatggcagcgccctgtttgacacagtgcccagggctgcccagcccggctacctggtgaccaaggtggtggccgtggatgctgacagcggccacaatgcctggctgagctaccacgtggtgcaggccagcgagcccggcctcttcagcctgggcctgaggactggagaggtgaggatggtgcgggccctgggggacaaggacagcgtgcggcagaggctgctggtggccgtgagagatggcggccagccccccctgagcgccacagccaccctgcacctggtgtttgctgacagcctgcaggaggtgctgcctgacttcagtgaccaccccacccccagcgacagccaggccgagatgcagttctacctggtggtggccctggccctgatctctgtgctcttcctgctggccgtcatcctggccatcgccctgcggctgcggcagagcttcagccccacagctggggactgctttgaatctgtgctgtgcagcaagagcggccctgtgggcccccccaactacagcgagggcaccctgccctatgcctacaacttctgtgtgcctggggaccagatgaaccctgagttcaacttcttcacctctgtggaccactgcccagccacccaggacaacctgaacaaggacagcatgctgctggccagcatcctgaccccatctgtggaggccgacaagaagatcctgaagcagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166558 - DNA, 2805 bp, Artificial Sequence
  Description of Artificial Sequence: Synthetic coding sequence
atggtgcctgaggcctggaggagcggcctggtgtccacaggccgggtggtgggcgtgctgctgctgctgggcgccctgaacaaggccagcaccgtcatccactatgagatccctgaggagcgggagaagggctttgctgtgggcaatgtggtggccaacctgggcctggacctgggcagcctgagcgcccggcgcttccgggtggtgtctggggccagccgccgcttctttgaggtgaaccgggagactggagagatgtttgtgaatgaccggctggaccgggaggagctgtgtggcaccctgcccagctgcaccgtgaccctggagctggtggtggagaaccccctggagctgttctctgtggaggtggtgatccaggacatcaatgacaacaacccagccttccccacccaggagatgaagctggagatcagcgaggccgtggcccctggcacccgcttccccctggagagcgcccatgaccctgatgtgggcagcaacagcctgcagacctatgagctgagcagaaatgagtactttgccctgcgggtgcagacccgggaggacagcaccaagtatgcagagctggtgctggagcgggccctggaccgggagcgggagcccagcctgcagctggtgctgacagccctggatggcggcaccccagccctgagcgccagcctgcccatccacatcaaggtgctggatgccaatgacaatgcccctgtgttcaaccagagcctgtaccgggcccgggtgctggaggatgcccccagcggcaccagggtggtgcaggtgctggccacagacctggatgagggccccaacggggagatcatctacagctttggcagccacaacagagctggggtgcggcagctgtttgccctggacctggtgacaggcatgctgaccatcaagggccgcctggactttgaggacaccaagctgcacgagatctacatccaggccaaggacaagggggccaaccctgagggcgcccactgcaaggtgctggtggaggtggtggatgtgaatgacaatgcccctgagatcaccgtgacctctgtgtacagccctgtgcctgaagatgcccccctgggcaccgtgattgccctgctgtctgtgacagacctggatgctggagaaaatggcctggtgacctgtgaggtgcccccaggcctgcccttcagcctgaccagcagcctgaagaactacttcaccctgaagaccagcgctgacctggaccgggagaccgtgcctgagtacaacctgagcatcacagccagagatgctggcacccccagcctgagcgccctgaccatcgtgcgggtgcaggtgtctgacatcaatgacaaccccccccagagcagccagagcagctatgatgtgtacatcgaggagaacaacctgcccggggcccccatcctgaacctgtctgtgtgggaccctgatgccccccagaatgcccggctgtccttcttcctgctggagcagggcgctgagaccggcctggtgggccgctacttcaccatcaacagagacaatggcatcgtgagcagcctggtgcccctggactatgaggaccggcgggagtttgagctgacagcccacatcagtgatggcggcacccctgtgctggccaccaacatctctgtgaacatctttgtgacagacagaaatgacaatgccccccaggtgctgtaccccaggcctgggggcagctctgtggagatgctgccccggggcaccagcgctggccacctggtgtcccgggtggtgggctgggatgctgatgctggccacaatgcctggctgagctacagcctgctgggcagccccaaccagagcctgtttgccatcggcctgcacacaggccagatcagcacagcccggcctgtgcaggacacagacagcccccggcagaccctgactgtgctgatcaaggacaatggagagcccagcctgagcaccacagccaccctgactgtgtctgtgacagaggacagccctgaggcccgggcagagttccccagcggcagcgccccccgggagcagaagaagaacctgaccttctacctgctgctgagcctcatcctggtgtctgtgggctttgtggtgacagtgtttggagtcatcatcttcaaggtgtacaagtggaagcagagccgggacctgtaccgggcccctgtgagcagcctgtaccgcaccccaggccccagcctgcacgcagatgctgtgcggggcggcctgatgagcccccacctgtaccaccaggtgtacctgaccacagacagcagaagaagtgaccccctgctgaagaagccaggggccgccagccccctggccagccggcagaacaccctgcggagctgtgaccccgtcttctaccggcaggtgctgggcgctgagagcgcccctcctggccagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166559 - DNA, 2817 bp, Artificial Sequence
  Description of Artificial Sequence: Synthetic coding sequence
atgctgaggaaggtgcgctcctggacagagatctggcgctgggccaccctgctcttcctgttctaccacctgggctacgtgtgtggccagatccgctaccctgtgcctgaggagagccaggagggcacctttgtgggcaatgtggcccaggacttcctgctggacacagacagcctgagcgcccggcggctgcaggtggccggggaggtgaaccagaggcacttccgggtggacctggacagcggggccctgctgatcaagaaccccatcgaccgggaggccctgtgtggcctgagcgccagctgcatcgtgcccctggagtttgtgacagagggccccctggagatgtacagagctgaggtggagatcgtggatgtgaatgaccacgccccccgcttcccccggcagcagctggacctggagatcggggaggccgcccctcctggccagcgcttccccctggagaaggcccaggatgctgatgtgggcagcaacagcatcagcagctaccgcctgagcagcaatgagcactttgccctggatgtgaagaagagaagtgatggcagcctggtgcctgagctgctgctggagaagcccctggaccgggagaagcagagcgactaccgcctggtgctgacagctgtggatggcggcaacccccccaggtctggaacagctgagctgcgggtgtctgtgctggatgtgaatgacaatgccccagccttccagcagagcagctaccgcatctctgtgctggagagcgccccagctggcatggtgctgatccagctgaatgccagtgaccctgacctgggccccagcggaaatgtgaccttctacttcagcggccacaccccagacagagtgaggaacctcttcagcctgcaccccaccaccgggaagctgaccctgctgggccccctggactttgaaagtgagaactactatgaatttgatgtgcgggccagagatggcggcagccctgccatggagcagcactgcagcctgcgggtggacctgctggatgtgaatgacaatgccccctacatcaccgtgaccagcgagctgggcaccctgcctgagagcgctgagcccggcaccgtggtggccctgatctctgtgcaggaccctgattctggcagcaatggagatgtgtccctgcgcatcccagaccacctgccctttgccctgaagagcgccttcaggaaccagttcagcctggtgacagctggccccctggaccgggaggccaagagcagctatgacatcatggtgacagccagtgatgctggcaacccccccctgagcacccacaggaccatcttcctgaacatcagtgatgtgaatgacaacccccccagcttcttccagaggagccatgaggtgtttgtgcctgagaacaacagacctggggacctgctgtgcagcctggccgccagtgaccctgacagcggcctgaatgccctgatctcctacagcctgctggagcccaggaacagagatgtgtctgccagcagcttcatcagcctgaacccccagacaggagctgtgcacgccaccaggagctttgattatgagcagacccagaccctgcagtttgaggtgcaggcccgggaccggggcaacccccccctgagcagcacagtgacagtgcggctgtttgtgctggacctgaatgacaatgccccagctgtgctgcggccccgggcccggcccggcagcctgtgcccccaggccctgcccccatctgtgggcgccggccacctgatcaccaaggtgacagctgtggacctggacagcggctacaatgcctgggtgtcctaccagctgctggaggccccagaccccagcctgtttgctgtgagccgctatgctggggaggtgaggacagctgtgcccatcccagctgacctgcccccccagaagctggtgattgtggtgaaggacagcggcagcccccccctgagcacctctgtgaccctgctggtgtccctggaggaggacacccaccctgtggtgcctgacctgcgggagagcagcgccccccgggagggggagagccggctgaccctgtacctggccgtgtccctggtggccatctgctttgtgtcctttggcagctttgtggccctgctgagcaagtgcctgcggggagctgcctgtggggtgacctgcttccctgctggcacctgtgcctgcctgaccaggagcagaagaagagagggcctgccccccagcaatggcatcctgcgcatccagctgggcagtgatgaccccatcaagtttgtggatgtgggcggccacagccacggctgcacccccctggccagcgcccccaccaggagtgacagcttcatgatggtgaagagccccagcgcccccatggccggggagcctgtgcggcccagctgccccccaagtgacctgctgtatggcctggagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166560 - DNA, 2835 bp, Artificial Sequence
  Description of Artificial Sequence: Synthetic coding sequence
atgggccccaagaccctgccccagctggccggcaagtggcaggtgctgtgcatgctgagcctgtgctgctggggctgggtgtctggccagctgcgctacagcgtggtggaggagagcgagcccggcaccctggtgggcaatgtggcccaggacctgggcctgaagatgacagacctgctgagccggcggctgcagctgggcagcgaggagaatggccgctacttcagcctgagcctgatgtctggggccctggccgtgaaccagaagattgaccgggagagcctgtgtggggccagcaccagctgcctgctgcctgtgcaggtggtgacagagcaccccctggagctgatccgggtggaggtggagatcctggacctgaatgacaacagccccagctttgccaccccagagcgggagatgaggatcagcgagagcgctgccagcggggcccgcttccccctggacagcgcccaggaccctgatgtgggcaccaacacagtgtccttctacaccctgagccccaacagccacttcagcctgaatgtgaagaccctgaaggatggcaagcccttccctgagctggtgctggagcagcagctggaccgggaggcccaggcccggcaccagctggtgctgacagctgtggatggcggcaccccagcccggagcggcaccaccctcatctctgtgattgtgctggacatcaatgacaatgcccccaccttccagagctctgtgctgcgggtgggcatcccagaaaatgcccccatcggcaccctgctgctgcggctgaatgccacagatcctgatgagggcaccaacggccagctggactacagctttggagaccacaccagcgaggccgtgaggaacctgtttggcctggaccccagcagcggggccatccacgtgctgggccccatcgactttgaggagagccgcttctatgagatccacgcccgggcccgggaccagggccagcctgccatggagggccactgcgtcatccaggtggatgtgggagatgtgaatgacaatgcccctgaggtgctgctggccagcctggccaaccctgtgctggagagcacccctgtgggcaccgtggtgggcctcttcaacgtgcgggaccgggacagcggcagaaatggagaggtgtccctggacatcagcccagacctgcccttccagatcaagcccagcgagaaccactacagcctgctgaccagccagcccctggaccgggaggccaccagccactacatcatcgagctgctggccagtgatgctggcagccccagcctgcacaagcacctgaccatccggctgaacatcagtgatgtgaatgacaatgccccccgcttcaaccagcagctgtacacagcctacatcctggagaaccggcccccaggcagcctgctgtgcaccgtggccgccagtgaccctgacacaggagacaatgcccggctgacctacagcatcgtgggcaaccaggtgcagggcgccccagccagcagctttgtgtatgtgaacccagaagatggccgcatctttgcccagaggacctttgattatgagctgctgcagatgctgcagatcgtggtgggcgtgcgggacagcggcagcccccccctgcacgccaacaccagcctgcacgtgtttgtgctggatgaaaatgacaatgccccagctgtgctgcaccccaggccagactgggagcacagcgccccccagaggctgcccaggtctgcccctcctggcagcctggtgaccaaggtgacagctgtggatgctgatgctggccacaatgcctggctgagctacagcctgctgccccagagcacagcccctggcctcttcctggtgtccacccacactggagaggtgaggacagcccgggccctgctggaggatgacagcgacacccagcaggtggtggtgctggtgcgggacaatggagaccccagcctgagcagcacagccaccgtgctgctggtgctggaggatgaagatcctgaggagatgcccaagagcagtgacttcctgatccaccccccagagaggagtgacctgaccctgtacctgattgtggccctggccaccgtgtccctgctgagcctggtgaccttcaccttcctgagcgccaagtgcctgcagggcaatgctgatggagatggcggcggcggccagtgctgccggcggcaggacagccccagcccagacttctacaagcagagcagccccaacctgcaggtgtccagtgatggcaccctgaagtacatggaggtgaccctgcggcccacagacagccagagccactgctaccgcacctgcttcagccctgccagtgatggcagtgacttcaccttcctgcggcccctgtctgtgcagcagcccacagccctggccctggagccagatgccatccgcagccgcagcaacaccctgcgggagaggagccagcaggccccacccaacacagactggaggttcagccaggcccagaggcctggcaccagcggcagccagaatggagatgacaccggcacctggcccaacaaccagtttgacacagagatgctgcaggccatgatcctggccagcgccagcgaggccgcagatggcagcagcaccctgggcggcggggccggcaccatgggcctgagcgcccgctatggcccccagttcaccctgcagcacgtgcctgactaccggcagaatgtgtacatccctggcagcaatgccaccctgaccaatgctgctgggaagagagatggcaaggccccagctggaggaaatggaaacaagaagaagagcggcaagaaggagaagaagtag

SEQ ID NO: 166561 - DNA, 5868 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacatcgaggacaccaaggaccctgagctgcacctgttcctgaatgactacaccagcgtcttcaccgtgacccagacaggcatcacccgctacctgaccctgctgcagcctgtggaccgggaggagcagcagacctacaccttcagcatcacagcctttgatggagtgcaggagagcgagcccgtcatcgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccccccagctgagaggagaaattccatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgacagtgattgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtaccggcccccacctgtgtctgagctggccaccaagggcaccatggtgggcgtcatctctgctgctgccatcaaccagagcatcgtgtacagcatcgtgtctggaaatgaggaggacaccttcggcatcaacaacatcaccggggtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgaggaggagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggaccgctacgtgcaggagcagatccctggggccaaggtggtggtggagagcattggagccaggagacatggagatgccttcagcctggaggactacaccaagtgtgacctgactgtgtatgccatcgacccccagaccaacagagccatcgacagaaatgagctgttcaagttcctggatggcaagctgctggacatcaacaaggacttccagccctactatggagagggcggccgcatcctggagatccgcaccccagaggccgtgaccagcatcaagaagagaggagagagcctgggctacacagaaggagccctgctggccctggccttcatcatcatcctgtgctgcatcccagccatcctggtggtgctggtgtcctaccggcagttcaaggtgcggcaggccgagtgcaccaagacagcccgcatccaggccgccctgcctgctgccaagccagctgtgcctgccccagcccctgtggccgcccctcctcctcctcctcctcctcctcctggggcccacctgtatgaggagctgggggacagcagcatcctcttcctgctgtaccacttccagcagagccggggcaacaacagcgtgtctgaggacaggaagcaccagcaggtggtgatgcccttcagcagcaacaccatcgaggcccacaagagcgcccacgtggatggcagcctgaagagcaacaagctgaagagcgccaggaagttcaccttcctgagtgatgaagatgacctgagcgcccacaaccccctgtacaaggagaacatcagccaggtgtccaccaacagcgacatcagccagaggacagactttgtggaccccttcagccccaagatccaggccaagagcaagagcctgcggggcccccgggagaagatccagaggctgtggagccagagcgtgtccctgccccggcggctgatgaggaaggtgcccaacagacctgagatcatcgacctgcagcagtggcagggcacccggcagaaggccgagaatgaaaatacaggcatctgcaccaacaagaggggcagcagcaaccccctgctgaccacagaggaggccaacctgacagagaaggaggagatccggcagggcgagaccctgatgattgagggcacagagcagctgaagagcctgagcagtgacagcagcttctgcttcccccggccccacttctccttcagcaccctgcccaccgtgtccaggacagtggagctgaagtctgagcccaacgtcatcagcagccctgcagaatgttccctggagctgagccccagccggccctgtgtgctgcacagcagcctgagccggcgggagacccccatctgcatgctgcccatcgagacagagaggaacatctttgagaactttgcccacccccccaacatcagccccagcgcctgccccctgcccccacctccacccatcagcccccccagccccccaccagccccagcccccctggcccctcctccagacatcagccccttcagcctcttctgccccccacccagccccccatccatccccctgcccctgcccccacccaccttcttccccctgtctgtgtccaccagcggcccccccaccccacccctgctgccccccttccccacccccctgcccccacctccacccagcatcccctgccccccaccacccagcgccagcttcctgagcacagaatgtgtgtgcatcaccggggtgaagtgcaccaccaacctgatgcctgctgagaagatcaagagctccatgacccagctgagcaccaccaccgtgtgcaagacagacccccagcgggagcccaagggcatcctgcggcacgtgaagaacctggccgagctggagaagtctgtggccaacatgtacagccagatcgagaagaactacctgcggaccaacgtgtctgagctgcagaccatgtgccccagcgaggtgaccaacatggagatcaccagcgagcagaacaagggcagcctgaacaacatcgtggagggcacagagaagcagagccacagccagagcaccagcctgtag

SEQ ID NO: 166562 - DNA, 5874 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacatcgaggacaccaaggaccctgagctgcacctgttcctgaatgactacaccagcgtcttcaccgtgacccagacaggcatcacccgctacctgaccctgctgcagcctgtggaccgggaggagcagcagacctacaccttcagcatcacagcctttgatggagtgcaggagagcgagcccgtcatcgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccccccagctgagaggagaaattccatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgacagtgattgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtaccggcccccacctgtgtctgagctggccaccaagggcaccatggtgggcgtcatctctgctgctgccatcaaccagagcatcgtgtacagcatcgtgtctggaaatgaggaggacaccttcggcatcaacaacatcaccggggtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgaggaggagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggaccgctacgtgcaggagcagatccctggggccaaggtggtggtggagagcattggagccaggagacatggagatgccttcagcctggaggactacaccaagtgtgacctgactgtgtatgccatcgacccccagaccaacagagccatcgacagaaatgagctgttcaagttcctggatggcaagctgctggacatcaacaaggacttccagccctactatggagagggcggccgcatcctggagatccgcaccccagaggccgtgaccagcatcaagaagagaggagagagcctgggctacacagaaggagccctgctggccctggccttcatcatcatcctgtgctgcatcccagccatcctggtggtgctggtgtcctaccggcagttcaaggtgcggcaggccgagtgcaccaagacagcccgcatccaggccgccctgcctgctgccaagccagctgtgcctgccccagcccctgtggccgcccctcctcctcctcctcctcctcctcctggggcccacctgtatgaggagctgggggacagctccatgcacaacctcttcctgctgtaccacttccagcagagccggggcaacaacagcgtgtctgaggacaggaagcaccagcaggtggtgatgcccttcagcagcaacaccatcgaggcccacaagagcgcccacgtggatggcagcctgaagagcaacaagctgaagagcgccaggaagttcaccttcctgagtgatgaagatgacctgagcgcccacaaccccctgtacaaggagaacatcagccaggtgtccaccaacagcgacatcagccagaggacagactttgtggaccccttcagccccaagatccaggccaagagcaagagcctgcggggcccccgggagaagatccagaggctgtggagccagagcgtgtccctgccccggcggctgatgaggaaggtgcccaacagacctgagatcatcgacctgcagcagtggcagggcacccggcagaaggccgagaatgaaaatacaggcatctgcaccaacaagaggggcagcagcaaccccctgctgaccacagaggaggccaacctgacagagaaggaggagatccggcagggcgagaccctgatgattgagggcacagagcagctgaagagcctgagcagtgacagcagcttctgcttcccccggccccacttctccttcagcaccctgcccaccgtgtccaggacagtggagctgaagtctgagcccaacgtcatcagcagccctgcagaatgttccctggagctgagccccagccggccctgtgtgctgcacagcagcctgagccggcgggagacccccatctgcatgctgcccatcgagacagagaggaacatctttgagaactttgcccacccccccaacatcagccccagcgcctgccccctgcccccacctccacccatcagcccccccagccccccaccagccccagcccccctggcccctcctccagacatcagccccttcagcctcttctgccccccacccagccccccatccatccccctgcccctgcccccacccaccttcttccccctgtctgtgtccaccagcggcccccccaccccacccctgctgccccccttccccacccccctgcccccacctccacccagcatcccctgccccccaccacccagcgccagcttcctgagcacagaatgtgtgtgcatcaccggggtgaagtgcaccaccaacctgatgcctgctgagaagatcaagagctccatgacccagctgagcaccaccaccgtgtgcaagacagacccccagcgggagcccaagggcatcctgcggcacgtgaagaacctggccgagctggagaagtctgtggccaacatgtacagccagatcgagaagaactacctgcggaccaacgtgtctgagctgcagaccatgtgccccagcgaggtgaccaacatggagatcaccagcgagcagaacaagggcagcctgaacaacatcgtggagggcacagagaagcagagccacagccagagcaccagcctgtag

SEQ ID NO: 166563 - DNA, 2886 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacatcgaggacaccaaggaccctgagctgcacctgttcctgaatgactacaccagcgtcttcaccgtgacccagacaggcatcacccgctacctgaccctgctgcagcctgtggaccgggaggagcagcagacctacaccttcagcatcacagcctttgatggagtgcaggagagcgagcccgtcatcgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccccccagctgagaggagaaattccatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgacagtgattgtgaaggacatgaatgactacccacctgtgttcagcaagaggatctacaagggcatggtggccccagatgctgtgaagggcacccccatcaccaccgtgtatgcagaagatgctgacccccctgtgtccagaagacactag

SEQ ID NO: 166564 - DNA, 2430 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacatcgaggacaccaaggaccctgagctgcacctgttcctgaatgactacaccagcgtcttcaccgtgacccagacaggcatcacccgctacctgaccctgctgcagcctgtggaccgggaggagcagcagacctacaccttcagcatcacagcctttgatggagtgcaggagagcgagcccgtcatcgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccccccagctgagaggagaaattccatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaagctgagcaccaccaccgtgtgcaagacagacccccagcgggagcccaagggcatcctgcggcacgtgaagaacctggccgagctggagaagtctgtggccaacatgtacagccagatcgagaagaactacctgcggaccaacgtgtctgagctgcagaccatgtgccccagcgaggtgaccaacatggagatcaccagcgagcagaacaagggcagcctgaacaacatcgtggagggcacagagaagcagagccacagccagagcaccagcctgtag

SEQ ID NO: 166565 - DNA, 5055 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacattgaagatgtgcccccatctggagtgcccaccaaggaccctgagctgcacctgttcctgaatgactacacctctgtgttcaccgtgacccagacaggcatcacccgctacctgaccctgctgcagcctgtggaccgggaggagcagcagacctacaccttcagcatcacagcctttgatggagtgcaggagagcgagcctgtgattgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccctcctgctgagaggaggaacagcatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgaccgtcatcgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtacagacctcctcctgtgtctgagctggccaccaagggcaccatggtgggcgtcatctctgctgctgccatcaaccagagcatcgtgtacagcatcgtgtctggaaatgaggaggacaccttcggcatcaacaacatcactggagtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgagaagaagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggacagatatgtgcaggagcagatccctggggccaaggtggtggtggagagcatcggggccaggagacatggagatgccttcagcctggaggactacaccaagtgtgacctgactgtgtatgccatcgacccccagaccaacagagccatcgacagaaatgaactcttcaagttcctggatggcaagctgctggacatcaacaaggacttccagccctactacggggagggcggccgcatcctggagatccgcaccccagaggccgtgaccagcatcaagaagagaggagagagcctgggctacacagagggcgccctgctggccctggccttcatcatcatcctgtgctgcatcccagccatcctggtggtgctggtgtcctaccggcagttcaaggtgcggcaggctgaatgtaccaagacagcccgcatccaggccgccctgcctgctgccaagccagctgtgcctgccccagcccctgtggccgcccctcctcctcctcctcctcctcctcctggggcccacctgtatgaggagctgggggacagctccatgcacaagtatgagatgccccagtatggcagcagaagaaggctgctgcccccagctggccaggaggagtatggagaggtggtgggggaggccgaggaggagtatgaggaggaggagtgggccaggaagaggatgatcaagctggtggtggaccgggagtatgagaccagcagcactggagaagattctgcccctgagtgccagaggaaccggctgcaccaccccagcatccacagcaacatcaatggaaacatctacatcgcccagaatggatctgtggtgaggacccggcgggcctgcctgacagacaacctgaaggtggccagccctgtgcggctgggcggccccttcaagaagctggacaagctggccgtgacccatgaagaaaatgtgcccctgaacaccctgagcaagggccccttcagcacagagaagatgaatgcccggcccaccctggtgacctttgccccctgccctgtgggcacagacaacacagctgtgaagcccctgaggaaccggctgaagagcacagtggagcaggagagcatgattgacagcaagaacatcaaggaggccctggagttccacagcgaccacacccagagtgatgatgaggagctgtggatgggcccctggaacaacctgcacatccccatgaccaagctgtag

SEQ ID NO: 166566 - DNA, 5859 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacatcgaggacaccaaggaccctgagctgcacctgttcctgaatgactacaccagcgtcttcaccgtgacccagacaggcatcacccgctacctgaccctgctgcagcctgtggaccgggaggagcagcagacctacaccttcagcatcacagcctttgatggagtgcaggagagcgagcccgtcatcgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccccccagctgagaggagaaattccatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgacagtgattgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtaccggcccccacctgtgtctgagctggccaccaagggcaccatggtgggcgtcatctctgctgctgccatcaaccagagcatcgtgtacagcatcgtgtctggaaatgaggaggacaccttcggcatcaacaacatcaccggggtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgaggaggagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggaccgctacgtgcaggagcagatccctggggccaaggtggtggtggagagcattggagccaggagacatggagatgccttcagcctggaggactacaccaagtgtgacctgactgtgtatgccatcgacccccagaccaacagagccatcgacagaaatgagctgttcaagttcctggatggcaagctgctggacatcaacaaggacttccagccctactatggagagggcggccgcatcctggagatccgcaccccagaggccgtgaccagcatcaagaagagaggagagagcctgggctacacagaaggagccctgctggccctggccttcatcatcatcctgtgctgcatcccagccatcctggtggtgctggtgtcctaccggcagaggcaggctgaatgtaccaagacagcccgcatccaggccgccctgcctgctgccaagccagctgtgcctgccccagcccctgtggccgcccctcctcctcctcctcctcctcctcctggggcccacctgtatgaggagctgggggacagcagcatcctcttcctgctgtaccacttccagcagagccggggcaacaacagcgtgtctgaggacaggaagcaccagcaggtggtgatgcccttcagcagcaacaccatcgaggcccacaagagcgcccacgtggatggcagcctgaagagcaacaagctgaagagcgccaggaagttcaccttcctgagtgatgaagatgacctgagcgcccacaaccccctgtacaaggagaacatcagccaggtgtccaccaacagcgacatcagccagaggacagactttgtggaccccttcagccccaagatccaggccaagagcaagagcctgcggggcccccgggagaagatccagaggctgtggagccagagcgtgtccctgccccggcggctgatgaggaaggtgcccaacagacctgagatcatcgacctgcagcagtggcagggcacccggcagaaggcagaaaatgaaaatacaggcatctgcaccaacaagaggggcagcagcaaccccctgctgaccacagaggaggccaacctgacagagaaggaggagatccggcagggcgagaccctgatgattgagggcacagagcagctgaagagcctgagcagtgacagcagcttctgcttcccccggccccacttctccttcagcaccctgcccaccgtgtccaggacagtggagctgaagtctgagcccaacgtcatcagcagccctgctgagtgcagcctggagctgagccccagccggccctgtgtgctgcacagcagcctgagcagaagagagacccccatctgcatgctgcccattgaaacagaaagaaacatctttgaaaattttgcccacccccccaacatcagccccagcgcctgccccctgcccccacctccacccatcagcccccccagccccccaccagccccagcccccctggcccctcctccagacatcagccccttcagcctcttctgccccccacccagcccccccagcatccccctgcccctgcccccacccaccttcttccccctgtctgtgtccaccagcggcccccccaccccacccctgctgccccccttccccacccccctgcccccacctcctccttccatcccctgccccccacctccttctgccagcttcctgagcacagaatgtgtgtgcatcactggagtgaagtgcaccaccaacctgatgcctgctgagaagatcaagagctccatgacccagctgagcaccaccaccgtgtgcaagacagacccccagcgggagcccaagggcatcctgcggcacgtgaagaacctggccgagctggagaagtctgtggccaacatgtacagccagatcgagaagaactacctgcggaccaacgtgtctgagctgcagaccatgtgccccagcgaggtgaccaacatggagatcaccagcgagcagaacaagggcagcctgaacaacatcgtggagggcacagagaagcagagccacagccagagcaccagcctgtag

SEQ ID NO: 166567 - DNA, 5748 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgatcctgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagccccccagcgacaggcctggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgagaattgtggccctggacaaggacatcgaggacaccaaggaccctgagctgcacctgttcctgaatgactacacctctgtgttcaccgtgacccagacaggcatcacccgctacctgaccctgctgcagcctgtggaccgggaggagcagcagacctacaccttcagcatcacagcctttgatggagtgcaggagagcgagcctgtgattgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccctcctgctgagaggaggaacagcatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgaccgtcatcgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtacagacctcctcctgtgtctgagctggccaccaagggcaccatggtgggcgtcatctctgctgctgccatcaaccagagcatcgtgtacagcatcgtgtctggaaatgaggaggacaccttcggcatcaacaacatcactggagtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgagaagaagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggacagatatgtgcaggagcagatccctggggccaaggtggtggtggagagcatcggggccaggagacatggagatgccttcagcctggaggactacaccaagtgtgacctgactgtgtatgccatcgacccccagaccaacagagccatcgacagaaatgaactcttcaagttcctggatggcaagctgctggacatcaacaaggacttccagccctactacggggagggcggccgcatcctggagatccgcaccccagaggccgtgaccagcatcaagaagagaggagagagcctgggctacacagagggcgccctgctggccctggccttcatcatcatcctgtgctgcatcccagccatcctggtggtgctggtgtcctaccggcagaggcaggccgagtgcaccaagacagcccgcatccaggccgccctgcctgctgccaagccagctgtgcctgccccagcccctgtggccgcccctcctcctcctcctcctcctcctcctggggcccacctgtatgaggagctgggggacagcagcatcctcttcctgctgtaccacttccagcagagccggggcaacaacagcgtgtctgaggacaggaagcaccagcaggtggtgatgcccttcagcagcaacaccatcgaggcccacaagagcgcccacgtggatggcagcctgaagagcaacaagctgaagagcgccaggaagttcaccttcctgagtgatgaagatgacctgagcgcccacaaccccctgtacaaggagaacatcagccaggtgtccaccaacagcgacatcagccagaggacagactttgtggaccccttcagccccaagatccaggccaagagcaagagcctgcggggcccccgggagaagatccagaggctgtggagccagagcgtgtccctgccccggcggctgatgaggaaggtgcccaacagacctgagatcatcgacctgcagcagtggcagggcacccggcagaaggccgagaatgaaaatacaggcatctgcaccaacaagaggggcagcagcaaccccctgctgaccacagaggaggccaacctgacagagaaggaggagatccggcagggcgagaccctgatgattgagggcacagagcagctgaagagcctgagcagtgacagcagcttctgcttcccccggccccacttctccttcagcaccctgcccaccgtgtccaggacagtggagctgaagtctgagcccaacgtcatcagcagccctgcagaatgttccctggagctgagccccagccggccctgtgtgctgcacagcagcctgagccggcgggagacccccatctgcatgctgcccatcgagacagagaggaacatctttgagaactttgcccacccccccaacatcagccccagcgcctgccccctgcccccacctccacccatcagcccccccagccccccaccagccccagcccccctggcccctcctccagacatcagccccttcagcctcttctgccccccacccagccccccatccatccccctgcccctgcccccacccaccttcttccccctgtctgtgtccaccagcggcccccccaccccacccctgctgccccccttccccacccccctgcccccacctccacccagcatcccctgccccccaccacccagcgccagcttcctgagcacagaatgtgtgtgcatcaccggggtgaagtgcaccaccaacctgatgcctgctgagaagatcaagagctccatgacccagctgagcaccaccaccgtgtgcaagacagacccccagcgggagcccaagggcatcctgcggcacgtgaagaacctggccgagctggagaagtctgtggccaacatgtacagccagatcgagaagaactacctgcggaccaacgtgtctgagctgcagaccatgtgccccagcgaggtgaccaacatggagatcaccagcgagcagaacaagggcagcctgaacaacatcgtggagggcacagagaagcagagccacagccagagcaccagcctgtag

SEQ ID NO: 166568 - DNA, 5799 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacatcgaggacaccaaggaccctgagctgcacctgttcctgaatgactacaccagcgtcttcaccgtgacccagacaggcatcacccgctacctgaccctgctgcagcctgtggaccgggaggagcagcagacctacaccttcagcatcacagcctttgatggagtgcaggagagcgagcccgtcatcgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccccccagctgagaggagaaattccatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgacagtgattgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtaccggcccccacctgtgtctgagctggccaccaagggcaccatggtgggcgtcatctctgctgctgccatcaaccagagcatcgtgtacagcatcgtgtctggaaatgaggaggacaccttcggcatcaacaacatcaccggggtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgaggaggagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggaccgctacgtgcaggagcagatccctggggccaaggtggtggtggagagcattggagccaggagacatggagatgccttcagcctggaggactacaccaagtgtgacctgactgtgtatgccatcgacccccagaccaacagagccatcgacagaaatgagctgttcaagttcctggatggcaagctgctggacatcaacaaggacttccagccctactatggagagggcggccgcatcctggagatccgcaccccagaggccgtgaccagcatcaagaagagaggagagagcctgggctacacagaaggagccctgctggccctggccttcatcatcatcctgtgctgcatcccagccatcctggtggtgctggtgtcctaccggcagaggcaggctgaatgtaccaagacagcccgcatccaggccgccctgcctgctgccaagccagctgtgcctgccccagcccctgtggccgcccctcctcctcctcctcctcctcctcctggggcccacctgtatgaggagctgggggacagctccatgcacaacctcttcctgctgtaccacttccagcagagccggggcaacaacagcgtgtctgaggacaggaagcaccagcaggtggtgatgcccttcagcagcaacaccatcgaggcccacaagagcgcccacgtggatggcagcctgaagagcaacaagctgaagagcgccaggaagttcaccttcctgagtgatgaagatgacctgagcgcccacaaccccctgtacaaggagaacatcagccaggtgtccaccaacagcgacatcagccagaggacagactttgtggaccccttcagccccaagatccaggccaagagcaagagcctgcggggcccccgggagaagatccagaggctgtggagccagagcgtgtccctgccccggcggctgatgaggaaggtgcccaacagacctgagatcatcgacctgcagcagtggcagggcacccggcagaaggcagaaaatgaaaatacaggcatctgcaccaacaagaggggcagcagcaaccccctgctgaccacagaggaggccaacctgacagagaaggaggagatccggcagggcgagaccctgatgattgagggcacagagcagctgaagagcctgagcagtgacagcagcttctgcttcccccggccccacttctccttcagcaccctgcccaccgtgtccaggacagtggagctgaagtctgagcccaacgtcatcagcagccctgctgagtgcagcctggagctgagccccagccggccctgtgtgctgcacagcagcctgagcagaagagagacccccatctgcatgctgcccattgaaacagaaagaaacatctttgaaaattttgcccacccccccaacatcagccccagcgcctgccccctgcccccacctccacccatcagcccccccagccccccaccagccccagcccccctggcccctcctccagacatcagccccttcagcctcttctgccccccacccagcccccccagcatccccctgcccctgcccccacccaccttcttccccctgtctgtgtccaccagcggcccccccaccccacccctgctgccccccttccccacccccctgcccccacctcctccttccatcccctgccccccacctccttctgccagcttcctgagcacagaatgtgtgtgcatcactggagtgaagtgcaccaccaacctgatgcctgctgagaagatcaagagctccatgacccagctgagcaccaccaccgtgtgcaagacagacccccagcgggagcccaagggcatcctgcggcacgtgaagaacctggccgagctggagaagtctgtggccaacatgtacagccagatcgagaagaactacctgcggaccaacgtgtctgagctgcagaccatgtgccccagcgaggtgaccaacatggagatcaccagcgagcagaacaagggcagcctgaacaacatcgtggagggcacagagaagcagagccacagccagagcaccagcctgtag

SEQ ID NO: 166569 - DNA, 4620 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacatcgaggacaccaaggaccctgagctgcacctgttcctgaatgactacaccagcgtcttcaccgtgacccagacaggcatcacccgctacctgaccctgctgcagcctgtggaccgggaggagcagcagacctacaccttcagcatcacagcctttgatggagtgcaggagagcgagcccgtcatcgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccccccagctgagaggagaaattccatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgacagtgattgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtaccggcccccacctgtgtctgagctggccaccaagggcaccatggtgggcgtcatctctgctgctgccatcaaccagagcatcgtgtacagcatcgtgtctggaaatgaggaggacaccttcggcatcaacaacatcaccggggtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgaggaggagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggaccgctacgtgcaggagcagatccctggggccaaggtggtggtggagagcattggagccaggagacatggagatgccttcagcctggaggactacaccaagtgtgacctgactgtgtatgccatcgacccccagaccaacagagccatcgacagaaatgagctgttcaagttcctggatggcaagctgctggacatcaacaaggacttccagccctactatggagagggcggccgcatcctggagatccgcaccccagaggccgtgaccagcatcaagaagagaggagagagcctgggctacacagaaggagccctgctggccctggccttcatcatcatcctgtgctgcatcccagccatcctggtggtgctggtgtcctaccggcagttcaaggtgcggcaggccgagtgcaccaagacagcccgcatccaggccgccctgcctgctgccaagccagctgtgcctgccccagcccctgtggccgcccctcctcctcctcctcctcctcctcctggggcccacctgtatgaggagctgggggacagctccatgcacaagaactacccctggagcctggagctgatcctggccaggaacatggacaagatcatcaccgtgatgtccatgggcatgaagtgcctgaacatgggcgtggccgtggactgctaccaccagctggacagaagaaacatggtgcgctggctggtgaagctgaggaagaacatgaggaggaagaggaagagccagaggaagctgaagaaccagaggctgaagctggagagcctggtgcggaggaagaagtag

SEQ ID NO: 166570 - DNA, 2160 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacattgaagatgaggagcccaagaagatcaagaagcccaaggtggagatccgggagcccagcgaggaggaggaggtggtggtgaccatcgagaagcccccagctgctgagcccacctacaccacctggaagagggcccgcatcttccccatgatcttcaagaaggtgcggggcctggccgacaagaggggcatcgtggacctggagggggaggagtggcagaggcggctggaggaggaggacaaggactacctgaagctgaccctggaccaggaggaggccacagagagcacagtggagagcgaggaggagagcagcagtgactacacagagtacagcgaggaggagagcgagttcagcgagagcgagaccacagaggaggagagcgagagcgagacccccagcgaggaggaggagagcagcaccccagagagcgaggagagcgagagcacagagagcgagggggagaaggccaggaagaacatcgtgctggcccggcggcggcccatggtggaggaggtgaaggaggtgaagggcaggaaggaggagccccaggaggagcagaaggagcccaagatggaggaggaggagcacagcgaggaggaggagagcggccctgcccctgtggaggagagcacagatcctgaggcccaggacatccctgaggagggcagcgctgagagcgcctctgtggagggcggcgtggagagcgaggaggagagcgagagcggcagcagcagcagcagcagcgagagccagagcggcggcccctggggctaccaggtgcctgcctatgacaggagcaagaatgccaaccagaagaagagccctggggccaacagcgagggctacaacacagccctgtag

SEQ ID NO: 166571 - DNA, 1953 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggaggagcccaagaagatcaagaagcccaaggtggagatccgggagcccagcgaggaggaggaggtggtggtgaccatcgagaagcccccagctgctgagcccacctacaccacctggaagagggcccgcatcttccccatgatcttcaagaaggtgcggggcctggccgacaagaggggcatcgtggacctggagggggaggagtggcagaggcggctggaggaggaggacaaggactacctgaagctgaccctggaccaggaggaggccacagagagcacagtggagagcgaggaggagagcagcagtgactacacagagtacagcgaggaggagagcgagttcagcgagagcgagaccacagaggaggagagcgagagcgagaccccatctgaggaggaggagagcagcaccccagagagcgaggagagcgagagcacagaaagtgaaggagagaaggccaggaagaacatcgtgctggccaggagaagacccatggtggaggaggtgaaggaggtgaagggcaggaaggaggagccccaggaggagcagaaggagcccaagatggaggaggaggagcacagcgaggaggaggagagcggccctgcccctgtggaggagagcacagatcctgaggcccaggacatccctgaggagggcagcgctgagagcgcctctgtggagggcggcgtggagagcgaggaggagagcgagagcggcagcagcagcagcagcagcgagagccagagcggcggcccctggggctaccaggtgcctgcctatgacaggagcaagaatgccaaccagaagaagagccctggggccaacagcgagggctacaacacagccctgtag

SEQ ID NO: 166572 - DNA, 5358 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacattgaagatgtgcccccatctggagtgcccaccaaggaccctgagctgcacctgttcctgaatgactacacctctgtgttcaccgtgacccagacaggcatcacccgctacctgaccctgctgcagcctgtggaccgggaggagcagcagacctacaccttcagcatcacagcctttgatggagtgcaggagagcgagcctgtgattgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccctcctgctgagaggaggaacagcatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgaccgtcatcgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtacagacctcctcctgtgtctgagctggccaccaagggcaccatggtgggcgtcatctctgctgctgccatcaaccagagcatcgtgtacagcatcgtgtctggaaatgaggaggacaccttcggcatcaacaacatcactggagtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgagaagaagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggacagatatgtgcaggagcagatccctggggccaaggtggtggtggagagcatcggggccaggagacatggagatgccttcagcctggaggactacaccaagtgtgacctgactgtgtatgccatcgacccccagaccaacagagccatcgacagaaatgaactcttcaagttcctggatggcaagctgctggacatcaacaaggacttccagccctactacggggagggcggccgcatcctggagatccgcaccccagaggccgtgaccagcatcaagaagagaggagagagcctgggctacacagagggcgccctgctggccctggccttcatcatcatcctgtgctgcatcccagccatcctggtggtgctggtgtcctaccggcagttcaaggtgcggcaggctgaatgtaccaagacagcccgcatccaggccgccctgcctgctgccaagccagctgtgcctgccccagcccctgtggccgcccctcctcctcctcctcctcctcctcctggggcccacctgtatgaggagctgggggacagctccatgcacaagtatgagatgccccagtatggcagcagaagaaggctgctgcccccagctggccaggaggagtatggagaggtggtgggggaggccgaggaggagtatgaggaggaggaggaggagcccaagaagatcaagaagcccaaggtggagatccgggagcccagcgaggaggaggaggtggtggtgaccatcgagaagcccccagctgctgagcccacctacaccacctggaagagggcccgcatcttccccatgatcttcaagaaggtgcggggcctggccgacaagaggggcatcgtggacctggagggggaggagtggcagaggcggctggaggaggaggacaaggactacctgaagctgaccctggaccaggaggaggccacagagagcacagtggagagcgaggaggagagcagcagtgactacacagagtacagcgaggaggagagcgagttcagcgagagcgagaccacagaggaggagagcgagagcgagacccccagcgaggaggaggagagcagcaccccagagagcgaggagagcgagagcacagagagcgagggggagaaggccaggaagaacatcgtgctggcccggcggcggcccatggtggaggaggtgaaggaggtgaagggcaggaaggaggagccccaggaggagcagaaggagcccaagatggaggaggaggagcacagcgaggaggaggagagcggccctgcccctgtggaggagagcacagatcctgaggcccaggacatccctgaggagggcagcgctgagagcgcctctgtggagggcggcgtggagagcgaggaggagagcgagagcggcagcagcagcagcagcagcgagagccagagcggcggcccctggggctaccaggtgcctgcctatgacaggagcaagaatgccaaccagaagaagagccctggggccaacagcgagggctacaacacagccctgtag

SEQ ID NO: 166573 - DNA, 2946 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacatcgaggacaccaaggaccctgagctgcacctgttcctgaatgactacaccagcgtcttcaccgtgacccagacaggcatcacccgctacctgaccctgctgcagcctgtggaccgggaggagcagcagacctacaccttcagcatcacagcctttgatggagtgcaggagagcgagcccgtcatcgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccccccagctgagaggagaaattccatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggagaggagcccaagaagatcaagaagcccaaggtggagatccgggagcccagcgaggaggaggaggtggtggtgaccatcgagaagcccccagctgctgagcccacctacaccacctggaagagggcccgcatcttccccatgatcttcaagaaggtgcggggcctggccgacaagaggggcatcgtggacctggagggggaggagtggcagaggcggctggaggaggaggacaaggactacctgaagctgaccctggaccaggaggaggccacagagagcacagtggagagcgaggaggagagcagcagtgactacacagagtacagcgaggaggagagcgagttcagcgagagcgagaccacagaggaggagagcgagagcgagacccccagcgaggaggaggagagcagcaccccagagagcgaggagagcgagagcacagagagcgagggggagaaggccaggaagaacatcgtgctggcccggcggcggcccatggtggaggaggtgaaggaggtgaagggcaggaaggaggagccccaggaggagcagaaggagcccaagatggaggaggaggagcacagcgaggaggaggagagcggccctgcccctgtggaggagagcacagatcctgaggcccaggacatccctgaggagggcagcgctgagagcgcctctgtggagggcggcgtggagagcgaggaggagagcgagagcggcagcagcagcagcagcagcgagagccagagcggcggcccctggggctaccaggtgcctgcctatgacaggagcaagaatgccaaccagaagaagagccctggggccaacagcgagggctacaacacagccctgtag

SEQ ID NO: 166574 - DNA, 3453 bp, Artificial Sequence
  Description of Artificial Sequence: Synthetic coding sequence
atgcccagctaccagggctacatcctggagagcgcccctgtgggcgccaccatcagtgacagcctgaacctgaccagccccctgcgcatcgtggccctggacaaggacattgaagatgtgcccccatctggagtgcccaccaaggaccctgagctgcacctgttcctgaatgactacacctctgtgttcaccgtgacccagacaggcatcacccgctacctgaccctgctgcagcctgtggaccgggaggagcagcagacctacaccttcagcatcacagcctttgatggagtgcaggagagcgagcctgtgattgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccctcctgctgagaggaggaacagcatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgaccgtcatcgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtacagacctcctcctgtgtctgagctggccaccaagggcaccatggtgggcgtcatctctgctgctgccatcaaccagagcatcgtgtacagcatcgtgtctggaaatgaggaggacaccttcggcatcaacaacatcactggagtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgagaagaagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggacagatatgtgcaggagcagatccctggggccaaggtggtggtggagagcatcggggccaggagacatggagatgccttcagcctggaggactacaccaagtgtgacctgactgtgtatgccatcgacccccagaccaacagagccatcgacagaaatgaactcttcaagttcctggatggcaagctgctggacatcaacaaggacttccagccctactacggggagggcggccgcatcctggagatccgcaccccagaggccgtgaccagcatcaagaagagaggagagagcctgggctacacagagggcgccctgctggccctggccttcatcatcatcctgtgctgcatcccagccatcctggtggtgctggtgtcctaccggcagttcaaggtgcggcaggctgaatgtaccaagacagcccgcatccaggccgccctgcctgctgccaagccagctgtgcctgccccagcccctgtggccgcccctcctcctcctcctcctcctcctcctggggcccacctgtatgaggagctgggggacagctccatgcacaagaactacccctggagcctggagctgatcctggccaggaacatggacaagatcatcaccgtgatgtccatgggcatgaagtgcctgaacatgggcgtggccgtggactgctaccaccagctggacagaagaaacatggtgcgctggctggtgaagctgaggaagaacatgaggaggaagaggaagagccagaggaagctgaagaaccagaggctgaagctggagagcctggtgcggaggaagaagtag

SEQ ID NO: 166575 - DNA, 990 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagacctgggcagcctgtgcagcggcaccaacagctggtgccagggccgctctggagtgcactggagcagccctgcctggcgctgcctcttcccccggcggctgcaccagatgtag

SEQ ID NO: 166576 - DNA, 5046 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatggctggagatacatgtactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgcgcatcgtggtgcgggacagaaatgacaacagccccaccttcaagcatgagagctactatgccaccgtgaatgagctgacccctgtgggcaccaccatcttcaccggcttcagcggggacaatggagccacagacattgatgatggccccaacggccagatcgagtatgtgatccagtacaacccagatgaccccaccagcaatgacacctttgagatccccctgatgctgaccggcaacatcgtgctgaggaagaggctgaactatgaggacaagacccgctacttcgtcatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagccccccagcgacaggcctggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgagaattgtggccctggacaaggacatcgaggacaccaaggaccctgagctgcacctgttcctgaatgactacacctctgtgttcaccgtgacccagacaggcatcacccgctacctgaccctgctgcagcctgtggaccgggaggagcagcagacctacaccttcagcatcacagcctttgatggagtgcaggagagcgagcctgtgattgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccctcctgctgagaggaggaacagcatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgaccgtcatcgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtacagacctcctcctgtgtctgagctggccaccaagggcaccatggtgggcgtcatctctgctgctgccatcaaccagagcatcgtgtacagcatcgtgtctggaaatgaggaggacaccttcggcatcaacaacatcactggagtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgagaagaagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggacagatatgtgcaggagcagatccctggggccaaggtggtggtggagagcatcggggccaggagacatggagatgccttcagcctggaggactacaccaagtgtgacctgactgtgtatgccatcgacccccagaccaacagagccatcgacagaaatgaactcttcaagttcctggatggcaagctgctggacatcaacaaggacttccagccctactacggggagggcggccgcatcctggagatccgcaccccagaggccgtgaccagcatcaagaagagaggagagagcctgggctacacagagggcgccctgctggccctggccttcatcatcatcctgtgctgcatcccagccatcctggtggtgctggtgtcctaccggcagaggcaggccgagtgcaccaagacagcccgcatccaggccgccctgcctgctgccaagccagctgtgcctgccccagcccctgtggccgcccctcctcctcctcctcctcctcctcctggggcccacctgtatgaggagctgggggacagcagcatcctgtactaccgctatgagatgccccagtatggcagcagaagaaggctgctgcccccagctggccaggaggagtatggagaggtggtgggggaggccgaggaggagtatgaggaggaggagtgggccaggaagaggatgatcaagctggtggtggaccgggagtatgagaccagcagcactggagaggacagcgcccctgagtgccagaggaaccggctgcaccaccccagcatccacagcaacatcaatggaaacatctacatcgcccagaatggatctgtggtgaggacccggcgggcctgcctgacagacaacctgaaggtggccagccctgtgcggctgggcggccccttcaagaagctggacaagctggccgtgacccatgaggagaatgtgcccctgaacaccctgagcaagggccccttcagcacagagaagatgaatgcccggcccaccctggtgacctttgccccctgccctgtgggcacagacaacacagctgtgaagcccctgaggaaccggctgaagagcacagtggagcaggagagcatgattgacagcaagaacatcaaggaggccctggagttccacagcgaccacacccagagtgatgatgaggagctgtggatgggcccctggaacaacctgcacatccccatgaccaagctgtag

SEQ ID NO: 166577 - DNA, 5889 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgcctacagctatgaggactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgcgcatcgtggtgcgggacagaaatgacaacagccccaccttcaagcatgagagctactatgccaccgtgaatgagctgacccctgtgggcaccaccatcttcaccggcttcagcggggacaatggagccacagacattgatgatggccccaacggccagatcgagtatgtgatccagtacaacccagatgaccccaccagcaatgacacctttgagatccccctgatgctgaccggcaacatcgtgctgaggaagaggctgaactatgaggacaagacccgctacttcgtcatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagccccccagcgacaggcctggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgagaattgtggccctggacaaggacatcgaggacaccaaggaccctgagctgcacctgttcctgaatgactacacctctgtgttcaccgtgacccagacaggcatcacccgctacctgaccctgctgcagcctgtggaccgggaggagcagcagacctacaccttcagcatcacagcctttgatggagtgcaggagagcgagcctgtgattgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccctcctgctgagaggaggaacagcatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgaccgtcatcgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtacagacctcctcctgtgtctgagctggccaccaagggcaccatggtgggcgtcatctctgctgctgccatcaaccagagcatcgtgtacagcatcgtgtctggaaatgaggaggacaccttcggcatcaacaacatcactggagtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgagaagaagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggacagatatgtgcaggagcagatccctggggccaaggtggtggtggagagcatcggggccaggagacatggagatgccttcagcctggaggactacaccaagtgtgacctgactgtgtatgccatcgacccccagaccaacagagccatcgacagaaatgaactcttcaagttcctggatggcaagctgctggacatcaacaaggacttccagccctactacggggagggcggccgcatcctggagatccgcaccccagaggccgtgaccagcatcaagaagagaggagagagcctgggctacacagagggcgccctgctggccctggccttcatcatcatcctgtgctgcatcccagccatcctggtggtgctggtgtcctaccgccacttcaagaggcggcaggctgaatgtaccaagacagcccgcatccaggccgccctgcctgctgccaagccagctgtgcctgccccagcccctgtggccgcccctcctcctcctcctcctcctcctcctggggcccacctgtatgaggagctgggggacagctccatgaagggcctcttcctgctgtaccacttccagcagagccggggcaacaacagcgtgtctgaggacaggaagcaccagcaggtggtgatgcccttcagcagcaacaccatcgaggcccacaagagcgcccacgtggatggcagcctgaagagcaacaagctgaagagcgccaggaagttcaccttcctgagtgatgaagatgacctgagcgcccacaaccccctgtacaaggagaacatcagccaggtgtccaccaacagcgacatcagccagaggacagactttgtggaccccttcagccccaagatccaggccaagagcaagagcctgcggggcccccgggagaagatccagaggctgtggagccagagcgtgtccctgccccggcggctgatgaggaaggtgcccaacagacctgagatcatcgacctgcagcagtggcagggcacccggcagaaggcagaaaatgaaaatacaggcatctgcaccaacaagaggggcagcagcaaccccctgctgaccacagaggaggccaacctgacagagaaggaggagatccggcagggcgagaccctgatgattgagggcacagagcagctgaagagcctgagcagtgacagcagcttctgcttcccccggccccacttctccttcagcaccctgcccaccgtgtccaggacagtggagctgaagtctgagcccaacgtcatcagcagccctgctgagtgcagcctggagctgagccccagccggccctgtgtgctgcacagcagcctgagcagaagagagacccccatctgcatgctgcccattgaaacagaaagaaacatctttgaaaattttgcccacccccccaacatcagccccagcgcctgccccctgcccccacctccacccatcagcccccccagccccccaccagccccagcccccctggcccctcctccagacatcagccccttcagcctcttctgccccccacccagcccccccagcatccccctgcccctgcccccacccaccttcttccccctgtctgtgtccaccagcggcccccccaccccacccctgctgccccccttccccacccccctgcccccacctcctccttccatcccctgccccccacctccttctgccagcttcctgagcacagaatgtgtgtgcatcactggagtgaagtgcaccaccaacctgatgcctgctgagaagatcaagagctccatgacccagctgagcaccaccaccgtgtgcaagacagacccccagcgggagcccaagggcatcctgcggcacgtgaagaacctggccgagctggagaagtctgtggccaacatgtacagccagatcgagaagaactacctgcggaccaacgtgtctgagctgcagaccatgtgccccagcgaggtgaccaacatggagatcaccagcgagcagaacaagggcagcctgaacaacatcgtggagggcacagagaagcagagccacagccagagcaccagcctgtag

SEQ ID NO: 166578 - DNA, 5661 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacatcgaggacaccaaggaccctgagctgcacctgttcctgaatgactacaccagcgtcttcaccgtgacccagacaggcatcacccgctacctgaccctgctgcagcctgtggaccgggaggagcagcagacctacaccttcagcatcacagcctttgatggagtgcaggagagcgagcccgtcatcgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccccccagctgagaggagcacaggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgaccgtcatcgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtacagacctcctcctgtgtctgagctggccaccaagggcaccatggtgggcgtcatctctgctgctgccatcaaccagagcatcgtgtacagcatcgtgtctggaaatgaggaggacaccttcggcatcaacaacatcactggagtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgagaagaagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggacagatatgtgcaggagcagatccctggggccaaggtggtggtggagagcatcggggccaggagacatggagatgccttcagcctggaggactacaccaagtgtgacctgactgtgtatgccatcgacccccagaccaacagagccatcgacagaaatgaactcttcaagttcctggatggcaagctgctggacatcaacaaggacttccagccctactacggggagggcggccgcatcctggagatccgcaccccagaggccgtgaccagcatcaagaagagaggagagagcctgggctacacagagggcgccctgctggccctggccttcatcatcatcctgtgctgcatcccagccatcctggtggtgctggtgtcctaccgccacttcaagaggcggcaggctgaatgtaccaagacagcccgcatccaggccgccctgcctgctgccaagccagctgtgcctgccccagcccctgtggccgcccctcctcctcctcctcctcctcctcctggggcccacctgtatgaggagctgggggacagctccatgaagggcctcttcctgctgtaccacttccagcagagccggggcaacaacagcgtgtctgaggacaggaagcaccagcaggtggtgatgcccttcagcagcaacaccatcgaggcccacaagagcgcccacgtggatggcagcctgaagagcaacaagctgaagagcgccaggaagttcaccttcctgagtgatgaagatgacctgagcgcccacaaccccctgtacaaggagaacatcagccaggtgtccaccaacagcgacatcagccagaggacagactttgtggaccccttcagccccaagatccaggccaagagcaagagcctgcggggcccccgggagaagatccagaggctgtggagccagagcgtgtccctgccccggcggctgatgaggaaggtgcccaacagacctgagatcatcgacctgcagcagtggcagggcacccggcagaaggcagaaaatgaaaatacaggcatctgcaccaacaagaggggcagcagcaaccccctgctgaccacagaggaggccaacctgacagagaaggaggagatccggcagggcgagaccctgatgattgagggcacagagcagctgaagagcctgagcagtgacagcagcttctgcttcccccggccccacttctccttcagcaccctgcccaccgtgtccaggacagtggagctgaagtctgagcccaacgtcatcagcagccctgctgagtgcagcctggagctgagccccagccggccctgtgtgctgcacagcagcctgagcagaagagagacccccatctgcatgctgcccattgaaacagaaagaaacatctttgaaaattttgcccacccccccaacatcagccccagcgcctgccccctgcccccacctccacccatcagcccccccagccccccaccagccccagcccccctggcccctcctccagacatcagccccttcagcctcttctgccccccacccagcccccccagcatccccctgcccctgcccccacccaccttcttccccctgtctgtgtccaccagcggcccccccaccccacccctgctgccccccttccccacccccctgcccccacctcctccttccatcccctgccccccacctccttctgccagcttcctgagcacagaatgtgtgtgcatcactggagtgaagtgcaccaccaacctgatgcctgctgagaagatcaagagctccatgacccagctgagcaccaccaccgtgtgcaagacagacccccagcgggagcccaagggcatcctgcggcacgtgaagaacctggccgagctggagaagtctgtggccaacatgtacagccagatcgagaagaactacctgcggaccaacgtgtctgagctgcagaccatgtgccccagcgaggtgaccaacatggagatcaccagcgagcagaacaagggcagcctgaacaacatcgtggagggcacagagaagcagagccacagccagagcaccagcctgtag

SEQ ID NO: 166579 - DNA, 1965 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacatcgaggacaccaaggaccctgagctgcacctgttcctgaatgactacaccagcgtcttcaccgtgacccagacaggcatcacccgctacctgaccctgctgcagcctgtggaccgggaggagcagcagacctacaccttcagcatcacagcctttgatggagtgcaggagagcgagcccgtcatcgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccccccagctgagaggagaaattccatctgcaccgtgtacatcgaggtgctgccccccaacaaccagagccccccacgcttcccccagctgatgtacagcctggagatcagcgaggccatgagggtgggcgctgtgctgctgaacctgcagcacggggacagcaacctgcgggagagcacaggccagggcaagcactag

SEQ ID NO: 166580 - DNA, 5034 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagatgctgttcctgaacagcacaggccgggtgctggaccgggacccccccatgaacatccacagcatcgtggtgcaggtgcagtgcatcaacaagaaggtgggcaccatcatctaccacgaggtgagaattgtggtgcgggacagaaatgacaacagccccaccttcaagcatgagagctactatgccaccgtgaatgagctgacccctgtgggcaccaccatcttcaccggcttcagcggggacaacggggccacagacattgatgatggccccaacggccagattgaatatgtgatccagtacaacccagatgaccccaccagcaatgacacctttgagatccccctgatgctgactggaaacatcgtgctgaggaagaggctgaactatgaggacaagacccgctactttgtgatcatccaggccaatgaccgggcccagaacctgaatgaaagaaggaccaccaccaccaccctgactgtggatgtgctggatggagatgacctgggccccatgttcctgccctgtgtgctggtgcccaacacccgggactgccggcccctgacctaccaggccgccatccctgagctgcggaccccagaggagctgaaccccatcatcgtgaccccacccatccaggccatcgaccaggacaggaacatccagcccccaagtgaccggcccggcatcctgtacagcatcctggtgggcaccccagaggactacccccgcttcttccacatgcaccccaggacagctgagctgagcctgctggagcctgtgaacagagacttccaccagaagtttgacctggtgatcaaggccgagcaggacaatggccaccccctgcctgcctttgctggcctgcacatcgagatcctggatgagaacaaccagagcccctacttcaccatgcccagctaccagggctacatcctggagagcgcccctgtgggcgccaccatcagtgacagcctgaacctgaccagccccctgcgcatcgtggccctggacaaggacatcgaggacaccaaggaccctgagctgcacctgttcctgaatgactacaccagcgtcttcaccgtgacccagacaggcatcacccgctacctgaccctgctgcagcctgtggaccgggaggagcagcagacctacaccttcagcatcacagcctttgatggagtgcaggagagcgagcccgtcatcgtgaacatccaggtgatggatgccaatgacaacacccccaccttccctgagatctcctatgatgtgtatgtgtacacagacatgaggcctggggacagcgtcatccagctgacagctgtggatgctgatgagggcagcaatggagagatcacctatgagatcctggtgggcgcccagggcgacttcatcatcaacaagaccaccggcctcatcaccatcgcccctggggtggagatgattgtgggccgcacctacgccctgactgtgcaggccgctgacaatgcccccccagctgagaggagaaattccatctgcaccgtgtacatcgaggtgctgccccccaacaaccagagccccccacgcttcccccagctgatgtacagcctggagatcagcgaggccatgagggtgggcgctgtgctgctgaacctgcaggccacagaccgggagggggacagcatcacctacgccattgaaaatggagacccccagagggtcttcaacctgtctgagaccaccggcatcctgaccctgggcaaggccctggaccgggagagcacagaccgctacatcctgatcatcacagccagtgatggccgcccagatggcaccagcacagccaccgtgaacatcgtggtgacagatgtgaatgacaatgcccctgtgtttgacccctacctgcccaggaacctgtctgtggtggaggaggaggccaatgcctttgtgggccaggtgaaggccacagatcctgatgctggcatcaatggccaggtgcactacagcctgggcaacttcaacaacctcttccgcatcaccagcaatggcagcatctacacagctgtgaagctgaaccgggaggtgcgggactactatgagctggtggtggtggccacagatggagctgtgcaccccaggcacagcaccctgaccctggccatcaaggtgctggacattgatgacaacagccctgtgttcaccaacagcacctacacagtgctggtggaggagaacctgcctgctggcaccaccatcctgcagatcgaggccaaggatgtggacctgggcgccaacgtgtcctaccgcatccgcagccctgaggtgaagcacttctttgccctgcaccccttcaccggggagctgagcctgctgcggagcctggactatgaggccttcccagaccaggaggccagcatcaccttcctggtggaggcctttgacatctacggcaccatgcctcctggcatcgccaccgtgacagtgattgtgaaggacatgaatgactacccacctgtgttcagcaagaggatctacaagggcatggtggccccagatgctgtgaagggcacccccatcaccaccgtgtatgcagaagatgctgaccccccaggcctgcctgccagccgggtgcgctacagagtggatgatgtgcagttcccctacccagccagcatctttgaggtggaggaggacagcggccgggtcatcaccagggtgaacctgaatgaggagcccaccaccatcttcaagctggtggtggtggcctttgatgatggagagcctgtgatgagcagcagcgccaccgtgaagatcctggtgctgcaccctggagagatcccccgcttcacccaggaggagtaccggcccccacctgtgtctgagctggccaccaagggcaccatggtgggcgtcatctctgctgctgccatcaaccagagcatcgtgtacagcatcgtgtctggaaatgaggaggacaccttcggcatcaacaacatcaccggggtcatctacgtgaatggccccctggactatgagaccaggaccagctatgtgctgcgggtgcaggccgacagcctggaggtggtgctggccaacctgcgggtgcccagcaagagcaacacagccaaggtgtacatcgagatccaggatgagaacaaccacccccctgtgttccagaagaagttctacatcggcggcgtgtctgaagatgccaggatgttcacctctgtgctgcgggtgaaggccacagacaaggacaccggcaactacagcgtgatggcctaccgcctcatcatcccccccatcaaggagggcaaggagggctttgtggtggagacctacacaggcctcatcaagacagccatgctgttccacaacatgaggaggagctacttcaagttccaggtgattgccacagatgattatggcaagggcctgagcggcaaggcagatgtgctggtgtctgtggtgaaccagctggacatgcaggtgattgtgtccaatgtgccccccaccctggtggagaagaagattgaggacctgacagagatcctggaccgctacgtgcaggagcagatccctggggccaaggtggtggtggagagcattggagccaggagacatggagatgccttcagcctggaggactacaccaagtgtgacctgactgtgtatgccatcgacccccagaccaacagagccatcgacagaaatgagctgttcaagttcctggatggcaagctgctggacatcaacaaggacttccagccctactatggagagggcggccgcatcctggagatccgcaccccagaggccgtgaccagcatcaagaagagaggagagagcctgggctacacagaaggagccctgctggccctggccttcatcatcatcctgtgctgcatcccagccatcctggtggtgctggtgtcctaccgccacttcaagaggcggcaggccgagtgcaccaagacagcccgcatccaggccgccctgcctgctgccaagccagctgtgcctgccccagcccctgtggccgcccctcctcctcctcctcctcctcctcctggggcccacctgtatgaggagctgggggacagcagcatctaccgctatgagatgccccagtatggcagcagaagaaggctgctgcccccagctggccaggaggagtatggagaggtggtgggggaggccgaggaggagtatgaggaggaggagtgggccaggaagaggatgatcaagctggtggtggaccgggagtatgagaccagcagcactggagaggacagcgcccctgagtgccagaggaaccggctgcaccaccccagcatccacagcaacatcaatggaaacatctacatcgcccagaatggatctgtggtgaggacccggcgggcctgcctgacagacaacctgaaggtggccagccctgtgcggctgggcggccccttcaagaagctggacaagctggccgtgacccatgaggagaatgtgcccctgaacaccctgagcaagggccccttcagcacagagaagatgaatgcccggcccaccctggtgacctttgccccctgccctgtgggcacagacaacacagctgtgaagcccctgaggaaccggctgaagagcacagtggagcaggagagcatgattgacagcaagaacatcaaggaggccctggagttccacagcgaccacacccagagtgatgatgaggagctgtggatgggcccctggaacaacctgcacatccccatgaccaagctgtag

SEQ ID NO: 166581 - DNA, 279 bp, Artificial Sequence
  Description of Artificial Sequence: Synthetic coding sequence
atgttccggcagttctacctgtggacctgcctggccagcggcatcatcctgggcagcctgtttgagatctgcctgggccagtatgatgatgactgcaagctggcccggggcggccccccagccaccatcgtggccattgatgaggagagcagaaatggcaccatcctggtggacaacatgctgatcaagggcacagctgggggccctgaccccaccatcgagctgagcctgaaggacaacgtggactactgggtgctgatggaccctgtgaagcagtag

SEQ ID NO: 166582 - DNA, 3453 bp, Artificial Sequence
  Description of Artificial Sequence: Synthetic coding sequence
atggccccacccctgcggcccctggcccggctgcggcccccaggcatgctgctgcgggccctgctgctgctgctgctgctgagccccctgcccggggtgtggtgcttcagcgagctgagctttgtgaaggagccccaggatgtgacagtgaccaggaaggaccctgtggtgctggactgccaggcccatggagaggtgcccatcaaggtgacctggctgaagaatggagccaagatgtctgagaacaagagaattgaggtgctgagcaatggcagcctgtacatcagcgaggtggagggcagaagaggagagcagagtgatgagggcttctaccagtgcctggccatgaacaagtatggagccatcctgagccagaaggcccacctggccctgagcaccatcagcgcctttgaggtgcagcccatcagcacagaggtgcatgaaggaggagtggccaggtttgcctgcaagatcagcagccaccccccagctgtgatcacctgggagttcaacagaaccaccctgcccatgaccatggaccgcatcacagccctgcccactggagtgctgcagatctatgatgtgtcccagagggacagcggcaactaccgctgcatcgccgccaccgtggcccacaggaggaagtccatggaggccagcctgaccgtcatcccagccaaggagagcaagagcttccacacccccaccatcatcgccggcccccagaacatcaccaccagcctgcaccagacagtggtgctggagtgcatggccactggaaaccccaagcccatcatctcctggagccggctggaccacaagagcattgatgtgttcaacaccagggtgctgggcaatggaaacctgatgatcagtgatgtgcggctgcagcacgccggcgtgtatgtgtgccgggccaccaccccaggcaccaggaacttcaccgtggccatggccaccctgactgtgctggccccacccagctttgtggagtggccagagagcctgacccggcccagggctggaacagccaggtttgtgtgccaggccgagggcatccccagccccaagatgtcctggctgaagaatggaaggaagatccacagcaatggccgcatcaagatgtacaacagcaagctggtgatcaaccagatcatcccagaagatgatgccatctaccagtgcatggccgagaacagccagggcagcatcctgagccgggcccggctgactgtggtgatgtctgaggaccggcccagcgccccctacaacgtgcatgctgagaccatgagcagcagcgccatcctgctggcctgggagcggcccctgtacaacagcgacaaggtgattgcctacagcgtgcactacatgaaggccgagggcctgaacaatgaggagtaccaggtggtgattggaaatgacaccacccactacatcattgatgacctggagcccgccagcaactacaccttctacatcgtggcctacatgcccatgggcgccagccagatgtctgaccacgtgacccagaacaccctggaggatgtgcccctgcggcccccagagatcagcctgaccagccgcagccccacagacatcctgatctcctggctgcccatcccagccaagtacagaagaggccaggtggtgctgtaccgcctgtccttccggctgagcacagaaaattccatccaggtgctggagctgcccggcaccacccatgagtacctgctggagggcctgaagccagattctgtgtacctggtgcgcatcacagctgccaccagggtgggcctgggggagagctctgtgtggaccagccacaggacccccaaggccacctctgtgaaggcccccaagagccctgagctgcacctggagcccctgaactgcaccaccatctctgtgcgctggcagcaggatgtggaggacacagctgccatccagggctacaagctgtactacaaggaggagggccagcaggagaatggccccatcttcctggacaccaaggacctgctgtacaccctgagcggcctggaccccaggaggaagtaccacgtgcggctgctggcctacaacaacattgatgatggctaccaggccgaccagacagtgtccaccccaggctgtgtgtctgtgcgggacaggatggtgcccccacctcctccaccccaccacctgtatgccaaggccaacaccagcagcagcatcttcctgcactggaggaggcctgccttcaccgctgcccagatcatcaactacaccatccgctgcaaccctgtgggcctgcagaatgccagcctggtgctgtacctgcagaccagcgagacccacatgctggtgcagggcctggagcccaacaccaagtatgaatttgctgtgcggctgcacgtggaccagctgagcagcccctggagccctgtggtgtaccacagcaccctgcctgaggccccagctggcccccctgtgggcgtgaaggtgaccctgattgaagatgacacagccctggtgtcctggaagcccccagatggccctgagaccgtggtgacccgctacaccatcctgtatgccagcaggaaggcctggattgctggggagtggcaggtgctgcaccgggagggcgccatcaccatggccctgctggagaacctggtggccggaaatgtgtacatcgtgaagatcagcgccagcaatgaggtgggggagggccccttcagcaacagcgtggagctggccgtgctgcccaaggagaccagcgagagcaaccagaggcccaagaggctggacagcgcagatgccaaggtgtacagcggctactaccacctggaccagaagtccatgactggaattgctgtgggcgtgggcatcgccctgacctgcatcctgatctgtgtgctgatcctgatctaccgcagcaaggccaggaagagcagcgccagcaagacagcccagaatggcacccagcagctgcccaggaccagcgccagcctggccagcggaaatgaggtgggcaagaacctggagggcgctgtgggcaatgaggagagcctgatgcccatgatcatgcccaacagcttcattgatgccaagggcggcacagacctgatcatcaacagctatggccccatcatcaagaacaacagcaagaagaagtggttcttcttccaggacagcaagaagatccaggtggagcagccccagaggcgcttcaccccagctgtgtgcttctaccagcccggcaccaccgtgctgatcagtgatgaggacagccccagcagccctggccagaccaccagcttcagccggccctttggagtggccgctgacacagagcacagcgccaacagcgagggcagccatgaaacaggagacagcggccgcttcagccatgagagcaatgatgagatccacctgagcagcgtcatcagcaccaccccacccaacctgtag

SEQ ID NO: 166583 - DNA, 1434 bp, Artificial Sequence
  Description of Artificial Sequence: Synthetic coding sequence
atgggccgcacagtggtggtgctgggcggcggcatcagcggcctggccgccagctaccacctgagccgggccccctgcccccccaaggtggtgctggtggagagcagcgagcggctgggcggctggatccgctctgtgcggggccccaacggggccatctttgagctgggcccccggggcatccggcctgctggggccctgggcgcccggaccctgctgctggtgtctgagctgggcctggacagcgaggtgctgcctgtgcggggggaccaccctgctgcccagaaccgcttcctgtatgtgggcggggccctgcacgccctgcccaccggcctgcggggcctgctgcggcccagcccccccttcagcaagcccctcttctgggccggcctgcgggagctgaccaagccccggggcaaggagccagatgaaacagtgcacagctttgcccagaggcggctgggccctgaggtggccagcctggccatggacagcctgtgccggggcgtgtttgctggcaacagccgggagctgagcatccgcagctgcttccccagcctcttccaggccgagcagacccacaggagcatcctgctgggcctgctgctgggcgccggccgcaccccccagccagattctgccctgatccggcaggccctggccgagcgctggagccagtggagcctgcggggcggcctggagatgctgccccaggccctggagacccacctgaccagccggggcgtgtctgtgctgcggggccagcctgtgtgtggcctgagcctgcaggccgagggccgctggaaggtgtccctgcgggacagcagcctggaggccgaccacgtgatcagcgccatcccagcctctgtgctgtctgagctgctgcctgctgaggccgcccccctggcccgggccctgagcgccatcacagctgtgtctgtggccgtggtgaacctgcagtaccagggcgcccacctgcctgtgcagggcttcggccacctggtgcccagcagtgaagatcctggggtgctgggcatcgtgtatgacagcgtggccttccctgagcaggacggcagccccccaggcctgcgggtgacagtgatgctgggcggctcctggctgcagaccctggaggccagcggctgtgtgctgagccaggagctgttccagcagagggcccaggaggccgccgccacccagctgggcctgaaggagatgcccagccactgcctggtgcacctgcacaagaactgcatcccccagtacaccctgggccactggcagaagctggagagcgcccggcagttcctgacagcccaccggctgcccctgaccctggccggggccagctatgaaggagtggccgtgaatgactgcatcgagagcggccggcaggccgctgtgtctgtgctgggcacagagcccaacagctag

SEQ ID NO: 166584 - DNA, 1434 bp, Artificial Sequence; identical to SEQ ID NO: 166583
  Description of Artificial Sequence: Synthetic coding sequence

SEQ ID NO: 166585 - DNA, 717 bp, Artificial Sequence
  Description of Artificial Sequence: Synthetic coding sequence
atgggccgcacagtggtggtgctgggcggcggcatcagcggcctggccgccagctaccacctgagccgggccccctgcccccccaaggtggtgctggtggagagcagcgagcggctgggcggctggatccgctctgtgcggggccccaacggggccatctttgagctgggcccccggggcatccggcctgctggggccctgggcgcccggaccctgctgctgggcttcggccacctggtgcccagcagcgaggaccccggggtgctgggcatcgtgtatgattctgtggccttccctgagcaggacggcagccccccaggcctgcgggtgacagtgatgctgggcggctcctggctgcagaccctggaggccagcggctgtgtgctgagccaggagctgttccagcagagggcccaggaggccgccgccacccagctgggcctgaaggagatgcccagccactgcctggtgcacctgcacaagaccaagaaccagctgaagtggaggcagagccatgacagaacagtggagtggcccaaggagtacccaggccgcagcaggaagcaggcccccagcatcctgcacgtgcccggctgccagctgctgcgctgccgggaccgggaccacctgggcgctgtgtctgagcagcccaggagcagcgctgagagccgggtgggcgtggccagcagcaccttcagcaccttccccctcttctag

SEQ ID NO: 166586 - DNA, 1335 bp, Artificial Sequence
  Description of Artificial Sequence: Synthetic coding sequence
atgggccgcacagtggtggtgctgggcggcggcatcagcggcctggccgccagctaccacctgagccgggccccctgcccccccaaggtggtgctggtggagagcagcgagcggctgggcggctggatccgctctgtgcggggccccaacggggccatctttgagctgggcccccggggcatccggcctgctggggccctgggcgcccggaccctgctgctggcctgtggggagcaggtgtctgagctgggcctggacagcgaggtgctgcctgtgcggggggaccaccctgctgcccagaaccgcttcctgtatgtgggcggggccctgcacgccctgcccaccggcctgagccccagcctgaccctgaaggtggccagcctggccatggacagcctgtgccggggcgtgtttgctggcaacagccgggagctgagcatccgcagctgcttccccagcctcttccaggccgagcagacccacaggagcatcctgctgggcctgctgctgggcgccggccgcaccccccagcctgacagcgccctgatccggcaggccctggccgagcgctggagccagtggagcctgcggggcggcctggagatgctgccccaggccctggagacccacctgaccagcagaggagtgtctgtgctgcggggccagcctgtgtgtggcctgagcctgcaggccgagggccgctggaaggtgtccctgcgggacagcagcctggaggccgaccacgtgatcagcgccatcccagcctctgtgctgtctgagctgctgcctgctgaggccgcccccctggcccgggccctgagcgccatcacagctgtgtctgtggccgtggtgaacctgcagtaccagggcgcccacctgcctgtgcagggcttcggccacctggtgcccagcagcgaggaccccggggtgctgggcatcgtgtatgattctgtggccttccctgagcaggacggcagccccccaggcctgcgggtgacagtgatgctgggcggctcctggctgcagaccctggaggccagcggctgtgtgctgagccaggagctgttccagcagagggcccaggaggccgccgccacccagctgggcctgaaggagatgcccagccactgcctggtgcacctgcacaagaactgcatcccccagtacaccctgggccactggcagaagctggagagcgcccggcagttcctgacagcccaccggctgcccctgaccctggccggggccagctatgagggcgtggccgtgaatgactgcattgaaagtggccggcaggccgctgtgtctgtgctgggcacagagcccaacagctag

SEQ ID NO: 166587 - DNA, 144 bp, Artificial Sequence
  Description of Artificial Sequence: Synthetic coding sequence
atggacatcctgaagtctgagatcctgaggaagaggcagctggtggaggacaggaacctgctgtctgagagcatgtgtgccaatgatgcctacctgcagatggccatcggaaatgccccctggcccatcggcgtgaccatgtag

SEQ ID NO: 166588 - DNA, 504 bp, Artificial Sequence
  Description of Artificial Sequence: Synthetic coding sequence
atgatccgcaccttccctggagagaacaagaagtacttcaagaggtctgagctggccaagaaggaggaggaggcctactttgagcgctgtggctacaagatccagcccaaggaggaggaccagaagcccctgaccagcagcaaccctgtgctggagctggagctggccgaggagaagctgcccatgaccctgagccggcaggaggtgatccggcggctgcgggagcggggggagcccatccggctgtttggagaaacagattatgatgccttccagaggctgaggaagattgagatcctgaccccagaggtgaacaagggcctgagaaatgacctgaaggccgccctggacaagattgaccagcagtacctgaatgaaattgtgggcggccaggagcctggagaggaggacacccagaatgacctgaaggtgcatgaggagaacaccaccatcgaggagctggaggccctgggggagagcctgggcaaaggagatgaccactag

SEQ ID NO: 166589 - DNA, 750 bp, Artificial Sequence
  Description of Artificial Sequence: Synthetic coding sequence
atgatccgcaccttccctggagagaacaagaagtacttcaagaggtctgagctggccaagaaggaggaggaggcctactttgagcgctgtggctacaagcccatcaatgagaagcccagcggggagatccagcccaaggaggaggaccagaagcccctgaccagcagcaaccctgtgctggagctggagctggccgaggagaagctgcccatgaccctgagccggcaggaggtgatccggcggctgcgggagcggggggagcccatccggctgtttggagaaacagattatgatgccttccagaggctgaggaagattgagatcctgaccccagaggtgaacaagggcctgagaaatgacctgaaggccgccctggacaagattgaccagcagtacctgaatgagatcgtgggcggccaggagcccggggaggaggacacccagaatgacctgaaggtgcatgaggagaacaccaccatcgaggagctggaggccctgggggagagcctgggcaaaggagatgaccacaaggacatggacatcatcaccaagttcctgaagttcctgctgggcgtgtgggccaaggagctgaatgccagagaagattatgtgaagaggtctgtgcagggcaagctgaacagcgccacccagaagcagacagagagctacctgcggcccctcttcaggaagctgaggaagaggaacctgcctgctgacatcaaggagagcatcacagacatcatcaagtag

SEQ ID NO: 166590 - DNA, 1029 bp, Artificial Sequence
  Description of Artificial Sequence: Synthetic coding sequence
atggacatcctgaagtctgagatcctgaggaagaggcagctggtggaggacaggaacctgctggtggagaacaagaagtacttcaagaggtctgagctggccaagaaggaggaggaggcctactttgagcgctgtggctacaagatccagcccaaggaggaggaccagaagcccctgaccagcagcaaccctgtgctggagctggagctggccgaggagaagctgcccatgaccctgagccggcaggaggtgatccggcggctgcgggagcggggggagcccatccggctgtttggagaaacagattatgatgccttccagaggctgaggaagattgagatcctgaccccagaggtgaacaagggcctgagaaatgacctgaaggccgccctggacaagattgaccagcagtacctgaatgagatcgtgggcggccaggagcccggggaggaggacacccagaatgacctgaaggtgcatgaggagaacaccaccatcgaggagctggaggccctgggggagagcctgggcaaaggagatgaccacaaggacatggacatcatcaccaagttcctgaagttcctgctgggcgtgtgggccaaggagctgaatgccagagaagattatgtgaagaggtctgtgcagggcaagctgaacagcgccacccagaagcagacagagagctacctgcggcccctcttcaggaagctgaggaagaggaacctgcctgctgacatcaaggagagcatcacagacatcatcaagttcatgctgcagcgggagtatgtgaaggccaatgatgcctacctgcagatggccatcggaaatgccccctggcccatcggcgtgaccatggtgggcatccacgccaggacaggccgggagaagatcttcagcaagcacgtggcccacgtgctgaatgatgagacccagaggaagtacatccagggcctgaagaggctgatgaccatctgccagaagcacttccccacagaccccagcaaatgtgtggagtacaatgccctgtag

SEQ ID NO: 166591 - DNA, 750 bp, Artificial Sequence; identical to SEQ ID NO: 166589
  Description of Artificial Sequence: Synthetic coding sequence

SEQ ID NO: 166592 - DNA, 1083 bp, Artificial Sequence
  Description of Artificial Sequence: Synthetic coding sequence
atggacacccccctgcggcgcagccggcggctgggcggcctgcggcctgagagccctgagagcctgacctctgtgtccaggacccggcgggccctggtggagtttgagagcaaccctgaggagacccgggagcccggcagcccccccagcgtgcagagagctggcctgggcagccctgagcggccccccaagaccagccctggcagcccccggctgcagcagggcgccggcctggagagcccccagggccagcctgagcctggagctgccagcccccagaggcagcaggacctgcacctggagagcccccagaggcagcctgagtacagccctgagagcccccgctgccagcccaagcccagcgaggaggcccccaagtgcagccaggaccagggcgtgctggccagcgagctggcccagaacaaggaggagctgacccctggggccccccagcaccagctgccccctgtgcccggcagccctgagccctacccaggccagcaggcccctggccctgagcccagccagcccctgctggagctgaccccccgggcccctggcagcccccggggccagcacgagcccagcaagcccccacctgctggggagaccgtgactggaggctttggagccaagaagaggaagggcagcagcagccaggccccagccagcaagaagctgaacaaggaggagctgcctgtgatccccaagggcaagcccaagagcggccgggtgtggaaggacaggagcaagaagcgcttcagccagatgctgcaggacaagcccctgcggacctcctggcagaggaagatgaaggagcggcaggagaggaagctggccaaggactttgcccggcacctggaggaggagaaggagcggcggcggcaggagaagaagcagaggagagctgagaacctgaagaggcggctggagaatgaaaggaaggccgaggtggtgcaggtgatcagaaatcctgccaagctgaagagggccaagaagaagcagctgcggagcattgagaagagggacaccctggccctgctgcagaagcagcccccccagcagcctgctgccaagatctag

SEQ ID NO: 166593 - DNA, 1095 bp, Artificial Sequence
  Description of Artificial Sequence: Synthetic coding sequence
atgagcctggctgatgagctgctggccgacctggaggaggccgctgaggaggaggagggcggcagctatggagaggaggaggaggagcccgccattgaagatgtgcaggaggagacccagctggacctgagcggggacagcgtgaagaccatcgccaagctgtgggacagcaagatgtttgctgagatcatgatgaagattgaggagtacatcagcaagcaggccaaggccagcgaggtgatgggccctgtggaggccgcccctgagtacagagtgattgtggatgccaacaacctgactgtggagattgaaaatgagctgaacatcatccacaagttcatccgggacaagtacagcaagcgcttccctgagctggagagcctggtgcccaatgccctggactacatcagaacagtgaaggagctgggcaacagcctggacaagtgcaagaacaatgaaaacctgcagcagatcctgaccaatgccaccatcatggtggtgtctgtgacagccagcaccacccagggccagcagctgtctgaggaggagctggagcggctggaggaggcctgtgacatggccctggagctgaatgccagcaagcaccgcatctatgaatatgtggagagcaggatgtccttcatcgcccccaacctgagcatcatcattggagccagcacagctgccaagatcatgggcgtggccggcggcctgaccaacctgagcaagatgcctgcctgcaacatcatgctgctgggcgcccagaggaagaccctgagcggcttcagcagcacctctgtgctgccccacacaggctacatctaccacagcgacatcgtgcagagcctgcccccagacctgcggaggaaggccgcccggctggtggccgccaagtgcaccctggccgcccgggtggacagcttccacgagagcacagagggcaaggtgggctatgagctgaaggatgaaattgaaaggaagtttgacaagtggcagaggcggcgctggctgcggcccaccaggagcatcagccctgcctggctgagcagcagccgcagccgggcccggcgggtggccctgtgccccccagagtag

SEQ ID NO: 166594 - DNA, 1500 bp, Artificial Sequence
  Description of Artificial Sequence: Synthetic coding sequence
atgagcctggctgatgagctgctggccgacctggaggaggccgctgaggaggaggagggcggcagctatggagaggaggaggaggagcccgccattgaagatgtgcaggaggagacccagctggacctgagcggggacagcgtgaagaccatcgccaagctgtgggacagcaagatgtttgctgagatcatgatgaagattgaggagtacatcagcaagcaggccaaggccagcgaggtgatgggccctgtggaggccgcccctgagtacagagtgattgtggatgccaacaacctgactgtggagattgaaaatgagctgaacatcatccacaagttcatccgggacaagtacagcaagcgcttccctgagctggagagcctggtgcccaatgccctggactacatcagaacagtgaaggagctgggcaacagcctggacaagtgcaagaacaatgaaaacctgcagcagatcctgaccaatgccaccatcatggtggtgtctgtgacagccagcaccacccagggccagcagctgtctgaggaggagctggagcggctggaggaggcctgtgacatggccctggagctgaatgccagcaagcaccgcatctatgaatatgtggagagcaggatgtccttcatcgcccccaacctgagcatcatcattggagccagcacagctgccaagatcatgggcgtggccggcggcctgaccaacctgagcaagatgcctgcctgcaacatcatgctgctgggcgcccagaggaagaccctgagcggcttcagcagcacctctgtgctgccccacacaggctacatctaccacagcgacatcgtgcagagcctgcccccagacctgcggaggaaggccgcccggctggtggccgccaagtgcaccctggccgcccgggtggacagcttccacgagagcacagagggcaaggtgggctatgagctgaaggatgaaattgaaaggaagtttgacaagtggcaggagcccccacctgtgaagcaggtgaagcccctgcctgcccccctggatggccagaggaagaagagaggaggaagacgctacaggaagatgaaggagcggctgggcctgacagagatcaggaagcaggccaacaggatgagctttggagaaattgaagaagatgcctaccaggaggacctgggcttcagcctgggccacctgggcaagagcggcagcggccgggtgcggcagacccaggtgaatgaggccaccaaggcccgcatcagcaagaccctgcagaggaccctgcagaagcagagcgtggtgtatggaggcaagagcaccatccgggacaggagcagcggcacagccagctctgtggccttcacccccctgcagggcctggagatcgtgaacccccaggccgctgagaagaaggtggccgaggccaaccagaagtacttcagctccatggccgagttcctgaaggtgaagggggagaagagcggcctgatgagcacctag

SEQ ID NO: 166595 - DNA, 1353 bp, Artificial Sequence
  Description of Artificial Sequence: Synthetic coding sequence
atgagcctggctgatgagctgctggccgacctggaggaggccgctgaggaggaggagggcggcagctatggagaggaggaggaggagcccgccattgaagatgtgcaggaggagacccagctggacctgagcggggacagcgtgaagaccatcgccaagctgtgggacagcaagatgtttgctgagatcatgatgaagattgaggagtacatcagcaagcaggccaaggccagcgaggtgatgggccctgtggaggccgcccctgagtacagagtgattgtggatgccaacaacctgactgtggagattgaaaatgagctgaacatcatccacaagttcatccgggacaagtacagcaagcgcttccctgagctggagagcctggtgcccaatgccctggactacatcagaacagtgaaggagctgggcaacagcctggacaagtgcaagaacaatgaaaacctgcagcagatcctgaccaatgccaccatcatggtggtgtctgtgacagccagcaccacccagggccagcagctgtctgaggaggagctggagcggctggaggaggcctgtgacatggccctggagctgaatgccagcaagcaccgcatctatgaatatgtggagagcaggatgtccttcatcgcccccaacctgagcatcatcattggagccagcacagctgccaagatcatgggcgtggccggcggcctgaccaacctgagcaagatgcctgcctgcaacatcatgctgctgggcgcccagaggaagaccctgagcggcttcagcagcacctctgtgctgccccacacaggctacatctaccacagcgacatcgtgcagagcctgcccccagacctgcggaggaaggccgcccggctggtggccgccaagtgcaccctggccgcccgggtggacagcttccacgagagcacagagggcaaggtgggctatgagctgaaggatgaaattgaaaggaagtttgacaagtggcaggagcccccacctgtgaagcaggtgaagcccctgcctgcccccctggatggccagaggaagaagagaggaggaagacgctacaggaagatgaaggagcggctgggcctgacagagatcaggaagcaggccaacaggatgagctttggagaaattgaagaagatgcctaccaggaggacctgggcttcagcctgggccacctggatgctgctgctgaccctgctgaggccgagcggcgcatctggagggaggtgcaccacccccggcccctgctgggccacggcctgcagaggggcctgcaccccaccccaggccctggggactgtgagcccactggaggccgggaggagggcggctag

SEQ ID NO: 166596 - DNA, 831 bp, Artificial Sequence
  Description of Artificial Sequence: Synthetic coding sequence
atgagcctggctgatgagctgctggccgacctggaggaggccgctgaggaggaggagggcggcagctatggagaggaggaggaggagcccgccattgaagatgtgcaggaggagacccagctggacctgagcggggacagcgtgaagaccatcgccaagctgtgggacagcaagatgtttgctgagatcatgatgaagattgaggagtacatcagcaagcaggccaaggccagcgaggtgatgggccctgtggaggccgcccctgagtacagagtgattgtggatgccaacaacctgactgtggagattgaaaatgagctgaacatcatccacaagttcatccgggacaagtacagcaagcgcttccctgagctggagagcctggtgcccaatgccctggactacatcagaacagtgaaggagctgggcaacagcctggacaagtgcaagaacaatgaaaacctgcagcagatcctgaccaatgccaccatcatggtggtgtctgtgacagccagcaccacccagggccagcagctgtctgaggaggagctggagcggctggaggaggcctgtgacatggccctggagctgaatgccagcaagcaccgcatctatgaatatgtggagagcaggatgtccttcatcgcccccaacctgagcatcatcattggagccagcacagctgccaagatcatgggcgtggccggcggcctgaccaacctgagcaagatgcctgcctgcaacatcatgctgctgggcgcccagaggaagaccctgagcggcttcagcagcacctctgtgctgccccacacaggctacatctaccactag

SEQ ID NO: 166597 - DNA, 855 bp, Artificial Sequence
  Description of Artificial Sequence: Synthetic coding sequence
atgagcctggctgatgagctgctggccgacctggaggaggccgctgaggaggaggagggcggcagctatggagaggaggaggaggagcccgccattgaagatgtgcaggaggagacccagctggacctgagcggggacagcgtgaagaccatcgccaagctgtgggacagcaagatgtttgctgagatcatgatgaagattgaggagtacatcagcaagcaggccaaggccagcgaggtgatgggccctgtggaggccgcccctgagtacagagtgattgtggatgccaacaacctgactgtggagattgaaaatgagctgaacatcatccacaagttcatccgggacaagtacagcaagcgcttccctgagctggagagcctggtgcccaatgccctggactacatcagaacagtgaaggagctgggcaacagcctggacaagtgcaagaacaatgaaaacctgcagcagatcctgaccaatgccaccatcatggtggtgtctgtgacagccagcaccacccagggccagcagctgtctgaggaggagctggagcggctggaggaggcctgtgacatggccctggagctgaatgccagcaagcaccgcatctatgaatatgtggagagcaggatgtccttcatcgcccccaacctgagcatcatcattggagccagcacagctgccaagatcatgggcgtggccggcggcctgaccaacctgagcaagatgcctgcctgcaacatcatgctgctgggcgcccagaggaagaccctgagcggcttcagcagcacctctgtgctgccccacacaggctacatctaccacagcgacatcgtgcagagcctgccctag

SEQ ID NO: 166598 - DNA, 786 bp, Artificial Sequence
  Description of Artificial Sequence: Synthetic coding sequence
atgagcctggctgatgagctgctggccgacctggaggaggccgctgaggaggaggagggcggcagctatggagaggaggaggaggagcccgccattgaagatgtgcaggaggagacccagctggacctgagcggggacagcgtgaagaccatcgccaagctgtgggacagcaagatgtttgctgagatcatgatgaagattgaggagtacatcagcaagcaggccaaggccagcgaggtgatgggccctgtggaggccgcccctgagtacagagtgattgtggatgccaacaacctgactgtggagattgaaaatgagctgaacatcatccacaagttcatccgggacaagtacagcaagcgcttccctgagctggagagcctggtgcccaatgccctggactacatcagaacagtgaaggagctgggcaacagcctggacaagtgcaagaacaatgaaaacctgcagcagatcctgaccaatgccaccatcatggtggtgtctgtgacagccagcaccacccagggccagcagctgtctgaggaggagctggagcggctggaggaggcctgtgacatggccctggagctgaatgccagcaagcaccgcatctatgaatatgtggagagcaggatgtccttcatcgcccccaacctgagcatcatcattggagccagcacagctgccaagatcatgggcgtggccggcggcctgaccaacctgagcaagatgcctgcctgcaacatcatgctgctgggcgcccagaggaagaccctgagcggctag

SEQ ID NO: 166599 - DNA, 1569 bp, Artificial Sequence
  Description of Artificial Sequence: Synthetic coding sequence
atggccagcagccgggccagcagcacccaggccaccaagaccaaggccccagatgacctggtggcccctgtggtgaagaagccccacatctactacggcagcctggaggagaaggagcgggagcggctggccaagggggagagcggcatcctgggcaaggatggcctgaaggccggcatcgaggccggcaacatcaacatcaccagcggggaggtgtttgaaattgaggagcacatcagcgagcggcaggccgaggtgctggccgagtttgagaggaggaagagggcccggcagatcaacgtgtccacagatgacagcgaggtgaaggcctgcctgcgggccctgggggagcccatcaccctgtttggagagggccctgctgagcggcgggagcggctgaggaacatcctgtctgtggtgggcacagatgccctgaagaagaccaagaaggatgatgagaagagcaagaagagcaaggaggagtaccagcagacctggtaccacgagggccccaacagcctgaaggtggcccggctgtggatcgccaactacagcctgccccgggccatgaagaggctggaggaggcccggctgcacaaggagatccctgagaccaccaggaccagccagatgcaggagctgcacaagagcctgcggagcctgaacaacttctgcagccagattggagatgaccggcccatctcctactgccacttcagccccaacagcaagatgctggccacagcctgctggagcggcctgtgcaagctgtggagcgtgcctgactgcaacctgctgcacaccctgcggggccacaacaccaacgtgggcgccatcgtgttccaccccaagagcacagtgtccctggaccccaaggatgtgaacctggccagctgtgccgcagatggctctgtgaagctgtggagcctggacagtgatgagcctgtggccgacatcgagggccacacagtgcgggtggcccgggtgatgtggcaccccagcggccgcttcctgggcaccacctgctatgaccgctcctggaggctgtgggacctggaggcccaggaggagatcctgcaccaggagggccacagcatgggcgtgtatgacatcgccttccaccaggacggcagcctggccggcaccggcggcctggatgccttcggccgggtgtgggacctgaggacaggccgctgcatcatgttcctggagggccacctgaaggagatctacggcatcaacttcagccccaacggctaccacatcgccaccggcagcggggacaacacctgcaaggtgtgggacctgcggcagaggcgctgtgtgtacaccatcccagcccaccagaacctggtgactggagtgaagtttgagcccatccacggcaacttcctgctgactggagcctatgacaacacagccaagatctggacccaccctggctggagccccctgaagaccctggccggccacgagggcaaggtgatgggcctggacatcagcagtgatggccagctgattgccacctgcagctatgacaggaccttcaagctgtggatggccgagtag

SEQ ID NO: 166600 - DNA, 1566 bp, Artificial Sequence
  Description of Artificial Sequence: Synthetic coding sequence
atggccagcagccgggccagcagcacagccaccaagaccaaggccccagatgacctggtggcccctgtggtgaagaagccccacatctactacggcagcctggaggagaaggagcgggagcggctggccaagggggagagcggcatcctgggcaaggatggcctgaaggccggcattgaagctggcaacatcaacatcaccagcggggaggtgtttgaaattgaggagcacatcagcgagcggcaggccgaggtgctggccgagtttgaaagaaggaagagggcccggcagatcaacgtgtccacagatgattctgaggtgaaggcctgcctgcgggccctgggggagcccatcaccctgtttggagagggccctgctgagcggcgggagcggctgaggaacatcctgtctgtggtgggcacagatgccctgaagaagaccaagaaggatgatgagaagagcaagaagagcaaggaggagtaccagcagacctggtaccacgagggccccaacagcctgaaggtggcccggctgtggatcgccaactacagcctgccccgggccatgaagaggctggaggaggcccggctgcacaaggagatccctgagaccaccaggaccagccagatgcaggagctgcacaagagcctgcggagcctgaacaacttctgcagccagattggagatgaccggcccatctcctactgccacttcagccccaacagcaagatgctggccacagcctgctggagcggcctgtgcaagctgtggagcgtgcctgactgcaacctgctgcacaccctgcggggccacaacaccaacgtgggcgccatcgtgttccaccccaagagcacagtgtccctggaccccaaggatgtgaacctggccagctgtgccgcagatggctctgtgaagctgtggagcctggacagtgatgagcctgtggccgacatcgagggccacacagtgcgggtggcccgggtgatgtggcaccccagcggccgcttcctgggcaccacctgctatgaccgctcctggaggctgtgggacctggaggcccaggaggagatcctgcaccaggagggccacagcatgggcgtgtatgacatcgccttccaccaggacggcagcctggccggcactggaggcctggatgccttcggccgggtgtgggacctgaggacaggccgctgcatcatgttcctggagggccacctgaaggagatctacggcatcaacttcagccccaacggctaccacatcgccactggaagtggggacaacacctgcaaggtgtgggacctgcggcagaggcgctgtgtgtacaccatcccagcccaccagaacctggtgactggagtgaagtttgagcccatccacggcaacttcctgctgaccggggcctatgacaacacagccaagatctggacccaccctggctggagccccctgaagaccctggccggccacgagggcaaggtgatgggcctggacatcagcagtgatggccagctgattgccacctgcagctatgacaggaccttcaagctgtggatggccgagtag

SEQ ID NO: 166601 - DNA, 3024 bp, Artificial Sequence
  Description of Artificial Sequence: Synthetic coding sequence
atggctgctgctgagacccagagcctgcgggagcagcctgagatggaggatgccaacagcgagaagagcatcaatgaagaaaatggagaggtgtctgaggaccagagccagaacaagcacagccgccacaagaagaagaagcacaagcacaggagcaagcacaagaagcacaagcacagcagcgaggaggacaaggacaagaagcacaagcacaagcacaagcacaagaagcacaagaggaaggagatcattgatgccagtgacaaggagggcatgagccctgccaagaggaccaagctggatgacctggccctgctggaggacctggagaagcagagggccctgatcaaggccgagctggacaatgagctgatggagggcaaggtgcagagcggcatgggcctcatcctgcagggctatgagagcggcagcgaggaggagggggagatccacgagaaggccagaaatggaaacagaagcagcaccaggagcagcagcaccaagggcaagctggagctggtggacaacaagatcaccaccaagaagaggagcaagagccgcagcaaggagaggaccaggcacagaagtgacaagaagaagagcaagggcggcattgaaattgtgaaggagaagaccaccaggagcaagagcaaggagaggaagaagagcaagagccccagcaagaggagcaagagccaggaccaggccaggaagagcaagagccccaccctgcggcggcgcagccaggagaagattggcaaggcccggagccccacagatgacaaggtgaagattgaggacaagagcaagagcaaggacaggaagaagagccccatcatcaatgaaagccgcagccgggaccggggcaagaagagccgcagccctgtggacctgcggggcaagagcaaggacagaagaagccgcagcaaggagaggaagagcaagagaagtgaaacagacaaggagaagaagcccatcaagagccccagcaaggatgccagcagcggcaaggagaacagaagccccagccggcggcccggccgcagccccaagaggaggagcctgagccccaagccccgggacaagagccgccgcagccgcagccccctgctgaatgaccggcgcagcaagcagagcaagagccccagcaggaccctgagccctggccggcgggccaagagccgcagcctggagaggaagagaagagagcctgagcggcggcggctgagcagccccaggacccggcccagagatgacatcctgagcagaagagagaggagcaaggatgccagccccatcaaccgctggagccccaccaggagaagaagccgcagccccatcagaagaagaagccgcagccccctgcggcgcagccgcagccccaggagaagaagccgcagcccccggcggcgggaccggggcagaagaagccgcagccggctgcggcggcgcagccgcagcagaggaggaagaagaagaagaagccgcagcaaggtgaaggaggacaagttcaagggcagcctgtctgagggcatgaaggtggagcaggagagcagcagtgatgacaacctggaggactttgatgtggaggaggaggatgaggaggccctgattgagcagaggcgcatccagaggcaggccatcgtgcagaagtacaagtacctggccgaggacagcaacatgtctgtgcccagcgagcccagcagcccccagagcagcaccaggaccaggagccccagcccagatgacatcctggagcgggtggccgcagatgtgaaggagtatgagcgggagaatgtggacacctttgaggcctctgtgaaggccaagcacaacctgatgacagtggagcagaacaacggcagcagccagaagaagctgctggccccagacatgttcacagaaagtgatgacatgtttgctgcctactttgacagcgcccggctgcgggccgccggcatcggcaaggacttcaaggagaaccccaacctgcgggacaactggacagatgctgagggctactacagagtgaacattggagaggtgctggacaagcgctacaacgtgtatggctacacaggccagggcgtcttcagcaatgtggtgcgggcccgggacaatgcccgggccaaccaggaggtggccgtgaagatcatccggaacaatgagctgatgcagaagacaggcctgaaggagctggagttcctgaagaagctgaatgatgctgaccctgatgacaagttccactgcctgcggctcttccgccacttctaccacaagcagcacctgtgcctggtgtttgagcccctgtccatgaacctgcgggaggtgctgaagaagtatggcaaggatgtgggcctgcacatcaaggctgtgcgcagctacagccagcagctgttcctggccctgaagctgctgaagcgctgcaacatcctgcacgccgacatcaagccagacaacatcctggtgaatgaaagcaagaccatcctgaagctgtgtgactttggaagtgccagccacgtggccgacaatgacatcaccccctacctggtgagccgcttctaccgggcccctgagatcatcatcggcaagagctatgactatggcatcgacatgtggagcgtgggctgcaccctgtatgagctgtacaccgggaagatcctcttccctgggaagaccaacaaccacatgctgaagctggccatggacctgaagggcaagatgcccaacaagatgatcagaaaaggagtcttcaaggaccagcactttgaccagaacctgaacttcatgtacatcgaggtggacaaggtgacagagcgggagaaggtgacagtgatgagcaccatcaaccccaccaaggacctgctggccgacctgattggctgccagaggctgcctgaggaccagaggaagaaggtgcaccagctgaaggacctgctggaccagatcctgatgctggaccctgccaagaggatcagcatcaaccaggccctgcagcacgccttcatccaggagaagatctag

SEQ ID NO: 166602 - DNA, 3024 bp, Artificial Sequence; identical to SEQ ID NO: 166601
  Description of Artificial Sequence: Synthetic coding sequence

SEQ ID NO: 166603 - DNA, 2982 bp, Artificial Sequence
  Description of Artificial Sequence: Synthetic coding sequence
atggaggatgccaacagcgagaagagcatcaatgaagaaaatggagaggtgtctgaggaccagagccagaacaagcacagccgccacaagaagaagaagcacaagcacaggagcaagcacaagaagcacaagcacagcagcgaggaggacaaggacaagaagcacaagcacaagcacaagcacaagaagcacaagaggaaggagatcattgatgccagtgacaaggagggcatgagccctgccaagaggaccaagctggatgacctggccctgctggaggacctggagaagcagagggccctgatcaaggccgagctggacaatgagctgatggagggcaaggtgcagagcggcatgggcctcatcctgcagggctatgagagcggcagcgaggaggagggggagatccacgagaaggccagaaatggaaacagaagcagcaccaggagcagcagcaccaagggcaagctggagctggtggacaacaagatcaccaccaagaagaggagcaagagccgcagcaaggagaggaccaggcacagaagtgacaagaagaagagcaagggcggcattgaaattgtgaaggagaagaccaccaggagcaagagcaaggagaggaagaagagcaagagccccagcaagaggagcaagagccaggaccaggccaggaagagcaagagccccaccctgcggcggcgcagccaggagaagattggcaaggcccggagccccacagatgacaaggtgaagattgaggacaagagcaagagcaaggacaggaagaagagccccatcatcaatgaaagccgcagccgggaccggggcaagaagagccgcagccctgtggacctgcggggcaagagcaaggacagaagaagccgcagcaaggagaggaagagcaagagaagtgaaacagacaaggagaagaagcccatcaagagccccagcaaggatgccagcagcggcaaggagaacagaagccccagccggcggcccggccgcagccccaagaggaggagcctgagccccaagccccgggacaagagccgccgcagccgcagccccctgctgaatgaccggcgcagcaagcagagcaagagccccagcaggaccctgagccctggccggcgggccaagagccgcagcctggagaggaagagaagagagcctgagcggcggcggctgagcagccccaggacccggcccagagatgacatcctgagcagaagagagaggagcaaggatgccagccccatcaaccgctggagccccaccaggagaagaagccgcagccccatcagaagaagaagccgcagccccctgcggcgcagccgcagccccaggagaagaagccgcagcccccggcggcgggaccggggcagaagaagccgcagccggctgcggcggcgcagccgcagcagaggaggaagaagaagaagaagccgcagcaaggtgaaggaggacaagttcaagggcagcctgtctgagggcatgaaggtggagcaggagagcagcagtgatgacaacctggaggactttgatgtggaggaggaggatgaggaggccctgattgagcagaggcgcatccagaggcaggccatcgtgcagaagtacaagtacctggccgaggacagcaacatgtctgtgcccagcgagcccagcagcccccagagcagcaccaggaccaggagccccagcccagatgacatcctggagcgggtggccgcagatgtgaaggagtatgagcgggagaatgtggacacctttgaggcctctgtgaaggccaagcacaacctgatgacagtggagcagaacaacggcagcagccagaagaagctgctggccccagacatgttcacagaaagtgatgacatgtttgctgcctactttgacagcgcccggctgcgggccgccggcatcggcaaggacttcaaggagaaccccaacctgcgggacaactggacagatgctgagggctactacagagtgaacattggagaggtgctggacaagcgctacaacgtgtatggctacacaggccagggcgtcttcagcaatgtggtgcgggcccgggacaatgcccgggccaaccaggaggtggccgtgaagatcatccggaacaatgagctgatgcagaagacaggcctgaaggagctggagttcctgaagaagctgaatgatgctgaccctgatgacaagttccactgcctgcggctcttccgccacttctaccacaagcagcacctgtgcctggtgtttgagcccctgtccatgaacctgcgggaggtgctgaagaagtatggcaaggatgtgggcctgcacatcaaggctgtgcgcagctacagccagcagctgttcctggccctgaagctgctgaagcgctgcaacatcctgcacgccgacatcaagccagacaacatcctggtgaatgaaagcaagaccatcctgaagctgtgtgactttggaagtgccagccacgtggccgacaatgacatcaccccctacctggtgagccgcttctaccgggcccctgagatcatcatcggcaagagctatgactatggcatcgacatgtggagcgtgggctgcaccctgtatgagctgtacaccgggaagatcctcttccctgggaagaccaacaaccacatgctgaagctggccatggacctgaagggcaagatgcccaacaagatgatcagaaaaggagtcttcaaggaccagcactttgaccagaacctgaacttcatgtacatcgaggtggacaaggtgacagagcgggagaaggtgacagtgatgagcaccatcaaccccaccaaggacctgctggccgacctgattggctgccagaggctgcctgaggaccagaggaagaaggtgcaccagctgaaggacctgctggaccagatcctgatgctggaccctgccaagaggatcagcatcaaccaggccctgcagcacgccttcatccaggagaagatctag

SEQ ID NO: 166604 - DNA, 2820 bp, Artificial Sequence
  Description of Artificial Sequence: Synthetic coding sequence
atgaggcctggcactggagctgagcggggcggcctgatggtgtctgagatggagagccacccccccagccagggccctggagatggagagcggcggctgagcggcagcagcctgtgcagcggctcctgggtgtctgcagatggcttcctgcggcggcggcccagcatgggccaccctggcatgcactacgcccccatgggcatgcaccccatgggccagagggccaacatgcctcctgtgccccacggcatgatgccccagatgatgccacccatgggcggcccccccatgggccagatgcctggcatgatgagctctgtgatgcctggcatgatgatgagccacatgagccaggcctccatgcagcctgccctgcccccaggagtgaacagcatggatgtggccgccggcacctacaccctgtacaagtccatgtggacagagcacaagagcccagatggccgcacctactactacaacacagagaccaagcagagcacctgggagaagccagatgacctgaagaccccagctgagcagctgctgagcaagtgcccctggaaggagtacaagagtgacagcggcaagccctactactacaacagccagaccaaggagagccgctgggccaagcccaaggagctggaggacctggagggcaagatgggcaagatcaagtacagcaagcaggaggagtgcaccaccaccagcacagcccctgtgcccaccacagagatccccaccaccatgagcaccatggctgctgctgaggccgctgctgctgtggtggccgctgctgctgctgctgctgctgctgctgctgctgccaatgccaatgccagcaccagcgccagcaacacagtgtctggaacagtgcctgtggtgcctgagcctgaggtgaccagcatcgtggccaccgtggtggacaatgaaaatacagtgaccatcagcacagaggagcaggcccagctgaccagcaccccagccatccaggaccagagcgtggaggtgagcagcaacacaggagaggagaccagcaagcaggagaccgtggccgacttcacccccaagaaggaggaggaggagagccagcctgccaagaagacctacacctggaacaccaaggaggaggccaagcaggccttcaaggagctgctgaaggagaagagggtgcccagcaatgcctcctgggagcaggccatgaagatgatcatcaatgacccccgctacagcgccctggccaagctgtctgagaagaagcaggccttcaatgcctacaaggtgcagacagagaaggaggagaaggaggaggcccggagcaagtacaaggaggccaaggagagcttccagcgcttcctggagaaccacgagaagatgaccagcaccacccgctacaagaaggccgagcagatgtttggagagatggaggtgtggaatgccatcagcgagcgggaccggctggagatctatgaagatgtgctcttcttcctgagcaagaaggagaaggagcaggccaagcagctgaggaagaggaactgggaggccctgaagaacatcctggacaacatggccaacgtgacctacagcaccacctggagcgaggcccagcagtacctgatggacaaccccacctttgctgaagatgaggagctgcagaacatggacaaggaggatgccctgatctgctttgaggagcacatccgggccctggagaaggaggaggaggaggagaagcagaagagcctgctgcgggagcggcggcggcagaggaagaaccgggagagcttccagatcttcctggatgagctgcacgagcacggccagctgcacagcatgagctcctggatggagctgtaccccaccatcagcagtgacatccgcttcaccaacatgctgggccagcccggcagcacagccctggacctcttcaagttctacgtggaggacctgaaggcccgctaccatgatgagaagaagatcatcaaggacatcctgaaggacaagggctttgtggtggaggtgaacaccacctttgaagattttgtggccatcatcagcagcaccaagaggagcaccaccctggatgctggcaacatcaagctggccttcaacagcctgctggagaaggccgaggcccgggagcgggagcgggagaaggaggaggccaggaagatgaagaggaaggagagcgccttcaagtccatgctgaagcaggccgccccacccatcgagctggatgctgtgtgggaggacatccgggagagatttgtgaaggagcccgcctttgaggacatcaccctggagagcgagaggaagaggatcttcaaggacttcatgcacgtgctggagcacgagtgccagcaccaccacagcaagaacaagaagcacagcaagaagagcaagaagcaccacaggaagaggagccgcagccgcagcggcagtgacagtgatgatgatgacagccacagcaagaagaagaggcagaggtctgagagccgcagcgccagcgagcacagcagcagcgctgagagcgagaggagctacaagaagagcaagaagcacaagaagaagagcaagaagagaagacacaagagtgacagccctgagagtgatgctgagcgggagaaggacaagaaggagaaggaccgggagagcgagaaggacaggacccggcagaggtctgagagcaagcacaagagccccaagaagaagacaggcaaggacagcggcaactgggacaccagcggcagcgagctgtctgagggggagctggagaagagaagaaggaccctgctggagcagctggatgatgaccagtag

SEQ ID NO: 166605 - DNA, 2451 bp, Artificial Sequence
  Description of Artificial Sequence: Synthetic coding sequence
atgtgcagcggcagcggcagaagaagaagcagcctgagccccaccatgaggcctggcaccggggctgagcggggcggcctgatgatgggccaccctggcatgcactacgcccccatgggcatgcaccccatgggccagagggccaacatgcctcctgtgccccacggcatgatgccccagatgatgccacccatgggcggcccccccatgggccagatgcctggcatgatgagctctgtgatgcctggcatgatgatgagccacatgagccaggcctccatgcagcctgccctgccccagctgctgagcaagtgcccctggaaggagtacaagagtgacagcggcaagccctactactacaacagccagaccaaggagagccgctgggccaagcccaaggagctggaggacctggagggctaccagaacaccatcgtggccggcagcctcatcaccaagagcaacctgcacggcatgctgacagagctgaagtacagcaagcaggaggagtgcaccaccaccagcacagcccctgtgcccaccacagagatccccaccaccatgagcaccatggctgctgctgaggccgctgctgctgtggtggccgctgctgctgctgctgctgctgctgctgctgctgccaatgccaatgccagcaccagcgccagcaacacagtgtctggaacagtgcctgtggtgcctgagcctgaggtgaccagcatcgtggccaccgtggtggacaatgaaaatacagtgaccatcagcacagaggagcaggcccagctgaccagcaccccagccatccaggaccagagcgtggaggtgagcagcaacacaggagaggagaccagcaagcaggagaccgtggccgacttcacccccaagaaggaggaggaggagagccagcctgccaagaagacctacacctggaacaccaaggaggaggccaagcaggccttcaaggagctgctgaaggagaagagggtgcccagcaatgcctcctgggagcaggccatgaagatgatcatcaatgacccccgctacagcgccctggccaagctgtctgagaagaagcaggccttcaatgcctacaaggtgcagacagagaaggaggagaaggaggaggcccggagcaagtacaaggaggccaaggagagcttccagcgcttcctggagaaccacgagaagatgaccagcaccacccgctacaagaaggccgagcagatgtttggagagatggaggtgtggaatgccatcagcgagcgggaccggctggagatctatgaagatgtgctcttcttcctgagcaagaaggagaaggagcaggccaagcagctgaggaagaggaactgggaggccctgaagaacatcctggacaacatggccaacgtgacctacagcaccacctggagcgaggcccagcagtacctgatggacaaccccacctttgctgaagatgaggagctgcagaacatggacaaggaggatgccctgatctgctttgaggagcacatccgggccctggagaaggaggaggaggaggagaagcagaagagcctgctgcgggagcggcggcggcagaggaagaaccgggagagcttccagatcttcctggatgagctgcacgagcacggccagctgcacagcatgagctcctggatggagctgtaccccaccatcagcagtgacatccgcttcaccaacatgctgggccagcctgtgttcagcctgggcagcacagccctggacctcttcaagttctacgtggaggacctgaaggcccgctaccatgatgagaagaagatcatcaaggacatcctgaaggacaagggctttgtggtggaggtgaacaccacctttgaagattttgtggccatcatcagcagcaccaagaggagcaccaccctggatgctggcaacatcaagctggccttcaacagcctgctggagaaggccgaggcccgggagcgggagcgggagaaggaggaggccaggaagatgaagaggaaggagagcgccttcaagtccatgctgaagcaggccgccccacccatcgagctggatgctgtgtgggaggacatccgggagagatttgtgaaggagcccgcctttgaggacatcaccctggagagcgagaggaagaggatcttcaaggacttcatgcacgtgctggagcacgagtgccagcaccaccacagcaagaacaagaagcacagcaagaagagcaagaagcaccacaggaagaggagccgcagccgcagcggcagtgacagtgatgatgatgacagccacagcaagaagaagaggcagaggtctgagagccgcagcgccagcgagcacagcagcagcgctgagagcgagaggagctacaagaagagcaagaagcacaagaagaagagcaagaagagaagacacaagagtgacagccctgagagtgatgctgagaggtag

SEQ ID NO: 166606 - DNA, 2793 bp, Artificial Sequence
  Description of Artificial Sequence: Synthetic coding sequence
atgtgcagcggcagcggcagaagaagaagcagcctgagccccaccatgaggcctggcaccggggctgagcggggcggcctgatgatgggccaccctggcatgcactacgcccccatgggcatgcaccccatgggccagagggccaacatgcctcctgtgccccacggcatgatgccccagatgatgccacccatgggcggcccccccatgggccagatgcctggcatgatgagctctgtgatgcctggcatgatgatgagccacatgagccaggcctccatgcagcctgccctgcccccaggagtgaacagcatggatgtggccgccggcacagccagcggggccaagtccatgtggacagagcacaagagcccagatggccgcacctactactacaacacagagaccaagcagagcacctgggagaagccagatgacctgaagaccccagctgagcagctgctgagcaaatgtccctggaaggagtacaagagtgacagcggcaagccctactactacaacagccagaccaaggagagccgctgggccaagcccaaggagctggaggacctggagggctaccagaacaccatcgtggccggcagcctcatcaccaagagcaacctgcacgccatgatcaaggccgaggagagcagcaagcaggaggagtgcaccaccaccagcacagcccctgtgcccaccacagagatccccaccaccatgagcaccatggctgctgctgaggccgctgctgctgtggtggccgctgctgctgctgctgctgctgctgctgctgctgccaatgccaatgccagcaccagcgccagcaacacagtgtctggcaccgtgcctgtggtgcctgagcctgaggtgaccagcatcgtggccaccgtggtggacaatgaaaatacagtgaccatcagcacagaggagcaggcccagctgaccagcaccccagccatccaggaccagagcgtggaggtgagcagcaacacaggagaggagaccagcaagcaggagaccgtggccgacttcacccccaagaaggaggaggaggagagccagcctgccaagaagacctacacctggaacaccaaggaggaggccaagcaggccttcaaggagctgctgaaggagaagagggtgcccagcaatgcctcctgggagcaggccatgaagatgatcatcaatgacccccgctacagcgccctggccaagctgtctgagaagaagcaggccttcaatgcctacaaggtgcagacagagaaggaggagaaggaggaggcccggagcaagtacaaggaggccaaggagagcttccagcgcttcctggagaaccacgagaagatgaccagcaccacccgctacaagaaggccgagcagatgtttggagagatggaggtgtggaatgccatcagcgagcgggaccggctggagatctatgaagatgtgctcttcttcctgagcaagaaggagaaggagcaggccaagcagctgaggaagaggaactgggaggccctgaagaacatcctggacaacatggccaacgtgacctacagcaccacctggagcgaggcccagcagtacctgatggacaaccccacctttgctgaagatgaggagctgcagaacatggacaaggaggatgccctgatctgctttgaggagcacatccgggccctggagaaggaggaggaggaggagaagcagaagagcctgctgcgggagcggcggcggcagaggaagaaccgggagagcttccagatcttcctggatgagctgcatgaacatggccagctgcacagcatgagctcctggatggagctgtaccccaccatcagcagtgacatccgcttcaccaacatgctgggccagcccggcagcacagccctggacctcttcaagttctacgtggaggacctgaaggcccgctaccatgatgagaagaagatcatcaaggacatcctgaaggacaagggctttgtggtggaggtgaacaccacctttgaggactttgtggccatcatcagcagcaccaagaggagcaccaccctggatgctggcaacatcaagctggccttcaacagcctgctggagaaggccgaggcccgggagcgggagcgggagaaggaggaggccaggaagatgaagaggaaggagagcgccttcaagtccatgctgaagcaggccgccccacccatcgagctggatgctgtgtgggaggacatccgggagagatttgtgaaggagcccgcctttgaggacatcaccctggagagcgagaggaagaggatcttcaaggacttcatgcacgtgctggagcacgagtgccagcaccaccacagcaagaacaagaagcacagcaagaagagcaagaagcaccacaggaagaggagccgcagccgcagcggcagtgacagtgatgatgatgacagccacagcaagaagaagaggcagaggtctgagagccgcagcgccagcgagcacagcagcagcgctgagagcgagaggagctacaagaagagcaagaagcacaagaagaagagcaagaagaggaggcacaagagtgacagccctgagagtgatgctgagcgggagaaggacaagaaggagaaggaccgggagagcgagaaggacaggacccggcagaggtctgagagcaagcacaagagccccaagaagaagacaggcaaggacagcggcaactgggacaccagcggcagcgagctgtctgagggggagctggagaagagaagaaggaccctgctggagcagctggatgatgaccagtag

SEQ ID NO: 166607 - DNA, 2481 bp, Artificial Sequence
  Description of Artificial Sequence: Synthetic coding sequence
atggatgtggccgccggcacagccagcggggccaagtccatgtggacagagcacaagagcccagatggccgcacctactactacaacacagagaccaagcagagcacctgggagaagccagatgacctgaagaccccagctgagcagctgctgagcaaatgtccctggaaggagtacaagagtgacagcggcaagccctactactacaacagccagaccaaggagagccgctgggccaagcccaaggagctggaggacctggagggctaccagaacaccatcgtggccggcagcctcatcaccaagagcaacctgcacggcatgctgacagagctgaagtacagcaagcaggaggagtgcaccaccaccagcacagcccctgtgcccaccacagagatccccaccaccatgagcaccatggctgctgctgaggccgctgctgctgtggtggccgctgctgctgctgctgctgctgctgctgctgctgccaatgccaatgccagcaccagcgccagcaacacagtgtctggcaccgtgcctgtggtgcctgagcctgaggtgaccagcatcgtggccaccgtggtggacaatgaaaatacagtgaccatcagcacagaggagcaggcccagctgaccagcaccccagccatccaggaccagagcgtggaggtgagcagcaacacaggagaggagaccagcaagcaggagaccgtggccgacttcacccccaagaaggaggaggaggagagccagcctgccaagaagacctacacctggaacaccaaggaggaggccaagcaggccttcaaggagctgctgaaggagaagagggtgcccagcaatgcctcctgggagcaggccatgaagatgatcatcaatgacccccgctacagcgccctggccaagctgtctgagaagaagcaggccttcaatgcctacaaggtgcagacagagaaggaggagaaggaggaggcccggagcaagtacaaggaggccaaggagagcttccagcgcttcctggagaaccacgagaagatgaccagcaccacccgctacaagaaggccgagcagatgtttggagagatggaggtgtggaatgccatcagcgagcgggaccggctggagatctatgaagatgtgctcttcttcctgagcaagaaggagaaggagcaggccaagcagctgaggaagaggaactgggaggccctgaagaacatcctggacaacatggccaacgtgacctacagcaccacctggagcgaggcccagcagtacctgatggacaaccccacctttgctgaagatgaggagctgcagaacatggacaaggaggatgccctgatctgctttgaggagcacatccgggccctggagaaggaggaggaggaggagaagcagaagagcctgctgcgggagcggcggcggcagaggaagaaccgggagagcttccagatcttcctggatgagctgcatgaacatggccagctgcacagcatgagctcctggatggagctgtaccccaccatcagcagtgacatccgcttcaccaacatgctgggccagcccggcagcacagccctggacctcttcaagttctacgtggaggacctgaaggcccgctaccatgatgagaagaagatcatcaaggacatcctgaaggacaagggctttgtggtggaggtgaacaccacctttgaggactttgtggccatcatcagcagcaccaagaggagcaccaccctggatgctggcaacatcaagctggccttcaacagcctgctggagaaggccgaggcccgggagcgggagcgggagaaggaggaggccaggaagatgaagaggaaggagagcgccttcaagtccatgctgaagcaggccgccccacccatcgagctggatgctgtgtgggaggacatccgggagagatttgtgaaggagcccgcctttgaggacatcaccctggagagcgagaggaagaggatcttcaaggacttcatgcacgtgctggagcacgagtgccagcaccaccacagcaagaacaagaagcacagcaagaagagcaagaagcaccacaggaagaggagccgcagccgcagcggcagtgacagtgatgatgatgacagccacagcaagaagaagaggcagaggtctgagagccgcagcgccagcgagcacagcagcagcgctgagagcgagaggagctacaagaagagcaagaagcacaagaagaagagcaagaagaggaggcacaagagtgacagccctgagagtgatgctgagcgggagaaggacaagaaggagaaggaccgggagagcgagaaggacaggacccggcagaggtctgagagcaagcacaagagccccaagaagaagacaggcaaggacagcggcaactgggacaccagcggcagcgagctgtctgagggggagctggagaagagaagaaggaccctgctggagcagctggatgatgaccagtag

SEQ ID NO: 166608 - DNA, 1347 bp, Artificial Sequence
  Description of Artificial Sequence: Synthetic coding sequence
atgaggcctggcactggagctgagcggggcggcctgatggtgtctgagatggagagccacccccccagccagggccctggagatggagagcggcggctgagcggcagcagcctgtgcagcggctcctgggtgtctgcagatggcttcctgcggcggcggcccagcatgggccaccctggcatgcactacgcccccatgggcatgcaccccatgggccagagggccaacatgcctcctgtgccccacggcatgatgccccagatgatgccacccatgggcggcccccccatgggccagatgcctggcatgatgagctctgtgatgcctggcatgatgatgagccacatgagccaggcctccatgcagcctgccctgcccccaggagtgaacagcatggatgtggccgccggcacagccagcggggccaagtccatgtggacagagcacaagagcccagatggccgcacctactactacaacacagagaccaagcagagcacctgggagaagccagatgacctgaagaccccagctgagcagctgctgagcaagtgcccctggaaggagtacaagagtgacagcggcaagccctactactacaacagccagaccaaggagagccgctgggccaagcccaaggagctggaggacctggagggctaccagaacaccatcgtggccggcagcctcatcaccaagagcaacctgcacgccatgatcaaggccgaggagagcagcaagcaggaggagtgcaccaccaccagcacagcccctgtgcccaccacagagatccccaccaccatgagcaccatggctgctgctgaggccgctgctgctgtggtggccgctgctgctgctgctgctgctgctgctgctgctgccaatgccaatgccagcaccagcgccagcaacacagtgtctggaacagtgcctgtggtgcctgagcctgaggtgaccagcatcgtggccaccgtggtggacaatgaaaatacagtgaccatcagcacagaggagcaggcccagctgaccagcaccccagccatccaggaccagagcgtggaggtgagcagcaacacaggagaggagaccagcaagcaggagaccgtggccgacttcacccccaagaaggaggaggaggagagccagcctgccaagaagacctacacctggaacaccaaggaggaggccaagcaggccttcaaggagctgctgaaggagaagagggtgcccagcaatgcctcctgggagcaggccatgaagatgatcatcaatgacccccgctacagcgccctggccaagctgtctgagaagaagcaggccttcaatgcctacaaggtgcagacctag

SEQ ID NO: 166609 - DNA, 2826 bp, Artificial Sequence
  Description of Artificial Sequence: Synthetic coding sequence
atgaacaagaagaagaagcccttcctgggcatgcctgcccccctgggctacgtgcccggcctgggccgcggggccaccggcttcaccaccaggagtgacatcggccctgccagagatgccaatgaccctgtggatgacagacatgcccctcctgggaagaggacagtgggggaccagatgaagaagaaccaggccgcagatgatgatgatgaggacctgaatgacaccaactatgatgagttcaacggctacgccggcagcctcttcagcagcggcccctatgagaaggatgatgaggaggctgatgccatctatgctgccctggacaagaggatggatgaaagaaggaaggagcggcgggagcagcgggagaaggaggagattgagaagtacaggatggagcggcccaagatccagcagcagttcagtgacctgaagaggaagctggccgaggtgacagaggaggagtggctgagcatccctgaggtgggagatgccaggaacaagaggcagaggaaccccaggtatgagaagctgacccctgtgcctgacagcttctttgccaagcacctgcagacaggagagaaccacacctctgtggacccccggcagacccagtttggaggcctgaacaccccctacccaggcggcctgaacaccccctacccaggcggcatgaccccaggcctgatgaccccaggcactggagagctggacatgaggaagattggccaggccaggaacaccctgatggacatgaggctgagccaggtgtctgattctgtgtctggccagacagtggtggaccccaagggctacctgacagacctgaacagcatgatccccacccacggcggggacatcaatgacatcaagaaggcccggctgctgctgaagtctgtgcgggagaccaacccccaccaccccccagcctggatcgccagcgcccggctggaggaggtgacaggcaagctgcaggtggccaggaacctgatcatgaagggcacagagatgtgccccaagtcagaagatgtgtggctggaggccgcccggctgcagcccggggacacagccaaggctgtggtggcccaggccgtgcgccacctgccccagagcgtgcgcatctacatccgggctgctgagctggagacagacatccgggccaagaagagggtgctgaggaaggccctggagcacgtgcccaacagcgtgcggctgtggaaggctgctgtggagctggaggagccagaagatgcccgcatcatgctgagcagagctgtggagtgctgccccacctctgtggagctgtggctggccctggcccggctggagacctatgaaaatgccaggaaggtgctgaacaaggcccgggagaacatccccacagacagacacatctggatcacagctgccaagctggaggaggccaatggaaacacccagatggtggagaagatcatcgaccgggccatcaccagcctgcgggccaatggagtggagatcaaccgggagcagtggatccaggatgctgaggagtgtgaccgggccggctctgtggccacctgccaggccgtgatgagagctgtgattggcatcggcatcgaggaggaggacaggaagcacacctggatggaggatgctgacagctgtgtggcccacaatgccctggagtgtgcccgggccatctatgcctatgccctgcaggtgttccccagcaagaagtctgtgtggctgcgggccgcctactttgagaagaaccacggcacccgggagagcctggaggccctgctgcagagagctgtggcccactgccccaaggccgaggtgctgtggctgatgggcgccaagagcaagtggctggccggagatgtgcctgctgcccggagcatcctggccctggccttccaggccaaccccaacagcgaggagatctggctggccgctgtgaagctggagagtgaaaatgatgaatatgaaagagcccggcggctgctggccaaggcccggagcagcgcccccacagcccgggtcttcatgaagtctgtgaagctggagtgggtgcaggacaacatccgggccgcccaggacctgtgtgaggaggccctgcggcactatgaggacttccccaagctgtggatgatgaagggccagatcgaggagcagaaggagatgatggagaaggcccgggaggcctacaaccagggcctgaagaagtgcccccacagcacccccctgtggctgctgctgagccggctggaggagaagattggccagctgacccgggcccgggccatcctggagaagagccggctgaagaaccccaagaaccctggcctgtggctggagagcgtgcggctggagtaccgggccggcctgaagaacatcgccaacaccctgatggccaaggccctgcaggagtgccccaacagcggcatcctgtggagcgaggccatcttcctggaggcccggccccagaggaggaccaagtctgtggatgccctgaagaagtgtgaacatgacccccacgtgctgctggccgtggccaagctgttctggagccagaggaagatcaccaaggcccgggagtggttccacaggacagtgaagattgacagcgacctgggagatgcctgggccttcttctacaagtttgagctgcagcacggcacagaggagcagcaggaggaggtgaggaagagatgtgagagcgctgagcccaggcatggagagctgtggtgtgctgtgtccaaggacatcgccaactggcagaagaagatcggggacatcctgcggctggtggccggccgcatcaagaacaccttctag

SEQ ID NO: 166610 - DNA, 2706 bp, Artificial Sequence
  Description of Artificial Sequence: Synthetic coding sequence
atgaacaagaagaagaagcccttcctgggcatgcctgcccccctgggctacgtgcccggcctgggccgcggggccaccggcttcaccaccaggagtgacatcggccctgccagagatgccaatgaccctgtggatgacagacatgcccctcctgggaagaggacagtgggggaccagatgaagaagaaccaggccgcagatgatgatgatgaggacctgaatgacaccaactatgatgagttcaacggctacgccggcagcctcttcagcagcggcccctatgagaaggatgatgaggaggctgatgccatctatgctgccctggacaagaggatggatgaaagaaggaaggagcggcgggagcagcgggagaaggaggagattgagaagtacaggatggagcggcccaagatccagcagcagttcagtgacctgaagaggaagctggccgaggtgacagaggaggagtggctgagcatccctgaggtgggagatgccaggaacaagaggcagaggaaccccaggtatgagaagctgacccctgtgcctgacagcttctttgccaagcacctgcagacaggagagaaccacacctctgtggacccccggcagacccagtttggaggcctgaacaccccctacccaggcggcctgaacaccccctacccaggcggcatgaccccaggcctgatgaccccaggcactggagagctggacatgaggaagattggccaggccaggaacaccctgatggacatgaggctgagccaggtgtctgattctgtgtctggccagacagtggtggaccccaagggctacctgacagacctgaacagcatgatccccacccacggcggggacatcaatgacatcaagaaggcccggctgctgctgaagtctgtgcgggagaccaacccccaccaccccccagcctggatcgccagcgcccggctggaggaggtgacaggcaagctgcaggtggccaggaacctgatcatgaagggcacagagatgtgccccaagtcagaagatgtgtggctggaggccgcccggctgcagcccggggacacagccaaggctgtggtggcccaggccgtgcgccacctgccccagagcgtgcgcatctacatccgggctgctgagctggagacagacatccgggccaagaagagggtgctgaggaaggccctggagcacgtgcccaacagcgtgcggctgtggaaggctgctgtggagctggaggagccagaagatgcccgcatcatgctgagcagagctgtggagtgctgccccacctctgtggagctgtggctggccctggcccggctggagacctatgaaaatgccaggaaggtgctgaacaaggcccgggagaacatccccacagacagacacatctggatcacagctgccaagctggaggaggccaatggaaacacccagatggtggagaagatcatcgaccgggccatcaccagcctgcgggccaatggagtggagatcaaccgggagcagtggatccaggatgctgaggagtgtgaccgggccggctctgtggccacctgccaggccgtgatgagagctgtgattggcatcggcatcgaggaggaggacaggaagcacacctggatggaggatgctgacagctgtgtggcccacaatgccctggagtgtgcccgggccatctatgcctatgccctgcaggtgttccccagcaagaagtctgtgtggctgcgggccgcctactttgagaagaaccacggcacccgggagagcctggaggccctgctgcagagagctgtggcccactgccccaaggccgaggtgctgtggctgatgggcgccaagagcaagtggctggccggagatgtgcctgctgcccggagcatcctggccctggccttccaggtgttcatgaagtctgtgaagctggagtgggtgcaggacaacatccgggccgcccaggacctgtgtgaggaggccctgcggcactatgaggacttccccaagctgtggatgatgaagggccagatcgaggagcagaaggagatgatggagaaggcccgggaggcctacaaccagggcctgaagaagtgcccccacagcacccccctgtggctgctgctgagccggctggaggagaagattggccagctgacccgggcccgggccatcctggagaagagccggctgaagaaccccaagaaccctggcctgtggctggagagcgtgcggctggagtaccgggccggcctgaagaacatcgccaacaccctgatggccaaggccctgcaggagtgccccaacagcggcatcctgtggagcgaggccatcttcctggaggcccggccccagaggaggaccaagtctgtggatgccctgaagaagtgtgaacatgacccccacgtgctgctggccgtggccaagctgttctggagccagaggaagatcaccaaggcccgggagtggttccacaggacagtgaagattgacagcgacctgggagatgcctgggccttcttctacaagtttgagctgcagcacggcacagaggagcagcaggaggaggtgaggaagagatgtgagagcgctgagcccaggcatggagagctgtggtgtgctgtgtccaaggacatcgccaactggcagaagaagatcggggacatcctgcggctggtggccggccgcatcaagaacaccttctag

SEQ ID NO: 166611 - DNA, 7008 bp, Artificial Sequence
  Description of Artificial Sequence: Synthetic coding sequence
atggccggggtcttcccctaccggggccctggcaaccctgtgcccggccccctggcccccctgcctgactacatgtctgaggagaagctgcaggagaaggccaggaagtggcagcagctgcaggccaagagatatgcagagaagaggaagtttggatttgtggatgcccagaaggaggacatgcctcctgagcacgtgaggaagatcatccgggaccatggagacatgaccaacaggaagttcagacatgacaagagggtgtacctgggcgccctgaagtacatgcctcatgctgtgctgaagctgctggagaacatgcccatgccctgggagcagatcagagatgtgcctgtgctgtaccacatcactggagccatcagctttgtgaatgagatcccctgggtgattgagcctgtgtacatcagccagtggggctccatgtggatcatgatgaggcgggagaagagggaccggcggcacttcaagaggatgagatttcctccatttgatgatgaggagccccccctggactatgctgacaacatcctggatgtggagcccctggaggccatccagctggagctggaccctgaagaagatgcccctgtgctggactggttctatgaccaccagcccctgcgggacagcaggaaatatgtgaatggcagcacctaccagcgctggcagttcaccctgcccatgatgagcaccctgtaccgcctggccaaccagctgctgacagacctggtggatgacaactacttctacctgtttgacctgaaggccttcttcaccagcaaggccctgaacatggccatccctgggggccccaagtttgagcccctggtgcgggacatcaacctgcaggatgaggactggaatgagttcaatgacatcaacaagatcatcatccggcagcccatcagaacagagtacaagatcgccttcccctacctgtacaacaacctgccccaccacgtgcacctgacctggtaccacacccccaacgtggtgttcatcaagacagaagatcctgacctgcctgccttctactttgaccccctcatcaaccccatcagccaccgccacagcgtgaagagccaggagcccctgcctgatgatgatgaggagtttgagctgcctgagtttgtggagcccttcctgaaggacacccccctgtacacagacaacacagccaacggcatcgccctgctgtgggccccccggcccttcaacctgcggagcggccgcacccggcgggccctggacatccccctggtgaagaactggtaccgggagcactgcccagctggccagcctgtgaaggtgcgggtgtcctaccagaagctgctgaagtactacgtgctgaatgccctgaagcacaggcctcccaaggcccagaagaagcgctacctgttccgctccttcaaggccaccaagttcttccagagcaccaagctggactgggtggaggtgggcctgcaggtgtgccggcagggctacaacatgctgaacctgctgatccacaggaagaacctgaactacctgcacctggactacaacttcaacctgaagcctgtgaagaccctgaccaccaaggagaggaagaagagcagatttggaaatgccttccacctgtgccgggaggtgctgcggctgaccaagctggtggtggacagccacgtgcagtaccgcctgggcaatgtggatgccttccagctggctgatggcctgcagtacatctttgcccacgtgggccagctgaccggcatgtaccgctacaagtacaagctgatgaggcagatccgcatgtgcaaggacctgaagcacctgatctactaccgcttcaacacaggccctgtgggcaaaggacctggctgcggcttctgggccgccggctggagggtgtggctgttcttcatgaggggcatcacccccctgctggagcgctggctgggcaacctgctggcccggcagtttgagggccgccacagcaagggcgtggccaagacagtgaccaagcagagggtggagagccactttgacctggagctgcgggctgctgtgatgcatgacatcctggacatgatgcctgagggcatcaagcagaacaaggcccggaccatcctgcagcacctgtctgaggcctggcgctgctggaaggccaacatcccctggaaggtgcccggcctgcccacccccatcgagaacatgatcctgcgctacgtgaaggccaaggctgactggtggaccaacacagcccactacaaccgggagcgcatccggcggggggccaccgtggacaagacagtgtgcaagaagaacctgggccgcctgacccggctgtacctgaaggccgagcaggagcggcagcacaactacctgaaggatggcccctacatcacagctgaggaggccgtggccgtgtacaccaccaccgtgcactggctggagagccgccgcttcagccccatccccttcccccccctgagctacaagcatgacaccaagctgctgatcctggccctggagcggctgaaggaggcctacagcgtgaagagccggctgaaccagagccagcgggaggagctgggcctgattgagcaggcctatgacaacccccatgaggccctgagccgcatcaagaggcacctgctgacccagagggccttcaaggaggtgggcatcgagttcatggacctgtacagccacctggtgcctgtgtatgatgtggagcccctggagaagatcacagatgcctacctggaccagtacctgtggtatgaggccgacaagagaagactcttccccccctggatcaagccagctgacacagagcccccacccctgctggtgtacaagtggtgccagggcatcaacaacctgcaggatgtgtgggagaccagcgagggggagtgcaatgtgatgctggagagcagatttgagaagatgtatgagaagattgacctgaccctgctgaaccggctgctgcggctcatcgtggaccacaacattgctgactacatgacagccaagaacaacgtggtgatcaactacaaggacatgaaccacaccaacagctatggcatcatccggggcctgcagtttgccagcttcatcgtgcagtactacggcctggtgatggacctgctggtgctgggcctgcaccgggccagcgagatggccggccccccccagatgcccaatgacttcctgtccttccaggacatcgccacagaagctgcccaccccatccgcctcttctgccgctacatcgaccgcatccacatcttcttccgcttcaccgcagatgaggcccgggacctgatccagcgctacctgacagagcacccagaccccaacaatgaaaatattgtgggctacaacaacaagaagtgctggcccagagatgccaggatgaggctgatgaagcatgatgtgaacctgggccgggctgtgttctgggacatcaagaaccggctgcccaggtctgtgaccaccgtgcagtgggagaacagctttgtgtctgtgtacagcaaggacaaccccaacctgctcttcaacatgtgtggctttgaatgtcgcatcctgcccaagtgcaggaccagctatgaggagttcacccacaaggatggagtgtggaacctgcagaatgaggtgaccaaggagaggacagcccagtgcttcctgcgggtggatgatgagagcatgcagcgcttccacaacagagtgcggcagatcctgatggccagcggcagcaccaccttcaccaagatcgtgaacaagtggaacacagccctgattggcctgatgacctacttccgggaggccgtggtgaacacccaggagctgctggacctgctggtgaagtgtgagaacaagatccagacccgcatcaagattggcctgaacagcaagatgcccagccgcttcccccctgtggtgttctacacccccaaggagctgggcggcctgggcatgctgtccatgggccacgtgctgatcccccagagcgacctgcgctggagcaagcagacagatgtgggcatcacccacttccgcagcggcatgagccatgaggaggaccagctgatccccaacctgtaccgctacatccagccctgggagagcgagttcatcgacagccagagggtgtgggccgagtatgccctgaagaggcaggaggccatcgcccagaacagaaggctgaccctggaggacctggaggacagctgggaccggggcatcccccgcatcaacaccctcttccagaaggacagacacaccctggcctatgacaagggctggagggtgaggacagacttcaagcagtaccaggtgctgaagcagaaccccttctggtggacccaccagagacatgatggcaagctgtggaacctgaacaactacagaacagacatgatccaggccctgggcggcgtggagggcatcctggagcacaccctcttcaagggcacctacttccccacctgggagggcctcttctgggagaaggccagcggctttgaggagagcatgaagtggaagaagctgaccaatgcccagaggagcggcctgaaccagatccccaacagacgcttcaccctgtggtggagccccaccatcaacagagccaacgtgtatgtgggcttccaggtgcagctggacctgaccggcatcttcatgcacggcaagatccccaccctgaagatcagcctcatccagatcttccgggcccacctgtggcagaagatccacgagagcatcgtgatggacctgtgccaggtgtttgaccaggagctggatgccctggagattgagaccgtgcagaaggagaccatccaccccaggaagagctacaagatgaacagcagctgtgccgacatcctgctgtttgccagctacaagtggaatgtgtcccggcccagcctgctggccgacagcaaggatgtgatggacagcaccaccacccagaagtactggattgacatccagctgcgctggggagactatgacagccatgacatcgagagatatgcccgggccaagttcctggactacaccacagacaacatgagcatctaccccagccccactggagtgctgattgccatcgacctggcctacaacctgcacagcgcctacggcaactggttccctggcagcaagcccctcatccagcaggccatggccaagatcatgaaggccaacccagccctgtatgtgctgcgggagcgcatcaggaagggcctgcagctgtacagcagcgagcccacagagccctacctgagcagccagaactacggggagctgttcagcaaccagatcatctggtttgtggatgacaccaacgtgtacagagtgaccatccacaagacctttgagggcaacctgaccaccaagcccatcaacggggccatcttcatcttcaaccccaggacaggccagctgttcctgaagatcatccacacctctgtgtgggccggccagaagaggctgggccagctggccaagtggaagacagctgaggaggtggccgccctgatccgcagcctgcctgtggaggagcagcccaagcagatcatcgtgaccaggaagggcatgctggaccccctggaggtgcacctgctggacttccccaacatcgtcatcaagggcagcgagctgcagctgcccttccaggcctgcctgaaggtggagaagtttggagacctgatcctgaaggccacagagccccagatggtgctcttcaacctgtatgatgactggctgaagaccatcagcagctacacagccttcagccgcctcatcctgatcctgcgggccctgcacgtgaacaatgaccgggccaaggtgatcctgaagccagacaagaccaccatcacagagccccaccacatctggcccaccctgacagatgaggagtggatcaaggtggaggtgcagctgaaggacctgatcctggccgactatggcaagaagaacaacgtgaatgtggccagcctgacccagagcgagatccgggacatcatcctgggcatggagatcagcgcccccagccagcagaggcagcagattgctgagattgagaagcagaccaaggagcagagccagctgacagccacccagaccaggacagtgaacaagcatggagatgagatcatcaccagcaccaccagcaactatgagacccagaccttcagcagcaagacagagtggagggtgcgggccatctctgctgccaacctgcacctgcggaccaaccacatctacgtgtccagtgatgacatcaaggagaccggctacacctacatcctgcccaagaatgtgctgaagaagttcatctgcatcagtgacctgcgggcccagattgctggctacctgtatggagtgtccccaccagacaacccccaggtgaaggagatccgctgcatcgtgatggtgccccagtggggcacccaccagacagtgcacctgcccggccagctgccccagcacgagtacctgaaggagatggagcccctgggctggatccacacccagcccaatgaaagcccccagctgagcccccaggatgtgaccacccacgccaagatcatggctgacaaccccagctgggatggagagaagaccatcatcatcacctgcagcttcaccccaggcagctgcaccctgacagcctacaagctgaccccatctggctatgagtggggccggcagaacacagacaagggcaacaaccccaagggctacctgcccagccactatgaaagagtgcagatgctgctgagtgaccgcttcctgggcttcttcatggtgcctgcccagagctcctggaactacaacttcatgggcgtgagacatgaccccaacatgaagtatgagctgcagctggccaaccccaaggagttctaccacgaggtgcaccggcccagccacttcctgaactttgccctgctgcaggagggggaggtgtacagcgctgaccgggaggacctgtatgcctag

SEQ ID NO: 166612 - DNA, 1392 bp, Artificial Sequence
  Description of Artificial Sequence: Synthetic coding sequence
atgatccaggccctgggcggcgtggagggcatcctggagcacaccctcttcaagggcacctacttccccacctgggagggcctcttctgggagaaggccagcggctttgaggagagcatgaagtggaagaagctgaccaatgcccagaggagcggcctgaaccagatccccaacagacgcttcaccctgtggtggagccccaccatcaacagagccaacgtgtatgtgggcttccaggtgcagctggacctgaccggcatcttcatgcacggcaagatccccaccctgaagatcagcctcatccagatcttccgggcccacctgtggcagaagatccacgagagcatcgtgatggacctgtgccaggtgtttgaccaggagctggatgccctggagattgaaacagtgcagaaggagaccatccaccccaggaagagctacaagatgaacagcagctgtgccgacatcctgctgtttgccagctacaagtggaatgtgtcccggcccagcctgctggccgacagcaaggatgtgatggacagcaccaccacccagaagtactggattgacatccagctgcgctggggagactatgacagccatgacatcgagagatatgcccgggccaagttcctggactacaccacagacaacatgagcatctaccccagccccaccggggtgctgattgccatcgacctggcctacaacctgcacagctacagcgaggtgggcagcctgcagcaggccagccacaccaccggggccaagatcatgaaggccaacccagccctgtatgtgctgcgggagcgcatcaggaagggcctgcagctgtacagcagcgagcccacagagccctacctgagcagccagaactatggagagctgttcagcaaccagatcatctggtttgtggatgacaccaacgtgtacagagtgaccatccacaagacctttgagggcaacctgaccaccaagcccatcaatggagccatcttcatcttcaaccccaggacaggccagctgttcctgaagatcatccacacctctgtgtgggccggccagaagaggctgggccagctggccaagtggaagacagctgaggaggtggccgccctgatccgcagcctgcctgtggaggagcagcccaagcagatcatcgtgaccaggaagggcatgctggaccccctggaggtgcacctgctggacttccccaacatcgtcatcaagggcagcgagctgcagctgcccttccaggcctgcctgaaggtggagaagtttggagacctgatcctgaaggccacagagccccagatggtgctcttcaacctgtatgatgactggctgaagaccatcagcagctacacagccttcagccgcctcatcctgtag

SEQ ID NO: 166613 - DNA, 2727 bp, Artificial Sequence
  Description of Artificial Sequence: Synthetic coding sequence
atggctgatggcggcggccccaaggatgcccccagcctgcggagcagccctggccctgccccccgggtgcccagggctgtgggccccagcggcggcggcggggagacccccaggacagctgccctggccctgcgctttgacaagcccatcaagcaggccttctacaacacaggagctgtgctgtttgtgtgcctgtgctgcggggctgctgtgctggtgtacttcatcctggaggccttcctgcggcccctgctgtgggccgtgctgtgtggcaccttcctgcaccccttcaagagcagcctgacccggctgggccgccactggctgcagaggctgcaccgggcccacacccccatcgtgctggccgccctgctgctgcccctgtgctttgtggactatggagtggaggccctgggggagcaggccctgcggcggcggcggctgctgctgctgctgggcgctgggggccccctgctgtatggcctgtactgcctgggcagctacctgggcgtgcaggtgctgctggtgcacgccgccaccctcatctgccggggcctggactacttcagcagcctgtggatctggaccctggtggtgggctacgtgctgactgtgtccttcaagtggaatgccagcacagagcgctacctgcgggctgtgtccatccctgtgtggatcatcctgctcttccacctggccagcctggccggctcctggagaattcctgtgttcctggtgattgtgttcctgatgtctgtgggcaccctgtatgagaagcagaatggcaaggagagcagcggggctgagctgcccggccaggtgatctccatggccgccagcaccctggccaacctggccatcagcatcaccggctatgagagcagcagcgaggaccagcccagcacccagcctgctgaggccgtggacagaggagagagcgcccccaccctgagcaccagccccagccccagcagccccagccccaccagccccagccccaccctgggcagaagaagacctgagatcggcaccttcctgaggaagaagaagaccagtgacatctactttgtgtccctggtgtgggccatcgtggtgatgcagatctggctgaacctgtggatcgtgcagctgctgcctgtgcccatcgctgtgtggatcctgaagaagctggtgatccactttggagtggtggacttcctggagaagcgctaccacgtgtggtggggcatcatcgagagcttcctgaaggagcggcagggcgccctggccccctggcccatcgtgggcctgggcaagttcctgctgaaggtggacagcaagctgtggcactggctgaacaagaagatgatcatctggctggagaagatgctggacaagatcatcagcatcttcatcatcttcctgctggtgattggcaccctgctgctggccctgctgctgacagccaaggtgcaccaggagagcgtgcacatgattgaggtgaccagcaacctgatcaatgagaccctggccaaccaccctgagtgggccaactggctgcctgaggcccaggtggtgcagagggccctgaacagcgctgccaacaacgtgtaccagtatggccgggagtggatcacccacaagctgcacaagatcctgggggacaaggtgaacaacacagctgtgattgagaagcaggtgctggagctgtgggaccggctgtaccacagctggtttgtgaagaatgtgacccacagcggccgccacaagggccagaagctgcacgtgtcccggcagaacagctggctgggggacatcctggactggcaggacatcgtgtcctttgtgcatgaaaatattgagaccttcctgagcatcctggagagcctgtggatcgtgatgagcagaaatgtgtccctgctcttcaccaccgtgaccaccctgctgaccatcctcttctacagcggcacagccctgctgaactttgtgctgagcctcatcatcttcctgaccaccctcttctacctgctgagcagcagtgatgagtactacaagcctgtgaagtgggtgatcagcctgacccccctgagccagcccggccccagcagcaacatcatcggccagagcgtggaggaggccatccggggcgtgtttgatgccagcctgaagatggccggcttctacggcctgtacacctggctgacccacaccatgtttggcatcaacatcgtgttcatccccagcgccctggccgccatcctgggcgctgtgcccttcctgggcacctactgggccgctgtgcctgctgtgctggacctgtggctgacccagggcctgggctgcaaggccatcctgctgctgatcttccacctgctgcccacctactttgtggacacagccatctacagcgacatcagcggcggcggccacccctacctgaccggcctggccgtggccggcggggcctactacctgggcctggagggcgccatcatcggccccatcctgctgtgcatcctggtggtggccagcaacatctacagcgccatgctggtgagccccaccaacagcgtgcccacccccaaccagaccccctggccagcccagccccagaggaccttccgggacatcagccgctctgagatcttctctgtggatgtggtgtcctctgctgtgatcttcaggaagttcaagtttgacagcgagttcagcagcgctgtggccctgtgccccagcagctgtgcctag

SEQ ID NO: 166614 - DNA, 1062 bp, Artificial Sequence
  Description of Artificial Sequence: Synthetic coding sequence
atgctgaagagctgcagccgggccagcttcagccccagcgtgaggaagcccccactcatcctgcggcggctgctgtctgaagatgtgggcatggacatcccctttgaggagggcgtgctgagccccagcgctgctgacatgaggcctgagccccccaacagcctggacctgaatgacacccacccccggcgcatcaagctgacagcccccaacatcaacctgagcctggaccagagcgagggcagcatcctgagtgatgacaacctggacagcccagatgaaattgacatcaacgtggatgagctggacaccccagatgaggccgacagctttgagtacacaggccacgaggaccccacagccaacaaggacagcggccaggagagcgagagcatccctgagtacacagctgaggaggagcgggaggacaaccggctgtggaggacagtggtgattggagagcaggagcagagaattgacatgaaggtgattgagccctaccgccgggtcatcagccatggaggctactatggagatggcctgaatgccatcatcgtgtttgctgcctgcttcctgcctgacagcagcagagctgactaccactacgtgatggagaacctcttcctgtatgtgatcagcaccctggagctgatggtggccgaggactacatgattgtgtacctgaatggagccacccccaggaggaggatgcctggcctgggctggatgaagaagtgctaccagatgattgaccggcggctgaggaagaacctgaagagcttcatcatcgtgcaccccagctggttcatccgcaccatcctggccgtgacccggcccttcatcagcagcaagttcagcagcaagatcaagtatgtgaacagcctgtctgagctgagcggcctcatccccatggactgcatccacatccctgagagcatcatcaagctggatgaggagctgcgggaggccagcgaggccgccaagaccagctgcctgtacaatgaccctgagatgagctccatggagaaggacatcgacctgaagctgaaggagaagccctag

SEQ ID NO: 166615 - DNA, 9267 bp, Artificial Sequence
  Description of Artificial Sequence: Synthetic coding sequence
atggaggagttcctgcagagggccaagagcaagctgaacagaagcaagaggctggagaaggtgcacgtggtgattggccccaagagctgtgacctggacagcctcatcagcaccttcacctacgcctacttcctggacaaggtgagccccccaggagtgctgtgcctgcctgtgctgaacatccccaggacagagttcaactacttcacagagacccgcttcatcctggaggagctgaacatcagcgagagcttccacatcttcagagatgagatcaacctgcaccagctgaatgatgagggcaagctgagcatcaccctggtgggcagctctgtgctggccagcgaggacaagaccctggagagcgctgtggtgaaggtgatcaaccctgtggagcagagtgatgccaacgtggagttccgggagagcagcagcagcctggtgctgaaggagatcctgcaggaggcccctgagctgatcacagagcagctggcccaccggctgcggggcagcatcctcttcaagtggatgaccatggagagcgagaagatcagcgagaagcaggaggagatcctgagcatcctggaggagaagttccccaacctgcccccccgggaggacatcatcaacgtgctgcaggagacccagttcagcgcccagggcctgagcattgagcagaccatgctgaaggacctgaaggagctgagtgatggagagatcaaggtggccatcagcacagtgtccatgaacctggagaactgcctcttccacagcaacatcaccagtgacctgaaggccttcacagacaagtttggatttgatgtgctgatcctcttcagcagctacctgtctgaggagcagcagccccggcggcagattgctgtgtacagcgagaacatggagctgtgcagccagatctgctgtgagctggaggagtgccagaacccctgcctggagctggagccctttgactgtggctgtgatgagatcctggtgtaccagcaggaggaccccagcgtgacctgtgaccaggtggtgctggtggtgaaggaggtgatcaacagacgctgcccagagatggtgagcaacagcaggaccagcagcacagaagctgtggccggcagcgcccccctgagccagggcagcagcggcatcatggagctgtatggcagtgacatcgagccccagcccagctctgtgaacttcatcgagaaccccccagacctgaatgacagcaaccaggcccaggtggatgccaacgtggacctggtgtccccagacagcggcctggccaccatccgcagcagccgcagcagcaaggagagctctgtgttcctgagtgatgacagccctgtgggggagggcgccggcccccaccacaccctgctgcccggcctggacagctacagccccatccctgagggcgctgtggccgaggagcacgcctggagcggggagcacggggagcactttgacctcttcaactttgatcctgcccccatggccagcggccagagccagcagagcagccacagcgctgactacagccctgcagatgacttcttccccaacagcgacctgtctgagggccagctgcctgctggccctgagggcctggatggcatgggcaccaacatgagcaactacagcagcagcagcctgctgagcggggccggcaaggacagcctggtggagcatgatgaggagtttgtgcagaggcaggacagcccccgggacaacagcgagaggaacctgagcctgacagactttgtgggagatgagagccccagccctgagcggctgaagaacacaggcaagagaattcctcccacccccatgaacagcctggtggagagcagccccagcacagaggagcccgccagcctgtacacagaggacatgacccagaaggccacagacaccggccacatgggccccccccagacccacgcccgctgcagctcctggtggggcggcctggagattgacagcaagaacattgctgatgcctggagcagcagcgagcaggagagcgtcttccagagccctgagagctggaaggagcacaagcccagcagcattgaccggcgggccagtgacagcgtcttccagcccaagagcctggagttcaccaagagcggcccctgggagagcgagtttggccagcctgagctgggcagcaatgacatccaggacaagaatgaggagagcctgcccttccagaacctgcccatggagaagagccccctgcccaacaccagcccccagggcaccaaccacctgattgaagattttgccagcctgtggcacagcggccgcagccccacagccatgcctgagccctggggcaaccccacagatgatggagagcctgctgctgtggcccccttccctgcctggagcgccttcggcaaggaggaccatgatgaggccctgaagaacacctggaacctgcaccccaccagcagcaagaccccatctgtgcgggaccccaatgagtgggccatggccaagagcggctttgccttcagcagcagcgagctgctggacaacagccccagcgagatcaacaatgaggccgcccctgagatctggggcaagaagaacaatgacagccgggaccacatctttgcccctggcaaccccagcagtgacctggaccacacctggaccaacagcaagccacccaaggaggaccagaatggcctggtggaccccaagacccggggcaaggtgtatgagaaggtggacagctggaacctgtttgaggagaacatgaagaagggcggcagtgatgtgctggtgccctgggaggacagcttcctgagctacaagtgcagcgactacagcgccagcaacctgggggaggacagcgtgcccagccccctggacaccaactacagcaccagtgacagctacaccagccccacctttgctggagatgagaaggagacagagcacaagccctttgccaaggaggagggctttgagagcaaggatggcaacagcacagctgaggagacagacatccccccccagagcctgcagcagagcagcaggaaccgcatcagcagcggccctggcaacctggacatgtgggccagcccccacacagacaacagcagcgagatcaacaccacccacaacctggatgaaaatgagctgaagacagagcacacagatggcaagaacatctccatggaggatgatgtgggggagagcagccagagcagctatgatgaccccagcatgatgcagctgtacaatgagaccaaccggcagctgaccctgctgcacagcagcaccaacagccggcagacagccccagacagcctggacctgtggaacagagtcatcctggaggacacccagagcacagccaccatcagtgacatggacaatgacctggactgggatgactgcagcggcggggccgccatccccagtgatggccagacagagggctacatggccgagggcagcgagcctgagacccgcttcaccgtgcggcagctggagccctggggcctggagtaccaggaggccaaccaggtggactgggagctgcctgccagtgatgagcacaccaaggacagcgcccccagcgagcaccacaccctgaatgagaagagcggccagctgattgccaacagcatctgggacagcgtgatgagggacaaggacatgagcagcttcatgctgcccggcagcagccacatcacagattctgagcagcgggagctgcccccagagatccccagccacagcgccaacgtgaaggacacccacagcccagatgccccagctgccagcggcaccagcgagagcgaggccctgatcagccacctggacaagcaggacacagagcgggagaccctgcagagtgatgctgccagcctggccacccggctggagaaccctggctacttcccccacccagacccctggaagggccatggagatggccagagcgagagcgagaaggaggcccagggcgccacagaccggggccacctggatgaggaggaggtgattgccagcggcgtggagaatgccagcggcatcagcgagaagggccagagcgaccaggagctgagcagcctggtggccagcgagcaccaggagatctgcatcaagagcggcaagatcagcagcctggccgtgaccttcagcccccagacagaggagcctgaggaggtgctggagtatgaggagggcagctacaacctggacagcagagatgtgcagacaggcatgtctgctgacaacctgcagcccaaggacacccatgagaagcacctgatgagccagaggaacagcggggagaccacagagaccagtgatggcatgaacttcaccaagtatgtgtctgtgcctgagaaggacctggagaagacagaggagtgcaacttcctggagccagaaaatgtgggcggcggccccccccaccgggtgcccaggagcctggactttggagatgtgcccatcgacagtgatgtgcacgtgagcagcacctgcagcgagatcaccaagaacctggatgtgaagggcagcgagaacagcctgcctggagctggcagcagcggcaactttgaccgggacaccatcagcagcgagtacacccacagcagcgccagcagccctgagctgaatgacagctctgtggccctgagctcctggggccagcagcccagcagcggctaccaggaggagaaccagggcaactggagcgagcagaaccaccaggagagcgagctgatcaccacagatggccaggtggagatcgtgaccaaggtgaaggacctggagaagaaccgcatcaatgaatttgagaagagctttgacaggaagacccccaccttcctggagatctggaatgacagcgtggatggagacagcttcagcagcctgagcagccctgagaccgggaagtacagcgagcacagcggcacccaccaggagagcaacctgattgccagctaccaggagaagaatgaacatgacatcagcgccaccgtgcagccagaagatgcccgggtcatcagcaccagcagcggcagtgatgatgattctgtgggcggggaggagagcattgaggaggagatccaggtggccaactgccacgtggctgaagatgagagccgggcctgggacagcctgaatgaaagcaacaagttcctggtgacagctgaccccaagtctgagaacatctatgactacctggacagcagcgagccagcagaaaatgaaaacaagagcaaccccttctgtgacaaccagcagagcagcccagacccctggaccttcagccccctgacagaaacagagatgcagatcacagctgtggagaaggagaagaggagcagccctgagaccggcaccactggagatgtggcctggcagatcagccccaaggccagcttccccaagaatgaagacaacagccagctggagatgctgggcttctctgctgacagcacagagtggtggaaggccagcccccaggagggccgcctcatcgagagcccctttgagcgggagctgagtgacagcagcggcgtgctggagatcaacagctctgtgcaccagaatgccagcccctggggcgtgcctgtgcagggcgacatcgagcctgtggagacccactacaccaaccccttcagtgacaaccaccagagccccttcctggagggcaatggcaagaacagccatgagcagctgtggaacatccagccccggcagcctgaccctgatgctgacaagttcagccagctggtgaagctggaccagatcaaggagaaggacagccgggagcagacctttgtgtctgctgctggagatgagctgaccccagagacccccacccaggagcagtgccaggacaccatgctgcctgtgtgtgaccacccagacacagccttcacccatgctgaggagaacagctgtgtgaccagcaatgtgtccaccaatgaaggccaggagaccaaccagtgggagcaggagaagagctacctgggggagatgaccaacagcagcatcgccacagagaacttccctgctgtgagcagccccacccagctgatcatgaagccaggcagcgagtgggatggcagcaccccatctgaggacagccggggcacctttgtgcctgacatcctgcacggcaacttccaggagggcggccagctggccagcgctgccccagacctgtggattgatgccaagaagcccttcagcctgaaggcagatggagaaaatccagacatcctgacccactgtgaacatgacagcaacagccaggccagtgacagcccagacatctgccatgattctgaggccaagcaggagacagagaagcacctgagcgcctgcatgggccctgaggtggagagcagcgagctgtgcctgacagagcctgagattgatgaggagcccatctatgagcccggccgggagtttgtgcccagcaatgctgagctggacagtgaaaatgccaccgtgctgccccccatcggctaccaggccgacatcaagggcagcagccagcctgccagccacaagggcagccctgagcccagcgagatcaacggggacaacagcacaggcctgcaggtgtctgagaagggggccagcccagacatggcccccatcctggagcctgtggaccggcgcatccccagaattgaaaatgtggccaccagcatctttgtgacccaccaggagcccaccccagaaggagatggctcctggatcagtgacagcttcagccctgagagccagcccggggcccgggccctgtttgatggagacccccacctgagcacagagaacccagccctggtgcctgatgccctgctggccagtgacacctgcctggacatcagcgaggccgcctttgaccacagcttcagtgatgccagcggcctgaacaccagcacaggcaccattgatgacatgagcaagctgaccctgtctgagggccaccctgagacccctgtggatggagacctgggcaagcaggacatctgcagcagcgaggcctcctggggagactttgaatatgatgtgatgggccagaacattgatgaggacctgctgcgggagcctgagcacttcctgtatggaggagacccccccctggaggaggacagcctgaagcagagcctggccccctacaccccaccatttgacctgagctacctgacagagcccgcccagagcgctgagaccatcgaggaggccggcagcccagaagatgagagcctgggctgcagagctgctgagatcgtgctgagcgccctgcctgacagaagaagtgagggcaaccaggccgagaccaagaaccggctgcccggcagccagctggccgtgctgcacatccgggaggaccctgagagcgtgtacctgcctgtgggcgccggcagcaacatcctgagccccagcaatgtggactgggaggtggagacagacaacagcgacctgcctgctggaggagacatcggcccccccaacggggccagcaaggagatcagcgagctggaggaggagaagaccatccccaccaaggagcctgagcagatcaagtctgagtacaaggaggagcgctgcacagagaagaatgaagatagacatgccctgcacatggactacatcctggtgaaccgggaggagaacagccacagcaagccagagacctgtgaggagcgggagagcattgctgagctggagctgtatgtgggcagcaaggagaccggcctgcagggcacccagctggccagcttcccagacacctgccagcctgccagcctgaatgaaaggaagggcctgtctgctgagaagatgagcagcaagagtgacaccaggagcagctttgagagccctgcccaggaccagagctggatgttcctgggccacagcgaggtgggggaccccagcctggatgcccgggacagcggccctggctggagcggcaagacagtggagcccttcagcgagctgggcctgggggagggcccccagctgcagatcctggaggagatgaagcccctggagagcctggccctggaggaggccagcggccctgtgtcccagagccagaagagcaagagccggggccgggccggcccagatgctgtgaccctgcaggccgtgacccatgacaatgagtgggagatgctgagcccccagcctgtgcagaagaacatgatcccagacacagagatggaggaggagacagagttcctggagctgggcacccgcatcagccggcccaacggcctgctgtctgaagatgtgggcatggacatcccctttgaggagggcgtgctgagccccagcgctgctgacatgaggcctgagccccccaacagcctggacctgaatgacacccacccccggcgcatcaagctgacagcccccaacatcaacctgagcctggaccagagcgagggcagcatcctgagtgatgacaacctggacagcccagatgaaattgacatcaacgtggatgagctggacaccccagatgaggccgacagctttgagtacacaggccatgaccccacagccaacaaggacagcggccaggagagcgagagcatccctgagtacacagctgaggaggagcgggaggacaaccggctgtggaggacagtggtgattggagagcaggagcagagaattgacatgaaggtgattgagccctacagaagagtcatcagccacggcggctactatggagatggcctgaatgccatcatcgtgtttgctgcctgcttcctgcctgacagcagcagagctgactaccactacgtgatggagaacctcttcctgtatgtgatcagcaccctggagctgatggtggccgaggactacatgattgtgtacctgaatggagccaccccaagaagaaggatgcctggcctgggctggatgaagaagtgctaccagatgattgaccggcggctgaggaagaacctgaagagcttcatcatcgtgcaccccagctggttcatccgcaccatcctggccgtgacccggcccttcatcagcagcaagttcagcagcaagatcaagtatgtgaacagcctgtctgagctgagcggcctcatccccatggactgcatccacatccctgagagcatcatcaagctggatgaggagctgcgggaggccagcgaggccgccaagaccagctgcctgtacaatgaccctgagatgagctccatggagaaggacatcgacctgaagctgaaggagaagccctag

SEQ ID NO: 166616 - DNA, 9165 bp, Artificial Sequence
  Description of Artificial Sequence: Synthetic coding sequence
agaaacctgatgcacaggatgaaggagagtgaaaatagaagcaagaggctggagaaggtgcacgtggtgattggccccaagagctgtgacctggacagcctcatcagcaccttcacctacgcctacttcctggacaaggtgtccccacctggggtgctgtgcctgcctgtgctgaacatccccaggacagagttcaactacttcacagagacccgcttcatcctggaggagctgaacatcagcgagagcttccacatcttcagagatgagatcaacctgcaccagctgaatgatgagggcaagctgagcatcaccctggtgggcagctctgtgctggccagcgaggacaagaccctggagagcgctgtggtgaaggtgatcaaccctgtggagcagagtgatgccaacgtggagttccgggagagcagcagcagcctggtgctgaaggagatcctgcaggaggcccctgagctgatcacagagcagctggcccaccggctgcggggcagcatcctcttcaagtggatgaccatggagagcgagaagatcagcgagaagcaggaggagatcctgagcatcctggaggagaagttccccaacctgcccccccgggaggacatcatcaacgtgctgcaggagacccagttcagcgcccagggcctgagcattgagcagaccatgctgaaggacctgaaggagctgagtgatggagagatcaaggtggccatcagcacagtgtccatgaacctggagaactgcctcttccacagcaacatcaccagtgacctgaaggccttcacagacaagtttggatttgatgtgctgatcctcttcagcagctacctgtctgaggagcagcagccccggcggcagattgctgtgtacagcgagaacatggagctgtgcagccagatctgctgtgagctggaggagtgccagaacccctgcctggagctggagccctttgactgtggctgtgatgagatcctggtgtaccagcaggaggaccccagcgtgacctgtgaccaggtggtgctggtggtgaaggaggtgatcaacagacgctgcccagagatggtgagcaacagcaggaccagcagcacagaggccgtggccggcagcgcccccctgagccagggcagcagcggcatcatggagctgtatggcagtgacatcgagccccagcccagctctgtgaacttcattgaaaatcctccagacctgaatgacagcaaccaggcccaggtggatgccaacgtggacctggtgtccccagattctggcctggccaccatccgcagcagccgcagcagcaaggagagcagcgtcttcctgagtgatgacagccctgtgggggagggcgccggcccccaccacaccctgctgcccggcctggacagctacagccccatccctgagggcgctgtggccgaggagcacgcctggagcggggagcacggggagcactttgacctcttcaactttgatcctgcccccatggccagcggccagagccagcagagcagccacagcgctgactacagccctgcagatgacttcttccccaacagcgacctgtctgagggccagctgcctgctggccctgagggcctggatggcatgggcaccaacatgagcaactacagcagcagcagcctgctgtctggagctgggaaggacagcctggtggagcatgatgaggagtttgtgcagaggcaggacagcccccgggacaacagcgagaggaacctgagcctgacagactttgtgggagatgagagccccagccctgagcggctgaagaacacaggcaagaggatcccccccacccccatgaacagcctggtggagagcagccccagcacagaggagcccgccagcctgtacacagaggacatgacccagaaggccacagacaccggccacatgggccccccccagacccacgcccgctgcagctcctggtggggcggcctggagattgacagcaagaacattgctgatgcctggagcagcagcgagcaggagagcgtcttccagagccctgagagctggaaggagcacaagcccagcagcattgacagaagagccagtgacagcgtcttccagcccaagagcctggagttcaccaagagcggcccctgggagagcgagtttggccagcctgagctgggcagcaatgacatccaggacaagaatgaggagagcctgcccttccagaacctgcccatggagaagagccccctgcccaacaccagcccccagggcaccaaccacctgattgaggactttgccagcctgtggcacagcggccgcagccccacagccatgcctgagccctggggcaaccccacagatgatggagagcctgctgctgtggcccccttccctgcctggagcgccttcggcaaggaggaccatgatgaggccctgaagaacacctggaacctgcaccccaccagcagcaagacccccagcgtgcgggaccccaatgagtgggccatggccaagagcggctttgccttcagcagcagcgagctgctggacaacagccccagcgagatcaacaatgaagctgcccctgagatctggggcaagaagaacaatgacagccgggaccacatctttgcccctggcaaccccagcagtgacctggaccacacctggaccaacagcaagccacccaaggaggaccagaatggcctggtggaccccaagacccggggcaaggtgtatgagaaggtggacagctggaacctgtttgaggagaacatgaagaagggcggcagtgatgtgctggtgccctgggaggacagcttcctgagctacaagtgcagcgactacagcgccagcaacctgggagaagattctgtgcccagccccctggacaccaactacagcaccagtgacagctacaccagccccacctttgctggagatgagaaggagacagagcacaagccctttgccaaggaggagggctttgagagcaaggatggcaacagcacagctgaggagacagacatccccccccagagcctgcagcagagcagcaggaaccgcatcagcagcggccctggcaacctggacatgtgggccagcccccacacagacaacagcagcgagatcaacaccacccacaacctggatgaaaatgagctgaagacagagcacacagatggcaagaacatctccatggaggatgatgtgggggagagcagccagagcagctatgatgaccccagcatgatgcagctgtacaatgagaccaaccggcagctgaccctgctgcacagcagcaccaacagccggcagacagccccagacagcctggacctgtggaacagagtcatcctggaggacacccagagcacagccaccatcagtgacatggacaatgacctggactgggatgactgcagcggcggggccgccatccccagtgatggccagacagagggctacatggccgagggcagcgagcctgagacccgcttcaccgtgcggcagctggagccctggggcctggagtaccaggaggccaaccaggtggactgggagctgcctgccagtgatgagcacaccaaggacagcgcccccagcgagcaccacaccctgaatgagaagagcggccagctgattgccaacagcatctgggacagcgtgatgagggacaaggacatgagcagcttcatgctgcccggcagcagccacatcacagacagcgagcagcgggagctgcccccagagatccccagccacagcgccaacgtgaaggacacccacagcccagatgccccagctgccagcggcaccagcgagagcgaggccctgatcagccacctggacaagcaggacacagagcgggagaccctgcagagtgatgctgccagcctggccacccggctggagaaccctggctacttcccccacccagacccctggaagggccatggagatggccagagcgagagcgagaaggaggcccagggcgccacagaccggggccacctggatgaggaggaggtgattgccagcggcgtggagaatgccagcggcatcagcgagaagggccagagcgaccaggagctgagcagcctggtggccagcgagcaccaggagatctgcatcaagagcggcaagatcagcagcctggccgtgaccttcagcccccagacagaggagcctgaggaggtgctggagtatgaggagggcagctacaacctggacagcagagatgtgcagacaggcatgtctgctgacaacctgcagcccaaggacacccatgagaagcacctgatgagccagagaaattctggagagaccacagagaccagtgatggcatgaacttcaccaagtatgtgtctgtgcctgagaaggacctggagaagacagaggagtgcaacttcctggagccagaaaatgtgggcggcggccccccccaccgggtgcccaggagcctggactttggagatgtgcccatcgacagtgatgtgcacgtgagcagcacctgcagcgagatcaccaagaacctggatgtgaagggcagcgagaacagcctgcccggggccggcagcagcggcaactttgaccgggacaccatcagcagcgagtacacccacagcagcgccagcagccctgagctgaatgacagctctgtggccctgagctcctggggccagcagcccagcagcggctaccaggaggagaaccagggcaactggagcgagcagaaccaccaggagagcgagctgatcaccacagatggccaggtggagatcgtgaccaaggtgaaggacctggagaagaaccgcatcaatgaatttgagaagagctttgacaggaagacccccaccttcctggagatctggaatgattctgtggatggagacagcttcagcagcctgagcagccctgagaccgggaagtacagcgagcacagcggcacccaccaggagagcaacctgattgccagctaccaggagaagaatgaacatgacatcagcgccaccgtgcagccagaagatgcccgggtcatcagcaccagcagcggcagtgatgatgacagcgtgggcggggaggagagcattgaggaggagatccaggtggccaactgccacgtggccgaggatgagagccgggcctgggacagcctgaatgaaagcaacaagttcctggtgacagctgaccccaagtctgagaacatctatgactacctggacagcagcgagccagcagaaaatgaaaacaagagcaaccccttctgtgacaaccagcagagcagcccagacccctggaccttcagccccctgacagaaacagagatgcagatcacagctgtggagaaggagaagaggagcagccctgagaccggcaccactggagatgtggcctggcagatcagccccaaggccagcttccccaagaatgaagacaacagccagctggagatgctgggcttctctgctgacagcacagagtggtggaaggccagcccccaggagggccgcctgattgagagcccctttgagcgggagctgagtgacagcagtggagtgctggagatcaacagctctgtgcaccagaatgccagcccctggggcgtgcctgtgcagggcgacatcgagcctgtggagacccactacaccaaccccttcagtgacaaccaccagagccccttcctggagggcaatggcaagaacagccatgagcagctgtggaacatccagccccggcagcctgaccctgatgctgacaagttcagccagctggtgaagctggaccagatcaaggagaaggacagccgggagcagacctttgtgtctgctgctggagatgagctgaccccagagacccccacccaggagcagtgccaggacaccatgctgcctgtgtgtgaccacccagacacagccttcacccacgccgaggagaacagctgtgtgaccagcaatgtgtccaccaatgaaggccaggagaccaaccagtgggagcaggagaagagctacctgggggagatgaccaacagcagcatcgccacagagaacttccctgctgtgagcagccccacccagctgatcatgaagccaggcagcgagtgggatggcagcacccccagcgaggacagccggggcacctttgtgcctgacatcctgcacggcaacttccaggagggcggccagctggccagcgctgccccagacctgtggattgatgccaagaagcccttcagcctgaaggcagatggagagaacccagacatcctgacccactgtgaacatgacagcaacagccaggccagtgacagcccagacatctgccacgacagcgaggccaagcaggagacagagaagcacctgagcgcctgcatgggccctgaggtggagagcagcgagctgtgcctgacagagcctgagattgatgaggagcccatctatgagcccggccgggagtttgtgcccagcaatgctgagctggacagtgaaaatgccaccgtgctgccccccatcggctaccaggccgacatcaagggcagcagccagcctgccagccacaagggcagccctgagcccagcgagatcaatggagacaacagcacaggcctgcaggtgtctgagaagggggccagcccagacatggcccccatcctggagcctgtggaccggcgcatccccagaattgaaaatgtggccaccagcatctttgtgacccaccaggagcccaccccagaaggagatggctcctggatcagtgacagcttcagccctgagagccagcccggggcccgggccctgtttgatggagacccccacctgagcacagaaaatcctgccctggtgcctgatgccctgctggccagtgacacctgcctggacatcagcgaggccgcctttgaccacagcttcagtgatgccagcggcctgaacaccagcacaggcaccattgatgacatgagcaagctgaccctgtctgagggccaccctgagacccctgtggatggagacctgggcaagcaggacatctgcagcagcgaggcctcctggggagactttgaatatgatgtgatgggccagaacattgatgaggacctgctgcgggagcctgagcacttcctgtatggaggagacccccccctggaggaggacagcctgaagcagagcctggccccctacaccccaccatttgacctgagctacctgacagagcccgcccagagcgctgagaccatcgaggaggccggcagcccagaagatgagagcctgggctgcagagctgctgagatcgtgctgagcgccctgcctgaccggcgctctgagggcaaccaggccgagaccaagaaccggctgcccggcagccagctggccgtgctgcacatcagagaagatcctgagagcgtgtacctgcctgtgggcgccggcagcaacatcctgagccccagcaatgtggactgggaggtggagacagacaacagcgacctgcctgctggaggagacatcggccccccaaatggagccagcaaggagatcagcgagctggaggaggagaagaccatccccaccaaggagcctgagcagatcaagtctgagtacaaggaggagcgctgcacagagaagaatgaagatagacatgccctgcacatggactacatcctggtgaaccgggaggagaacagccacagcaagccagagacctgtgaggagcgggagagcattgctgagctggagctgtatgtgggcagcaaggagaccggcctgcagggcacccagctggccagcttcccagacacctgccagcctgccagcctgaatgaaaggaagggcctgtctgctgagaagatgagcagcaagagtgacaccaggagcagctttgagagccctgcccaggaccagagctggatgttcctgggccacagcgaggtgggggaccccagcctggatgcccgggacagcggccctggctggagcggcaagacagtggagcccttcagcgagctgggcctgggggagggcccccagctgcagatcctggaggagatgaagcccctggagagcctggccctggaggaggccagcggccctgtgtcccagagccagaagagcaagagccggggccgggccggcccagatgctgtgaccctgcaggccgtgacccatgacaatgagtgggagatgctgagcccccagcctgtgcagaagaacatgatcccagacacagagatggaggaggagacagagttcctggagctgggcacccgcatcagccggcccaacggcctgctgtctgaagatgtgggcatggacatcccctttgaggagggcgtgctgagccccagcgctgctgacatgaggcctgagccccccaacagcctggacctgaatgacacccacccccggcgcatcaagctgacagcccccaacatcaacctgagcctggaccagagcgagggcagcatcctgagtgatgacaacctggacagcccagatgaaattgacatcaacgtggatgagctggacaccccagatgaagctgacagctttgagtacacaggccacgaggaccccacagccaacaaggacagcggccaggagagcgagagcatccctgagtacacagctgaggaggagcgggaggacaaccggctgtggaggacagtggtgattggagagcaggagcagagaattgacatgaaggtgattgagccctacagaagagtcatcagccacggcggcagccggggctactatggagatggcctgaatgccatcatcgtgtttgctgcctgcttcctgcctgacagcagcagagctgactaccactacgtgatggagaacctcttcctgtatgtgatcagcaccctggagctgatggtggccgaggactacatgattgtgtacctgaatggagccacccccaggaggaggatgcctggcctgggctggatgaagaagtgctaccagatgattgaccggcggctgaggaagaacctgaagagcttcatcatcgtgcaccccagctggttcatccgcaccatcctggccgtgacccggcccttcatcagcagcaagttcagcagcaagatcaagtatgtgaacagcctgtctgagctgagcggcctcatccccatggactgcatccacatccctgagagcatcatcaactactag

SEQ ID NO: 166617 - DNA, 783 bp, Artificial Sequence
  Description of Artificial Sequence: Synthetic coding sequence
attgacatcaacgtggatgagctggacaccccagatgaggccgacagctttgagtacacaggccatgaccccacagccaacaaggacagcggccaggagagcgagagcatccctgagtacacagctgaggaggagcgggaggacaaccggctgtggaggacagtggtgattggagagcaggagcagagaattgacatgaaggtgattgagccctacagaagagtcatcagccacggcggggacagcggctactatggagatggcctgaatgccatcatcgtgtttgctgcctgcttcctgcctgacagcagcagagctgactaccactacgtgatggagaacctcttcctgtatgtgatcagcaccctggagctgatggtggccgaggactacatgattgtgtacctgaatggagccacccccaggaggaggatgcctggcctgggctggatgaagaagtgctaccagatgattgaccggcggctgaggaagaacctgaagagcttcatcatcgtgcaccccagctggttcatccgcaccatcctggccgtgacccggcccttcatcagcagcaagttcagcagcaagatcaagtatgtgaacagcctgtctgagctgagcggcctcatccccatggactgcatccacatccctgagagcatcatcaagtatgatgaggagaggagctacaagaggtctgtgaggaccagctgcctgtacaatgaccctgagatgagctccatggagaaggacatcgacctgaagctgaaggagaagccctag

SEQ ID NO: 166618 - DNA, 7155 bp, Artificial Sequence
  Description of Artificial Sequence: Synthetic coding sequence
tgattccagagccctgagagctggaaggagcacaagcccagcagcattgaccggcgggccagtgacagcgtcttccagcccaagagcctggagttcaccaagagcggcccctgggagagcgagtttggccagcctgagctgggcagcaatgacatccaggacaagaatgaggagagcctgcccttccagaacctgcccatggagaagagccccctgcccaacaccagcccccagggcaccaaccacctgattgaagattttgccagcctgtggcacagcggccgcagccccacagccatgcctgagccctggggcaaccccacagatgatggagagcctgctgctgtggcccccttccctgcctggagcgccttcggcaaggaggaccatgatgaggccctgaagaacacctggaacctgcaccccaccagcagcaagaccccatctgtgcgggaccccaatgagtgggccatggccaagagcggctttgccttcagcagcagcgagctgctggacaacagccccagcgagatcaacaatgaggccgcccctgagatctggggcaagaagaacaatgacagccgggaccacatctttgcccctggcaaccccagcagtgacctggaccacacctggaccaacagcaagccacccaaggaggaccagaatggcctggtggaccccaagacccggggcaaggtgtatgagaaggtggacagctggaacctgtttgaggagaacatgaagaagggcggcagtgatgtgctggtgccctgggaggacagcttcctgagctacaagtgcagcgactacagcgccagcaacctgggggaggacagcgtgcccagccccctggacaccaactacagcaccagtgacagctacaccagccccacctttgctggagatgagaaggagacagagcacaagccctttgccaaggaggagggctttgagagcaaggatggcaacagcacagctgaggagacagacatccccccccagagcctgcagcagagcagcaggaaccgcatcagcagcggccctggcaacctggacatgtgggccagcccccacacagacaacagcagcgagatcaacaccacccacaacctggatgaaaatgagctgaagacagagcacacagatggcaagaacatctccatggaggatgatgtgggggagagcagccagagcagctatgatgaccccagcatgatgcagctgtacaatgagaccaaccggcagctgaccctgctgcacagcagcaccaacagccggcagacagccccagacagcctggacctgtggaacagagtcatcctggaggacacccagagcacagccaccatcagtgacatggacaatgacctggactgggatgactgcagcggcggggccgccatccccagtgatggccagacagagggctacatggccgagggcagcgagcctgagacccgcttcaccgtgcggcagctggagccctggggcctggagtaccaggaggccaaccaggtggactgggagctgcctgccagtgatgagcacaccaaggacagcgcccccagcgagcaccacaccctgaatgagaagagcggccagctgattgccaacagcatctgggacagcgtgatgagggacaaggacatgagcagcttcatgctgcccggcagcagccacatcacagattctgagcagcgggagctgcccccagagatccccagccacagcgccaacgtgaaggacacccacagcccagatgccccagctgccagcggcaccagcgagagcgaggccctgatcagccacctggacaagcaggacacagagcgggagaccctgcagagtgatgctgccagcctggccacccggctggagaaccctggctacttcccccacccagacccctggaagggccatggagatggccagagcgagagcgagaaggaggcccagggcgccacagaccggggccacctggatgaggaggaggtgattgccagcggcgtggagaatgccagcggcatcagcgagaagggccagagcgaccaggagctgagcagcctggtggccagcgagcaccaggagatctgcatcaagagcggcaagatcagcagcctggccgtgaccttcagcccccagacagaggagcctgaggaggtgctggagtatgaggagggcagctacaacctggacagcagagatgtgcagacaggcatgtctgctgacaacctgcagcccaaggacacccatgagaagcacctgatgagccagaggaacagcggggagaccacagagaccagtgatggcatgaacttcaccaagtatgtgtctgtgcctgagaaggacctggagaagacagaggagtgcaacttcctggagccagaaaatgtgggcggcggccccccccaccgggtgcccaggagcctggactttggagatgtgcccatcgacagtgatgtgcacgtgagcagcacctgcagcgagatcaccaagaacctggatgtgaagggcagcgagaacagcctgcctggagctggcagcagcggcaactttgaccgggacaccatcagcagcgagtacacccacagcagcgccagcagccctgagctgaatgacagctctgtggccctgagctcctggggccagcagcccagcagcggctaccaggaggagaaccagggcaactggagcgagcagaaccaccaggagagcgagctgatcaccacagatggccaggtggagatcgtgaccaaggtgaaggacctggagaagaaccgcatcaatgaatttgagaagagctttgacaggaagacccccaccttcctggagatctggaatgacagcgtggatggagacagcttcagcagcctgagcagccctgagaccgggaagtacagcgagcacagcggcacccaccaggagagcaacctgattgccagctaccaggagaagaatgaacatgacatcagcgccaccgtgcagccagaagatgcccgggtcatcagcaccagcagcggcagtgatgatgattctgtgggcggggaggagagcattgaggaggagatccaggtggccaactgccacgtggctgaagatgagagccgggcctgggacagcctgaatgaaagcaacaagttcctggtgacagctgaccccaagtctgagaacatctatgactacctggacagcagcgagccagcagaaaatgaaaacaagagcaaccccttctgtgacaaccagcagagcagcccagacccctggaccttcagccccctgacagaaacagagatgcagatcacagctgtggagaaggagaagaggagcagccctgagaccggcaccactggagatgtggcctggcagatcagccccaaggccagcttccccaagaatgaagacaacagccagctggagatgctgggcttctctgctgacagcacagagtggtggaaggccagcccccaggagggccgcctcatcgagagcccctttgagcgggagctgagtgacagcagcggcgtgctggagatcaacagctctgtgcaccagaatgccagcccctggggcgtgcctgtgcagggcgacatcgagcctgtggagacccactacaccaaccccttcagtgacaaccaccagagccccttcctggagggcaatggcaagaacagccatgagcagctgtggaacatccagccccggcagcctgaccctgatgctgacaagttcagccagctggtgaagctggaccagatcaaggagaaggacagccgggagcagacctttgtgtctgctgctggagatgagctgaccccagagacccccacccaggagcagtgccaggacaccatgctgcctgtgtgtgaccacccagacacagccttcacccatgctgaggagaacagctgtgtgaccagcaatgtgtccaccaatgaaggccaggagaccaaccagtgggagcaggagaagagctacctgggggagatgaccaacagcagcatcgccacagagaacttccctgctgtgagcagccccacccagctgatcatgaagccaggcagcgagtgggatggcagcaccccatctgaggacagccggggcacctttgtgcctgacatcctgcacggcaacttccaggagggcggccagctggccagcgctgccccagacctgtggattgatgccaagaagcccttcagcctgaaggcagatggagaaaatccagacatcctgacccactgtgaacatgacagcaacagccaggccagtgacagcccagacatctgccatgattctgaggccaagcaggagacagagaagcacctgagcgcctgcatgggccctgaggtggagagcagcgagctgtgcctgacagagcctgagattgatgaggagcccatctatgagcccggccgggagtttgtgcccagcaatgctgagctggacagtgaaaatgccaccgtgctgccccccatcggctaccaggccgacatcaagggcagcagccagcctgccagccacaagggcagccctgagcccagcgagatcaacggggacaacagcacaggcctgcaggtgtctgagaagggggccagcccagacatggcccccatcctggagcctgtggaccggcgcatccccagaattgaaaatgtggccaccagcatctttgtgacccaccaggagcccaccccagaaggagatggctcctggatcagtgacagcttcagccctgagagccagcccggggcccgggccctgtttgatggagacccccacctgagcacagagaacccagccctggtgcctgatgccctgctggccagtgacacctgcctggacatcagcgaggccgcctttgaccacagcttcagtgatgccagcggcctgaacaccagcacaggcaccattgatgacatgagcaagctgaccctgtctgagggccaccctgagacccctgtggatggagacctgggcaagcaggacatctgcagcagcgaggcctcctggggagactttgaatatgatgtgatgggccagaacattgatgaggacctgctgcgggagcctgagcacttcctgtatggaggagacccccccctggaggaggacagcctgaagcagagcctggccccctacaccccaccatttgacctgagctacctgacagagcccgcccagagcgctgagaccatcgaggaggccggcagcccagaagatgagagcctgggctgcagagctgctgagatcgtgctgagcgccctgcctgacagaagaagtgagggcaaccaggccgagaccaagaaccggctgcccggcagccagctggccgtgctgcacatccgggaggaccctgagagcgtgtacctgcctgtgggcgccggcagcaacatcctgagccccagcaatgtggactgggaggtggagacagacaacagcgacctgcctgctggaggagacatcggcccccccaacggggccagcaaggagatcagcgagctggaggaggagaagaccatccccaccaaggagcctgagcagatcaagtctgagtacaaggaggagcgctgcacagagaagaatgaagatagacatgccctgcacatggactacatcctggtgaaccgggaggagaacagccacagcaagccagagacctgtgaggagcgggagagcattgctgagctggagctgtatgtgggcagcaaggagaccggcctgcagggcacccagctggccagcttcccagacacctgccagcctgccagcctgaatgaaaggaagggcctgtctgctgagaagatgagcagcaagagtgacaccaggagcagctttgagagccctgcccaggaccagagctggatgttcctgggccacagcgaggtgggggaccccagcctggatgcccgggacagcggccctggctggagcggcaagacagtggagcccttcagcgagctgggcctgggggagggcccccagctgcagatcctggaggagatgaagcccctggagagcctggccctggaggaggccagcggccctgtgtcccagagccagaagagcaagagccggggccgggccggcccagatgctgtgaccctgcaggccgtgacccatgacaatgagtgggagatgctgagcccccagcctgtgcagaagaacatgatcccagacacagagatggaggaggagacagagttcctggagctgggcacccgcatcagccggcccaacggcctgctgtctgaagatgtgggcatggacatcccctttgaggagggcgtgctgagccccagcgctgctgacatgaggcctgagccccccaacagcctggacctgaatgacacccacccccggcgcatcaagctgacagcccccaacatcaacctgagcctggaccagagcgagggcagcatcctgagtgatgacaacctggacagcccagatgaaattgacatcaacgtggatgagctggacaccccagatgaggccgacagctttgagtacacaggccatgaccccacagccaacaaggacagcggccaggagagcgagagcatccctgagtacacagctgaggaggagcgggaggacaaccggctgtggaggacagtggtgattggagagcaggagcagagaattgacatgaaggtgattgagccctacagaagagtcatcagccacggcggggacagcggctactatggagatggcctgaatgccatcatcgtgtttgctgcctgcttcctgcctgacagcagcagagctgactaccactacgtgatggagaacctcttcctgtatgtgatcagcaccctggagctgatggtggccgaggactacatgattgtgtacctgaatggagccacccccaggaggaggatgcctggcctgggctggatgaagaagtgctaccagatgattgaccggcggctgaggaagaacctgaagagcttcatcatcgtgcaccccagctggttcatccgcaccatcctggccgtgacccggcccttcatcagcagcaagttcagcagcaagatcaagtatgtgaacagcctgtctgagctgagcggcctcatccccatggactgcatccacatccctgagagcatcatcaacatcgacctgaagctgaaggagaagccctag

SEQ ID NO: 166619 - DNA, 8193 bp, Artificial Sequence
  Description of Artificial Sequence: Synthetic coding sequence
atggtgagcaacagcaggaccagcagcacagaggccgtggccggcagcgcccccctgagccagggcagcagcggcatcatggagctgtatggcagtgacatcgagccccagcccagctctgtgaacttcattgaaaatcctccagacctgaatgacagcaaccaggcccaggtggatgccaacgtggacctggtgtccccagattctggcctggccaccatccgcagcagccgcagcagcaaggagagcagcgtcttcctgagtgatgacagccctgtgggggagggcgccggcccccaccacaccctgctgcccggcctggacagctacagccccatccctgagggcgctgtggccgaggagcacgcctggagcggggagcacggggagcactttgacctcttcaactttgatcctgcccccatggccagcggccagagccagcagagcagccacagcgctgactacagccctgcagatgacttcttccccaacagcgacctgtctgagggccagctgcctgctggccctgagggcctggatggcatgggcaccaacatgagcaactacagcagcagcagcctgctgtctggagctgggaaggacagcctggtggagcatgatgaggagtttgtgcagaggcaggacagcccccgggacaacagcgagaggaacctgagcctgacagactttgtgggagatgagagccccagccctgagcggctgaagaacacaggcaagaggatcccccccacccccatgaacagcctggtggagagcagccccagcacagaggagcccgccagcctgtacacagaggacatgacccagaaggccacagacaccggccacatgggccccccccagacccacgcccgctgcagctcctggtggggcggcctggagattgacagcaagaacattgctgatgcctggagcagcagcgagcaggagagcgtcttccagagccctgagagctggaaggagcacaagcccagcagcattgacagaagagccagtgacagcgtcttccagcccaagagcctggagttcaccaagagcggcccctgggagagcgagtttggccagcctgagctgggcagcaatgacatccaggacaagaatgaggagagcctgcccttccagaacctgcccatggagaagagccccctgcccaacaccagcccccagggcaccaaccacctgattgaggactttgccagcctgtggcacagcggccgcagccccacagccatgcctgagccctggggcaaccccacagatgatggagagcctgctgctgtggcccccttccctgcctggagcgccttcggcaaggaggaccatgatgaggccctgaagaacacctggaacctgcaccccaccagcagcaagacccccagcgtgcgggaccccaatgagtgggccatggccaagagcggctttgccttcagcagcagcgagctgctggacaacagccccagcgagatcaacaatgaagctgcccctgagatctggggcaagaagaacaatgacagccgggaccacatctttgcccctggcaaccccagcagtgacctggaccacacctggaccaacagcaagccacccaaggaggaccagaatggcctggtggaccccaagacccggggcaaggtgtatgagaaggtggacagctggaacctgtttgaggagaacatgaagaagggcggcagtgatgtgctggtgccctgggaggacagcttcctgagctacaagtgcagcgactacagcgccagcaacctgggagaagattctgtgcccagccccctggacaccaactacagcaccagtgacagctacaccagccccacctttgctggagatgagaaggagacagagcacaagccctttgccaaggaggagggctttgagagcaaggatggcaacagcacagctgaggagacagacatccccccccagagcctgcagcagagcagcaggaaccgcatcagcagcggccctggcaacctggacatgtgggccagcccccacacagacaacagcagcgagatcaacaccacccacaacctggatgaaaatgagctgaagacagagcacacagatggcaagaacatctccatggaggatgatgtgggggagagcagccagagcagctatgatgaccccagcatgatgcagctgtacaatgagaccaaccggcagctgaccctgctgcacagcagcaccaacagccggcagacagccccagacagcctggacctgtggaacagagtcatcctggaggacacccagagcacagccaccatcagtgacatggacaatgacctggactgggatgactgcagcggcggggccgccatccccagtgatggccagacagagggctacatggccgagggcagcgagcctgagacccgcttcaccgtgcggcagctggagccctggggcctggagtaccaggaggccaaccaggtggactgggagctgcctgccagtgatgagcacaccaaggacagcgcccccagcgagcaccacaccctgaatgagaagagcggccagctgattgccaacagcatctgggacagcgtgatgagggacaaggacatgagcagcttcatgctgcccggcagcagccacatcacagacagcgagcagcgggagctgcccccagagatccccagccacagcgccaacgtgaaggacacccacagcccagatgccccagctgccagcggcaccagcgagagcgaggccctgatcagccacctggacaagcaggacacagagcgggagaccctgcagagtgatgctgccagcctggccacccggctggagaaccctggctacttcccccacccagacccctggaagggccatggagatggccagagcgagagcgagaaggaggcccagggcgccacagaccggggccacctggatgaggaggaggtgattgccagcggcgtggagaatgccagcggcatcagcgagaagggccagagcgaccaggagctgagcagcctggtggccagcgagcaccaggagatctgcatcaagagcggcaagatcagcagcctggccgtgaccttcagcccccagacagaggagcctgaggaggtgctggagtatgaggagggcagctacaacctggacagcagagatgtgcagacaggcatgtctgctgacaacctgcagcccaaggacacccatgagaagcacctgatgagccagagaaattctggagagaccacagagaccagtgatggcatgaacttcaccaagtatgtgtctgtgcctgagaaggacctggagaagacagaggagtgcaacttcctggagccagaaaatgtgggcggcggccccccccaccgggtgcccaggagcctggactttggagatgtgcccatcgacagtgatgtgcacgtgagcagcacctgcagcgagatcaccaagaacctggatgtgaagggcagcgagaacagcctgcccggggccggcagcagcggcaactttgaccgggacaccatcagcagcgagtacacccacagcagcgccagcagccctgagctgaatgacagctctgtggccctgagctcctggggccagcagcccagcagcggctaccaggaggagaaccagggcaactggagcgagcagaaccaccaggagagcgagctgatcaccacagatggccaggtggagatcgtgaccaaggtgaaggacctggagaagaaccgcatcaatgaatttgagaagagctttgacaggaagacccccaccttcctggagatctggaatgattctgtggatggagacagcttcagcagcctgagcagccctgagaccgggaagtacagcgagcacagcggcacccaccaggagagcaacctgattgccagctaccaggagaagaatgaacatgacatcagcgccaccgtgcagccagaagatgcccgggtcatcagcaccagcagcggcagtgatgatgacagcgtgggcggggaggagagcattgaggaggagatccaggtggccaactgccacgtggccgaggatgagagccgggcctgggacagcctgaatgaaagcaacaagttcctggtgacagctgaccccaagtctgagaacatctatgactacctggacagcagcgagccagcagaaaatgaaaacaagagcaaccccttctgtgacaaccagcagagcagcccagacccctggaccttcagccccctgacagaaacagagatgcagatcacagctgtggagaaggagaagaggagcagccctgagaccggcaccactggagatgtggcctggcagatcagccccaaggccagcttccccaagaatgaagacaacagccagctggagatgctgggcttctctgctgacagcacagagtggtggaaggccagcccccaggagggccgcctgattgagagcccctttgagcgggagctgagtgacagcagtggagtgctggagatcaacagctctgtgcaccagaatgccagcccctggggcgtgcctgtgcagggcgacatcgagcctgtggagacccactacaccaaccccttcagtgacaaccaccagagccccttcctggagggcaatggcaagaacagccatgagcagctgtggaacatccagccccggcagcctgaccctgatgctgacaagttcagccagctggtgaagctggaccagatcaaggagaaggacagccgggagcagacctttgtgtctgctgctggagatgagctgaccccagagacccccacccaggagcagtgccaggacaccatgctgcctgtgtgtgaccacccagacacagccttcacccacgccgaggagaacagctgtgtgaccagcaatgtgtccaccaatgaaggccaggagaccaaccagtgggagcaggagaagagctacctgggggagatgaccaacagcagcatcgccacagagaacttccctgctgtgagcagccccacccagctgatcatgaagccaggcagcgagtgggatggcagcacccccagcgaggacagccggggcacctttgtgcctgacatcctgcacggcaacttccaggagggcggccagctggccagcgctgccccagacctgtggattgatgccaagaagcccttcagcctgaaggcagatggagagaacccagacatcctgacccactgtgaacatgacagcaacagccaggccagtgacagcccagacatctgccacgacagcgaggccaagcaggagacagagaagcacctgagcgcctgcatgggccctgaggtggagagcagcgagctgtgcctgacagagcctgagattgatgaggagcccatctatgagcccggccgggagtttgtgcccagcaatgctgagctggacagtgaaaatgccaccgtgctgccccccatcggctaccaggccgacatcaagggcagcagccagcctgccagccacaagggcagccctgagcccagcgagatcaatggagacaacagcacaggcctgcaggtgtctgagaagggggccagcccagacatggcccccatcctggagcctgtggaccggcgcatccccagaattgaaaatgtggccaccagcatctttgtgacccaccaggagcccaccccagaaggagatggctcctggatcagtgacagcttcagccctgagagccagcccggggcccgggccctgtttgatggagacccccacctgagcacagaaaatcctgccctggtgcctgatgccctgctggccagtgacacctgcctggacatcagcgaggccgcctttgaccacagcttcagtgatgccagcggcctgaacaccagcacaggcaccattgatgacatgagcaagctgaccctgtctgagggccaccctgagacccctgtggatggagacctgggcaagcaggacatctgcagcagcgaggcctcctggggagactttgaatatgatgtgatgggccagaacattgatgaggacctgctgcgggagcctgagcacttcctgtatggaggagacccccccctggaggaggacagcctgaagcagagcctggccccctacaccccaccatttgacctgagctacctgacagagcccgcccagagcgctgagaccatcgaggaggccggcagcccagaagatgagagcctgggctgcagagctgctgagatcgtgctgagcgccctgcctgaccggcgctctgagggcaaccaggccgagaccaagaaccggctgcccggcagccagctggccgtgctgcacatcagagaagatcctgagagcgtgtacctgcctgtgggcgccggcagcaacatcctgagccccagcaatgtggactgggaggtggagacagacaacagcgacctgcctgctggaggagacatcggccccccaaatggagccagcaaggagatcagcgagctggaggaggagaagaccatccccaccaaggagcctgagcagatcaagtctgagtacaaggaggagcgctgcacagagaagaatgaagatagacatgccctgcacatggactacatcctggtgaaccgggaggagaacagccacagcaagccagagacctgtgaggagcgggagagcattgctgagctggagctgtatgtgggcagcaaggagaccggcctgcagggcacccagctggccagcttcccagacacctgccagcctgccagcctgaatgaaaggaagggcctgtctgctgagaagatgagcagcaagagtgacaccaggagcagctttgagagccctgcccaggaccagagctggatgttcctgggccacagcgaggtgggggaccccagcctggatgcccgggacagcggccctggctggagcggcaagacagtggagcccttcagcgagctgggcctgggggagggcccccagctgcagatcctggaggagatgaagcccctggagagcctggccctggaggaggccagcggccctgtgtcccagagccagaagagcaagagccggggccgggccggcccagatgctgtgaccctgcaggccgtgacccatgacaatgagtgggagatgctgagcccccagcctgtgcagaagaacatgatcccagacacagagatggaggaggagacagagttcctggagctgggcacccgcatcagccggcccaacggcctgctgtctgaagatgtgggcatggacatcccctttgaggagggcgtgctgagccccagcgctgctgacatgaggcctgagccccccaacagcctggacctgaatgacacccacccccggcgcatcaagctgacagcccccaacatcaacctgagcctggaccagagcgagggcagcatcctgagtgatgacaacctggacagcccagatgaaattgacatcaacgtggatgagctggacaccccagatgaagctgacagctttgagtacacaggccacgaggaccccacagccaacaaggacagcggccaggagagcgagagcatccctgagtacacagctgaggaggagcgggaggacaaccggctgtggaggacagtggtgattggagagcaggagcagagaattgacatgaaggtgattgagccctacagaagagtcatcagccacggcggctactatggagatggcctgaatgccatcatcgtgtttgctgcctgcttcctgcctgacagcagcagagctgactaccactacgtgatggagaacctcttcctgtatgtgatcagcaccctggagctgatggtggccgaggactacatgattgtgtacctgaatggagccaccccaagaagaaggatgcctggcctgggctggatgaagaagtgctaccagatgattgaccggcggctgaggaagaacctgaagagcttcatcatcgtgcaccccagctggttcatccgcaccatcctggccgtgacccggcccttcatcagcagcaagttcagcagcaagatcaagtatgtgaacagcctgtctgagctgagcggcctcatccccatggactgcatccacatccctgagagcatcatcaagctggatgaggagctgcgggaggccagcgaggccgccaagaccagctgcctgtacaatgaccctgagatgagctccatggagaaggacatcgacctgaagctgaaggagaagccctag

SEQ ID NO: 166620 - DNA, 927 bp, Artificial Sequence
  Description of Artificial Sequence: Synthetic coding sequence
atgaggcctgagccccccaacagcctggacctgaatgacacccacccccggcgcatcaagctgacagcccccaacatcaacctgagcctggaccagagcgagggcagcatcctgagtgatgacaacctggacagcccagatgaaattgacatcaacgtggatgagctggacaccccagatgaggccgacagctttgagtacacaggccatgaccccacagccaacaaggacagcggccaggagagcgagagcatccctgagtacacagctgaggaggagcgggaggacaaccggctgtggaggacagtggtgattggagagcaggagcagagaattgacatgaaggtgattgagccctacagaagagtcatcagccacggcggcaagctgcgctactatggagatggcctgaatgccatcatcgtgtttgctgcctgcttcctgcctgacagcagcagagctgactaccactacgtgatggagaacctcttcctgtatgtgatcagcaccctggagctgatggtggccgaggactacatgattgtgtacctgaatggagccacccccaggaggaggatgcctggcctgggctggatgaagaagtgctaccagatgattgaccggcggctgaggaagaacctgaagagcttcatcatcgtgcaccccagctggttcatccgcaccatcctggccgtgacccggcccttcatcagcagcaagttcagcagcaagatcaagtatgtgaacagcctgtctgagctgagcggcctcatccccatggactgcatccacatccctgagagcatcatcaagtatgatgaggagaggagctacaagaggtctgtgaggaccagctgcctgtacaatgaccctgagatgagctccatggagaaggacatcgacctgaagctgaaggagaagccctag

SEQ ID NO: 166621 - DNA, 1014 bp, Artificial Sequence
  Description of Artificial Sequence: Synthetic coding sequence
atgaatggcctgaggaacaagcagctgctgtctgaagatgtgggcatggacatcccctttgaggagggcgtgctgagccccagcgctgctgacatgaggcctgagccccccaacagcctggacctgaatgacacccacccccggcgcatcaagctgacagcccccaacatcaacctgagcctggaccagagcgagggcagcatcctgagtgatgacaacctggacagcccagatgaaattgacatcaacgtggatgagctggacaccccagatgaagctgacagctttgagtacacaggccatgaccccacagccaacaaggacagcggccaggagagcgagagcatccctgagtacacagctgaggaggagcgggaggacaaccggctgtggaggacagtggtgattggagagcaggagcagagaattgacatgaaggtgattgagccctaccgccgggtcatcagccatggaggctactatggagatggcctgaatgccatcatcgtgtttgctgcctgcttcctgcctgacagcagcagagctgactaccactacgtgatggagaacctcttcctgtatgtgatcagcaccctggagctgatggtggccgaggactacatgattgtgtacctgaatggagccacccccaggaggaggatgcctggcctgggctggatgaagaagtgctaccagatgattgaccggcggctgaggaagaacctgaagagcttcatcatcgtgcaccccagctggttcatccgcaccatcctggccgtgacccggcccttcatcagcagcaagttcagcagcaagatcaagtatgtgaacagcctgtctgagctgagcggcctcatccccatggactgcatccacatccctgagagcatcatcaagctggatgaggagctgcgggaggccagcgaggccgccaagaccagctgcctgtacaatgaccctgagatgagctccatggagaaggacatcgacctgaagctgaaggagaagccctag

SEQ ID NO: 166622 - DNA, 1155 bp, Artificial Sequence
  Description of Artificial Sequence: Synthetic coding sequence
atggctggaaatgctgagcccccacctgctggggccgcctgcccccaggaccggcgcagctgcagcggccgggccggcggggacagagtgtgggaggatggagagcacccagccaagaagctgaagtctggaggagatgaggagcggcgggagaagccacccaagaggaagatcgtgctgctgatggcctacagcggcaagggctaccacggcatgcagagaaatgtgggcagcagccagttcaagaccattgaagatgacctggtgtctgccctggtgcgcagcggctgcatccctgagaaccacggggaggacatgaggaagatgtccttccagagatgtgccaggacagacaagggcgtgtctgctgctggccaggtggtgtccctgaaggtgtggctgattgatgacatcctggagaagatcaacagccacctgcccagccacatccgcatcctgggcctgaagagggtgactggaggcttcaacagcaagaacagatgtgatgcccggacctactgctacctgctgcccacctttgcctttgcccacaaggacagagatgtgcaggatgagacctaccgcctgtctgctgagaccctgcagcaggtgaaccggctgctggcctgctacaagggcacccacaacttccacaacttcaccagccagaagggcccccaggaccccagcgcctgccgctacatcctggagatgtactgtgaggagccctttgtgcgggagggcctggagtttgctgtgatccgggtgaagggccagagcttcatgatgcaccagatcaggaagatggtgggcctggtggtggccatcgtgaagggctacgcccctgagagcgtgctggagaggtcctggggcacagagaaggtggatgtgcccaaggcccctggcctgggcctggtgctggagcgggtgcactttgagaagtacaaccagagatttggaaatgatggcctgcacgagcccctggactgggcccaggaggagggcaaggtggccgccttcaaggaggagcacatctaccccaccatcatcggcacagaaagagatgagaggtccatggcccagtggctgagcaccctgcccatccacaacttcagcgccacagccctgacagctgggggcactggagccaagtag

SEQ ID NO: 166623 - DNA, 1284 bp, Artificial Sequence
  Description of Artificial Sequence: Synthetic coding sequence
atgggcctgcagctgcgggccctgctgggcgccttcggccgctggaccctgcggctgggcccccggcccagctgcagccccaggatggctggaaatgctgagcccccacctgctggggccgcctgcccccaggaccggcgcagctgcagcggccgggccggcggggacagagtgtgggaggatggagagcacccagccaagaagctgaagtctggaggagatgaggagcggcgggagaagccacccaagaggaagatcgtgctgctgatggcctacagcggcaagggctaccacggcatgcagagaaatgtgggcagcagccagttcaagaccattgaagatgacctggtgtctgccctggtgcgcagcggctgcatccctgagaaccacggggaggacatgaggaagatgtccttccagagatgtgccaggacagacaagggcgtgtctgctgctggccaggtggtgtccctgaaggtgtggctgattgatgacatcctggagaagatcaacagccacctgcccagccacatccgcatcctgggcctgaagagggtgactggaggcttcaacagcaagaacagatgtgatgcccggacctactgctacctgctgcccacctttgcctttgcccacaaggacagagatgtgcaggatgagacctaccgcctgtctgctgagaccctgcagcaggtgaaccggctgctggcctgctacaagggcacccacaacttccacaacttcaccagccagaagggcccccaggaccccagcgcctgccgctacatcctggagatgtactgtgaggagccctttgtgcgggagggcctggagtttgctgtgatccgggtgaagggccagagcttcatgatgcaccagatcaggaagatggtgggcctggtggtggccatcgtgaagggctacgcccctgagagcgtgctggagaggtcctggggcacagagaaggtggatgtgcccaaggcccctggcctgggcctggtgctggagcgggtgcactttgagaagtacaaccagagatttggaaatgatggcctgcacgagcccctggactgggcccaggaggagggcaaggtggccgccttcaaggaggagcacatctaccccaccatcatcggcacagaaagagatgagaggtccatggcccagtggctgagcaccctgcccatccacaacttcagcgccacagccctgacagctgggggcactggagccaaggtgcccagccccctggagggctctgaaggagatggagacacagactag

SEQ ID NO: 166624 - DNA, 1200 bp, Artificial Sequence
  Description of Artificial Sequence: Synthetic coding sequence
atggctggaaatgctgagcccccacctgctggggccgcctgcccccaggaccggcgcagctgcagcggccgggccggcggggacagagtgtgggaggatggagagcacccagccaagaagctgaagtctggaggagatgaggagcggcgggagaagccacccaagaggaagatcgtgctgctgatggcctacagcggcaagggctaccacggcatgcagagaaatgtgggcagcagccagttcaagaccattgaagatgacctggtgtctgccctggtgcgcagcggctgcatccctgagaaccacggggaggacatgaggaagatgtccttccagagatgtgccaggacagacaagggcgtgtctgctgctggccaggtggtgtccctgaaggtgtggctgattgatgacatcctggagaagatcaacagccacctgcccagccacatccgcatcctgggcctgaagagggtgactggaggcttcaacagcaagaacagatgtgatgcccggacctactgctacctgctgcccacctttgcctttgcccacaaggacagagatgtgcaggatgagacctaccgcctgtctgctgagaccctgcagcaggtgaaccggctgctggcctgctacaagggcacccacaacttccacaacttcaccagccagaagggcccccaggaccccagcgcctgccgctacatcctggagatgtactgtgaggagccctttgtgcgggagggcctggagtttgctgtgatccgggtgaagggccagagcttcatgatgcaccagatcaggaagatggtgggcctggtggtggccatcgtgaagggctacgcccctgagagcgtgctggagaggtcctggggcacagagaaggtggatgtgcccaaggcccctggcctgggcctggtgctggagcgggtgcactttgagaagtacaaccagagatttggaaatgatggcctgcacgagcccctggactgggcccaggaggagggcaaggtggccgccttcaaggaggagcacatctaccccaccatcatcggcacagaaagagatgagaggtccatggcccagtggctgagcaccctgcccatccacaacttcagcgccacagccctgacagctgggggcactggagccaaggtgcccagccccctggagggctctgaaggagatggagacacagactag

SEQ ID NO: 166625 - DNA, 1200 bp, Artificial Sequence; identical to SEQ ID NO: 166624
  Description of Artificial Sequence: Synthetic coding sequence

SEQ ID NO: 166626 - DNA, 465 bp, Artificial Sequence
  Description of Artificial Sequence: Synthetic coding sequence
atggctggaaatgctgagcccccacctgctggggccgcctgcccccaggaccggcgcagctgcagcggccgggccggcggggacagagtgtgggaggatggagagcacccagccaagaagctgaagtctggaggagatgaggagcggcgggagaagccacccaagaggaagatcgtgctgctgatggcctacagcggcaagggctaccacggcatgcagagaaatgtgggcagcagccagttcaagaccattgaagatgacctggtgtctgccctggtgcgcagcggctgcatccctgagaaccacggggaggacatgaggaagatgtccttccagagatgtgccaggacagacaagggcgtgtctgctgctggccaggtggtgtccctgaaggtgtggctgattgatgacatcctggagaagatcaacagccacctgcccagccacatccgcatcctgggctag

SEQ ID NO: 166627 - DNA, 618 bp, Artificial Sequence
  Description of Artificial Sequence: Synthetic coding sequence
atgagcaagggccgggcagaggccgccgccggggctgctggcatcctgctgcgctacctgcaggagcagaaccggccctacagcagccaggatgtgtttggaaacctgcagcgggagcacggcctgggcaaggctgtggtggtgaagaccctggagcagctggcccagcagggcaagatcaaggagaagatgtatggcaagcagaagatctactttgctgaccaggaccagtttgacatggtgtctgatgctgacctgcaggtgctggatggcaagatcgtggccctgacagccaaggtgcagagcctgcagcagagctgccgctacatggaggccgagatgcagaaggagatccaggagctgaagaaggaatgtgccggctaccgggagcggctgaagaacatcaaggccgccaccaaccacgtgaccccagaggagaaggagcaggtgtaccgggagcggcagaagtactgcaaggagtggaggaagaggaagaggatggccacagagctgagtgatgccatcctggagggctaccccaagagcaagaagcagttctttgaggaggtgggcatcgagacagatgaggactacaacgtgaccctgcctgacccctag

SEQ ID NO: 166628 - DNA, 654 bp, Artificial Sequence
  Description of Artificial Sequence: Synthetic coding sequence
atgagcaagggccgggcagaggccgccgccggggctgctggcatcctgctgcgctacctgcaggagcagaaccggccctacagcagccaggatgtgtttggaaacctgcagcgggagcacggcctgggcaaggctgtggtggtgaagaccctggagcagctggcccagcagggcaagatcaaggagaagatgtatggcaagcagaagatctactttgctgaccaggaccagtttgacatggtgtctgatgctgacctgcaggtgctggatggcaagatcgtggccctgacagccaaggtgcagagcctgcagcagagctgccgctacatggaggccgagctgaaggagctgagcagcgccctgaccaccccagagatgcagaaggagatccaggagctgaagaaggaatgtgccggctaccgggagcggctgaagaacatcaaggccgccaccaaccacgtgaccccagaggagaaggagcaggtgtaccgggagcggcagaagtactgcaaggagtggaggaagaggaagaggatggccacagagctgagtgatgccatcctggagggctaccccaagagcaagaagcagttctttgaggaggtgggcatcgagacagatgaggactacaacgtgaccctgcctgacccctag

SEQ ID NO: 166629 - DNA, 465 bp, Artificial Sequence
  Description of Artificial Sequence: Synthetic coding sequence
atgtatggcaagcagaagatctactttgctgaccaggaccagtttgacatggtgtctgatgctgacctgcaggtgctggatggcaagatcgtggccctgacagccaaggtgcagagcctgcagcagagctgccgctacatggaggccgagctgaaggagctgagcagcgccctgaccaccccagagatgcagaaggagatccaggagctgaagaaggaatgtgccggctaccgggagcggctgaagaacatcaaggccgccaccaaccacgtgaccccagaggagaaggagcaggtgtaccgggagcggcagaagtactgcaaggagtggaggaagaggaagaggatggccacagagctgagtgatgccatcctggagggctaccccaagagcaagaagcagttctttgaggaggtgggcattgaaacagatgaggactacaacgtgaccctgcctgacccctag

SEQ ID NO: 166630 - DNA, 915 bp, Artificial Sequence
  Description of Artificial Sequence: Synthetic coding sequence
atgttttctgtgctgtcctatggccgcctggtggcccgggctgtgctgggcggcctgagccagacagacccccgggccggcggcggcggcggcggggactatggcctggtgacagctggctgcggctttgggaaggacttcaggaagggcctgctgaagaagggggcctgctatggagatgatgcctgctttgtggcccggcacaggtctgcagatgtgctgggcgtggctgatggagtgggcggctggagggactatggagtggaccccagccagttcagcggcaccctgatgaggacctgtgagcggctggtgaaggagggccgctttgtgcccagcaaccccatcggcatcctgaccaccagctactgtgagctgctgcagaacaaggtgcccctgctgggcagcagcacagcctgcatcgtggtgctggacaggaccagccaccggctgcacacagccaacctgggggacagcggcttcctggtggtgcggggcggggaggtggtgcacagaagtgatgagcagcagcactacttcaacacccccttccagctgagcatcgcccctcctgaggccgagggcgtggtgctgagtgacagcccagatgctgctgacagcaccagctttgatgtgcagctgggggacatcatcctgacagccacagatggcctgtttgacaacatgccagactacatgatcctgcaggagctgaagaagctgaagaacagcaactatgagagcatccagcagacagcccggagcattgctgagcaggcccacgagctggcctatgaccccaactacatgagcccctttgcccagtttgcctgtgacaatggcctgaatgtgcggggcggcaagccagatgacatcaccgtgctgctgagcatcgtggccgagtacacagactag

SEQ ID NO: 166631 - DNA, 1746 bp, Artificial Sequence
  Description of Artificial Sequence: Synthetic coding sequence
atggctgtgcggcaggccctgggccggggcctgcagctgggccgggccctgctgctgcgcttcaccgggaagccaggccgggcctacggcctgggccggcccggccctgctgctggctgtgtgcggggggagcggcccggctgggccgccggccctggagctgagcccaggagagtgggcctgggcctgcccaaccggctgcgcttcttccggcagagcgtggccggcctggccgcccggctgcagaggcagtttgtggtgcgggcctggggctgtgccggcccctgtggccgggctgtgttcctggccttcggcctgggcctgggcctgattgaggagaagcaggccgagagcagaagagctgtgtctgcctgccaggagatccaggccatcttcacccagaagagcaagccaggccctgaccccctggacacccggcggctgcagggcttccggctggaggagtacctgattggccagagcatcggcaagggctgcagcgctgctgtgtatgaggccaccatgcccaccctgccccagaacctggaggtgaccaagagcacaggcctgctgcccggccggggccctggcaccagcgcccctggagagggccaggagcgggcccctggggccccagccttccccctggccatcaagatgatgtggaacatctctgctggcagcagcagcgaggccatcctgaacaccatgagccaggagctggtgcctgccagccgggtggccctggccggggagtatggagctgtgacctacaggaagagcaagaggggccccaagcagctggccccccaccccaacatcatccgggtgctgcgggccttcaccagctctgtgcccctgctgcccggggccctggtggactacccagatgtgctgcccagccggctgcaccctgagggcctgggccacggccgcaccctcttcctggtgatgaagaactacccctgcaccctgcggcagtacctgtgtgtgaacacccccagcccccggctggccgccatgatgctgctgcagctgctggagggcgtggaccacctggtgcagcagggcatcgcccaccgggacctgaagagtgacaacatcctggtggagctggaccctgatggctgcccctggctggtgattgctgactttggctgctgcctggctgatgagagcatcggcctgcagctgcccttcagctcctggtacgtggaccggggcggcaatggctgcctgatggcccctgaggtgtccacagcccggcccggccccagggctgtgattgactacagcaaggcagatgcctgggccgtgggcgccatcgcctatgagatcttcggcctggtgaaccccttctacggccagggcaaggcccacctggagagccgcagctaccaggaggcccagctgcctgccctgcctgagagcgtgcccccagatgtgcggcagctggtgcgggccctgctgcagcgggaggccagcaagaggccttctgcccgggtggccgccaacgtgctgcacctgagcctgtggggcgagcacatcctggccctgaagaacctgaagctggacaagatggtgggctggctgctgcagcagagcgctgccaccctgctggccaaccggctgacagagaagtgctgcgtggagaccaagatgaagatgctgttcctggccaacctggagtgtgagaccctgtgccaggccgccctgctgctgtgctcctggagggctgccctgtag

SEQ ID NO: 166632 - DNA, 393 bp, Artificial Sequence
  Description of Artificial Sequence: Synthetic coding sequence
atggctgctgtgctgggcgccctgggcgccacccggcggctgctggccgccctgcggggccagagcctgggcctggccgccatgagcagcggcacccaccggctgacagctgaggagaggaaccaggccatcctggacctgaaggccgccggctggagcgagctgtctgaaagagatgccatctacaaggagttctccttccacaacttcaaccaggccttcggcttcatgagccgggtggccctgcaggccgagaagatgaaccaccaccctgagtggttcaacgtgtacaacaaggtgcagatcaccctgaccagccatgactgtggggagctgaccaagaaggatgtgaagctggccaagttcatcgagaaggctgctgcctctgtgtag

SEQ ID NO: 166633 - DNA, 393 bp, Artificial Sequence; identical to SEQ ID NO: 166632
  Description of Artificial Sequence: Synthetic coding sequence

SEQ ID NO: 166634 - DNA, 1041 bp, Artificial Sequence
  Description of Artificial Sequence: Synthetic coding sequence
atggccctgctgaaggtgaagtttgaccagaagaagagggtgaagctggcccagggcctgtggctgatgaactggttctctgtgctggccggcatcatcatcttcagcctgggcctcttcctgaagattgagctgaggaagagaagtgatgtgatgaacaacagcgagagccactttgtgcccaacagcctgattggcatgggcgtgctgagctgtgtgttcaacagcctggccggcaagatctgctatgatgccctggaccctgccaagtatgcccgctggaagccctggctgaagccctacctggccatctgtgtgctcttcaacatcatcctcttcctggtggccctgtgctgcttcctgctgcggggcagcctggagaacaccctgggccagggcctgaagaatggcatgaagtactacagagacacagacaccccaggccgctgcttcatgaagaagaccatcgacatgctgcagatcgagttcaagtgctgcggcaacaacggcttccgggactggtttgagatccagtggatcagcaaccgctacctggacttcagcagcaaggaggtgaaggaccgcatcaagagcaatgtggatggccgctacctggtggatggagtgcccttcagctgctgcaaccccagcagcccccggccctgcatccagtaccagatcaccaacaacagcgcccactacagctatgaccaccagacagaggagctgaacctgtgggtgcggggctgccgggccgccctgctgagctactacagcagcctgatgaacagcatgggcgtggtgaccctgctgatctggctgtttgaggtgaccatcaccatcggcctgcgctacctgcagaccagcctggatggagtgagcaaccctgaggagagcgagagcgagagccagggctggctgctggagaggtctgtgcctgagacctggaaggccttcctggagagcgtgaagaagctgggcaagggcaaccaggtggaggccgagggcgcagatgctggccaggcccctgaggccggctag

SEQ ID NO: 166635 - DNA, 1191 bp, Artificial Sequence
  Description of Artificial Sequence: Synthetic coding sequence
atgcccctgtttgagcccagggtcttcaccgctggcagcgaggagcgggtgacctgcctgccccccaagggcctgcctgagcccagcgtgtggtgggagcacgccggcgtgcggctgcccacccacggccgggtgtaccagaagggccacgagctggtgctggccaacattgctgagagtgatgctggggtgtacacctgccacgccgccaacctggccggccagaggcggcaggatgtgaacatcaccgtggccaccgtgcccagctggctgaagaagccccaggacagccagctggaggagggcaagccaggctacctggactgcctgacccaggccacccccaagcccaccgtggtgtggtacagaaaccagatgctgatcagcgaggacagcagatttgaggtgttcctggccaaggcccagggcctggaggagggcgtggccgagaccctggtgctggtgaagagcctgcagagcaaggatgagcagcagcagctggacttccggcgggagctggagatgtttgggaagctgaaccacgccaacgtggtgcggctgctgggcctgtgccgggaggccgagccccactacatggtgctggagtatgtggacctgggggacctgaagcagttcctgcgcatcagcaagagcaaggatgagaagctgaagagccagcccctgagcaccaagcagaaggtggccctgtgcacccaggtggccctgggcatggagcacctgagcaacaacagatttgtgcacaaggacctggccgccaggaactgcctggtgtctgcccagaggcaggtgaaggtgtctgccctgggcctgagcaaggatgtgtacaacagcgagtactaccacttccggcaggcctgggtgcccctgcgctggatgagccctgaggccatcctggagggggacttcagcaccaagagtgatgtgtgggccttcggcgtgctgatgtgggaggtgttcacccacggggagatgcctcatggaggccaggctgatgatgaggtgctggccgacctgcaggccggcaaggcccggctgccccagcctgagggctgccccagcaagctgtaccgcctgatgcagcgctgctgggccctgagccccaaggaccggcccagcttcagcgagatcgccagcgccctgggggacagcacagtggacagcaagccctag

SEQ ID NO: 166636 - DNA, 3093 bp, Artificial Sequence
  Description of Artificial Sequence: Synthetic coding sequence
atgggcgccgcccggggcagccctgcccggccccggcggctgcccctgctgtctgtgctgctgctgcccctgctgggcggcacccagacagccatcgtgttcatcaagcagcccagcagccaggatgccctgcagggcagaagagccctgctgcgctgtgaggtggaggcccctggccctgtgcacgtgtactggctgctggatggagcccctgtgcaggacacagaaagaagatttgcccagggcagcagcctgagctttgctgctgtggaccggctgcaggacagcggcaccttccagtgtgtggccagagatgatgtgactggagaggaggcccggagcgccaatgccagcttcaacatcaagtggattgaggccggccctgtggtgctgaagcacccagccagcgaggccgagatccagccccagacccaggtgaccctgcgctgccacattgatggccacccccggcccacctaccagtggttcagagatggcacccccctgagtgatggccagagcaaccacacagtgagcagcaaggagaggaacctgaccctgcggcctgctggccctgagcacagcggcctgtacagctgctgtgcccacagcgccttcggccaggcctgcagcagccagaacttcaccctgagcattgctgatgagagctttgcccgggtggtgctggccccccaggatgtggtggtggcccgctatgaggaggccatgttccactgccagttcagcgcccagcccccacccagcctgcagtggctgtttgaagatgagacccccatcaccaacagaagccggcccccccacctgcggcgggccaccgtgtttgccaacggcagcctgctgctgacccaggtgcggcccagaaatgccggcatctaccgctgcatcggccagggccagaggggcccccccatcatcctggaggccaccctgcacctggccgagattgaggacatgcccctgtttgagcccagggtcttcaccgctggcagcgaggagcgggtgacctgcctgccccccaagggcctgcctgagcccagcgtgtggtgggagcacgccggcgtgcggctgcccacccacggccgggtgtaccagaagggccacgagctggtgctggccaacattgctgagagtgatgctggggtgtacacctgccacgccgccaacctggccggccagaggcggcaggatgtgaacatcaccgtggccaccgtgcccagctggctgaagaagccccaggacagccagctggaggagggcaagccaggctacctggactgcctgacccaggccacccccaagcccaccgtggtgtggtacagaaaccagatgctgatcagcgaggacagcagatttgaggtgttcaagaatggcaccctgcgcatcaacagcgtggaggtgtatgatggcacctggtaccgctgcatgagcagcaccccagctggcagcattgaggcccaggcccgggtgcaggtgctggatggcagcagcctgcctgagtgggtgacagacaatgccggcaccctgcactttgcccgggtgaccagagatgatgctggcaactacacctgcatcgccagcaatggcccccagggccagatccgggcccacgtgcagctgactgtggccgtgttcatcaccttcaaggtggagcctgagaggaccaccgtgtaccagggccacacagccctgctgcagtgtgaggcccagggcgaccccaagcccctcatccagtggaagggcaaggaccgcatcctggaccccaccaagctgggccccaggatgcacatcttccagaatggcagcctggtgattcatgatgtggccccagaagattctggccgctacacctgcatcgccggcaacagctgcaacatcaagcacacagaggcccccctgtatgtggtggacaagcctgtgcctgaggagagcgagggccctggcagccccccaccctacaagatgatccagaccatcggcctgtctgtgggcgctgctgtggcctacatcatcgctgtgctgggcctgatgttctactgcaagaagcgctgcaaggccaagaggctgcagaagcagcctgagggggaggagcctgagatggagtgcctgaatggaggccccctgcagaatggccagcccagcgctgagatccaggaggaggtggccctgaccagcctgggcagcggccctgctgccaccaacaagaggcacagcaccagtgacaagatgcacttccccaggagcagcctgcagcccatcaccaccctgggcaagtcagaatttggagaggtgttcctggccaaggcccagggcctggaggagggcgtggccgagaccctggtgctggtgaagagcctgcagagcaaggatgagcagcagcagctggacttccggcgggagctggagatgtttgggaagctgaaccacgccaacgtggtgcggctgctgggcctgtgccgggaggccgagccccactacatggtgctggagtatgtggacctgggggacctgaagcagttcctgcgcatcagcaagagcaaggatgagaagctgaagagccagcccctgagcaccaagcagaaggtggccctgtgcacccaggtggccctgggcatggagcacctgagcaacaacagatttgtgcacaaggacctggccgccaggaactgcctggtgtctgcccagaggcaggtgaaggtgtctgccctgggcctgagcaaggatgtgtacaacagcgagtactaccacttccggcaggcctgggtgcccctgcgctggatgagccctgaggccatcctggagggggacttcagcaccaagagtgatgtgtgggccttcggcgtgctgatgtgggaggtgttcacccacggggagatgcctcatggaggccaggctgatgatgaggtgctggccgacctgcaggccggcaaggcccggctgccccagcctgagggctgccccagcaagctgtaccgcctgatgcagcgctgctgggccctgagccccaaggaccggcccagcttcagcgagatcgccagcgccctgggggacagcacagtggacagcaagccctag

SEQ ID NO: 166637 - DNA, 2823 bp, Artificial Sequence
  Description of Artificial Sequence: Synthetic coding sequence
atgggcgccgcccggggcagccctgcccggccccggcggctgcccctgctgtctgtgctgctgctgcccctgctgggcggcacccagacagccatcgtgttcatcaagcagcccagcagccaggatgccctgcagggcagaagagccctgctgcgctgtgaggtggaggcccctggccctgtgcacgtgtactggctgctggatggagcccctgtgcaggacacagaaagaagatttgcccagggcagcagcctgagctttgctgctgtggaccggctgcaggacagcggcaccttccagtgtgtggccagagatgatgtgactggagaggaggcccggagcgccaatgccagcttcaacatcaagtggattgaggccggccctgtggtgctgaagcacccagccagcgaggccgagatccagccccagacccaggtgaccctgcgctgccacattgatggccacccccggcccacctaccagtggttcagagatggcacccccctgagtgatggccagagcaaccacacagtgagcagcaaggagaggaacctgaccctgcggcctgctggccctgagcacagcggcctgtacagctgctgtgcccacagcgccttcggccaggcctgcagcagccagaacttcaccctgagcattgctgatgagagctttgcccgggtggtgctggccccccaggatgtggtggtggcccgctatgaggaggccatgttccactgccagttcagcgcccagcccccacccagcctgcagtggctgtttgaagatgagacccccatcaccaacagaagccggcccccccacctgcggcgggccaccgtgtttgccaacggcagcctgctgctgacccaggtgcggcccagaaatgccggcatctaccgctgcatcggccagggccagaggggcccccccatcatcctggaggccaccctgcacctggccgagattgaggacatgcccctgtttgagcccagggtcttcaccgctggcagcgaggagcgggtgacctgcctgccccccaagggcctgcctgagcccagcgtgtggtgggagcacgccggcgtgcggctgcccacccacggccgggtgtaccagaagggccacgagctggtgctggccaacattgctgagagtgatgctggggtgtacacctgccacgccgccaacctggccggccagaggcggcaggatgtgaacatcaccgtggccaacggcagcagcctgcctgagtgggtgacagacaatgccggcaccctgcactttgcccgggtgaccagagatgatgctggcaactacacctgcatcgccagcaatggcccccagggccagatccgggcccacgtgcagctgactgtggccgtgttcatcaccttcaaggtggagcctgagaggaccaccgtgtaccagggccacacagccctgctgcagtgtgaggcccagggcgaccccaagcccctcatccagtggaagggcaaggaccgcatcctggaccccaccaagctgggccccaggatgcacatcttccagaatggcagcctggtgattcatgatgtggccccagaagattctggccgctacacctgcatcgccggcaacagctgcaacatcaagcacacagaggcccccctgtatgtggtggacaagcctgtgcctgaggagagcgagggccctggcagccccccaccctacaagatgatccagaccatcggcctgtctgtgggcgctgctgtggcctacatcatcgctgtgctgggcctgatgttctactgcaagaagcgctgcaaggccaagaggctgcagaagcagcctgagggggaggagcctgagatggagtgcctgaatggaggccccctgcagaatggccagcccagcgctgagatccaggaggaggtggccctgaccagcctgggcagcggccctgctgccaccaacaagaggcacagcaccagtgacaagatgcacttccccaggagcagcctgcagcccatcaccaccctgggcaagtcagaatttggagaggtgttcctggccaaggcccagggcctggaggagggcgtggccgagaccctggtgctggtgaagagcctgcagagcaaggatgagcagcagcagctggacttccggcgggagctggagatgtttgggaagctgaaccacgccaacgtggtgcggctgctgggcctgtgccgggaggccgagccccactacatggtgctggagtatgtggacctgggggacctgaagcagttcctgcgcatcagcaagagcaaggatgagaagctgaagagccagcccctgagcaccaagcagaaggtggccctgtgcacccaggtggccctgggcatggagcacctgagcaacaacagatttgtgcacaaggacctggccgccaggaactgcctggtgtctgcccagaggcaggtgaaggtgtctgccctgggcctgagcaaggatgtgtacaacagcgagtactaccacttccggcaggcctgggtgcccctgcgctggatgagccctgaggccatcctggagggggacttcagcaccaagagtgatgtgtgggccttcggcgtgctgatgtgggaggtgttcacccacggggagatgcctcatggaggccaggctgatgatgaggtgctggccgacctgcaggccggcaaggcccggctgccccagcctgagggctgccccagcaagctgtaccgcctgatgcagcgctgctgggccctgagccccaaggaccggcccagcttcagcgagatcgccagcgccctgggggacagcacagtggacagcaagccctag

SEQ ID NO: 166638 - DNA, 3045 bp, Artificial Sequence
  Description of Artificial Sequence: Synthetic coding sequence
atgggcgccgcccggggcagccctgcccggccccggcggctgcccctgctgtctgtgctgctgctgcccctgctgggcggcacccagacagccatcgtgttcatcaagcagcccagcagccaggatgccctgcagggcagaagagccctgctgcgctgtgaggtggaggcccctggccctgtgcacgtgtactggctgctggatggagcccctgtgcaggacacagaaagaagatttgcccagggcagcagcctgagctttgctgctgtggaccggctgcaggacagcggcaccttccagtgtgtggccagagatgatgtgactggagaggaggcccggagcgccaatgccagcttcaacatcaagtggattgaggccggccctgtggtgctgaagcacccagccagcgaggccgagatccagccccagacccaggtgaccctgcgctgccacattgatggccacccccggcccacctaccagtggttcagagatggcacccccctgagtgatggccagagcaaccacacagtgagcagcaaggagaggaacctgaccctgcggcctgctggccctgagcacagcggcctgtacagctgctgtgcccacagcgccttcggccaggcctgcagcagccagaacttcaccctgagcattgctgatgagagctttgcccgggtggtgctggccccccaggatgtggtggtggcccgctatgaggaggccatgttccactgccagttcagcgcccagcccccacccagcctgcagtggctgtttgaagatgagacccccatcaccaacagaagccggcccccccacctgcggcgggccaccgtgtttgccaacggcagcctgctgctgacccaggtgcggcccagaaatgccggcatctaccgctgcatcggccagggccagaggggcccccccatcatcctggaggccaccctgcacctggccgagattgaggacatgcccctgtttgagcccagggtcttcaccgctggcagcgaggagcgggtgacctgcctgccccccaagggcctgcctgagcccagcgtgtggtgggagcacgccggcgtgcggctgcccacccacggccgggtgtaccagaagggccacgagctggtgctggccaacattgctgagagtgatgctggggtgtacacctgccacgccgccaacctggccggccagaggcggcaggatgtgaacatcaccgtggccaccgtgcccagctggctgaagaagccccaggacagccagctggaggagggcaagccaggctacctggactgcctgacccaggccacccccaagcccaccgtggtgtggtacagaaaccagatgctgatcagcgaggacagcagatttgaggtgttcaagaatggcaccctgcgcatcaacagcgtggaggtgtatgatggcacctggtaccgctgcatgagcagcaccccagctggcagcattgaggcccaggcccgggtgcaggtgctggagaagctgaagttcaccccaccaccccagccccagcagtgcatggagtttgacaaggaggccaccgtgccctgcagcgccaccggccgggagaagcccaccatcaagtgggagcgggcagatggcagcagcctgcctgagtgggtgacagacaatgccggcaccctgcactttgcccgggtgaccagagatgatgctggcaactacacctgcatcgccagcaatggcccccagggccagatccgggcccacgtgcagctgactgtggccgtgttcatcaccttcaaggtggagcctgagaggaccaccgtgtaccagggccacacagccctgctgcagtgtgaggcccagggcgaccccaagcccctcatccagtggaaggacaagcctgtgcctgaggagagcgagggccctggcagccccccaccctacaagatgatccagaccatcggcctgtctgtgggcgctgctgtggcctacatcatcgctgtgctgggcctgatgttctactgcaagaagcgctgcaaggccaagaggctgcagaagcagcctgagggggaggagcctgagatggagtgcctgaatggaggccccctgcagaatggccagcccagcgctgagatccaggaggaggtggccctgaccagcctgggcagcggccctgctgccaccaacaagaggcacagcaccagtgacaagatgcacttccccaggagcagcctgcagcccatcaccaccctgggcaagtcagaatttggagaggtgttcctggccaaggcccagggcctggaggagggcgtggccgagaccctggtgctggtgaagagcctgcagagcaaggatgagcagcagcagctggacttccggcgggagctggagatgtttgggaagctgaaccacgccaacgtggtgcggctgctgggcctgtgccgggaggccgagccccactacatggtgctggagtatgtggacctgggggacctgaagcagttcctgcgcatcagcaagagcaaggatgagaagctgaagagccagcccctgagcaccaagcagaaggtggccctgtgcacccaggtggccctgggcatggagcacctgagcaacaacagatttgtgcacaaggacctggccgccaggaactgcctggtgtctgcccagaggcaggtgaaggtgtctgccctgggcctgagcaaggatgtgtacaacagcgagtactaccacttccggcaggcctgggtgcccctgcgctggatgagccctgaggccatcctggagggggacttcagcaccaagagtgatgtgtgggccttcggcgtgctgatgtgggaggtgttcacccacggggagatgcctcatggaggccaggctgatgatgaggtgctggccgacctgcaggccggcaaggcccggctgccccagcctgagggctgccccagcaagctgtaccgcctgatgcagcgctgctgggccctgagccccaaggaccggcccagcttcagcgagatcgccagcgccctgggggacagcacagtggacagcaagccctag

SEQ ID NO: 166639 - DNA, 1212 bp, Artificial Sequence
  Description of Artificial Sequence: Synthetic coding sequence
atgggcagcttcctgagcggggagaagaggcccagcgcccccaccgtgggcagcgccatggagaagaaggagttccccaccccacctggccgggtgggccctggcacccagacagccatcgtgttcatcaagcagcccagcagccaggatgccctgcagggcagaagagccctgctgcgctgtgaggtggaggcccctggccctgtgcacgtgtactggctgctggatggagcccctgtgcaggacacagaaagaagatttgcccagggcagcagcctgagctttgctgctgtggaccggctgcaggacagcggcaccttccagtgtgtggccagagatgatgtgactggagaggaggcccggagcgccaatgccagcttcaacatcaagtggattgaggccggccctgtggtgctgaagcacccagccagcgaggccgagatccagccccagacccaggtgaccctgcgctgccacattgatggccacccccggcccacctaccagtggttcagagatggcacccccctgagtgatggccagagcaaccacacagtgagcagcaaggagaggaacctgaccctgcggcctgctggccctgagcacagcggcctgtacagctgctgtgcccacagcgccttcggccaggcctgcagcagccagaacttcaccctgagcattgctgatgagagctttgcccgggtggtgctggccccccaggatgtggtggtggcccgctatgaggaggccatgttccactgccagttcagcgcccagcccccacccagcctgcagtggctgtttgaagatgagacccccatcaccaacagaagccggcccccccacctgcggcgggccaccgtgtttgccaacggcagcctgctgctgacccaggtgcggcccagaaatgccggcatctaccgctgcatcggccagggccagaggggcccccccatcatcctggaggccaccctgcacctggccgagattgaggacatgcccctgtttgagcccagggtcttcaccgctggcagcgaggagcgggtgacctgcctgccccccatggccggcagcacccggcgggccacctcctggtgctggcccatcctgctgaaggtgatgctggtgtccaccccagccacccggcccacctggctggtgtctggggacaggatgagcaccagcctgtggcccctgtgccccccaggatag

SEQ ID NO: 166640 - DNA, 810 bp, Artificial Sequence
  Description of Artificial Sequence: Synthetic coding sequence
ttcagcgcccagcccccacccagcctgcagtggctgtttgaagatgagacccccatcaccaacagaagcaggcctccccacctgcggcgggccaccgtgtttgccaacggcagcctgctgctgacccaggtgcggcccagaaatgccggcatctaccgctgcatcggccagggccagaggggcccccccatcatcctggaggccaccctgcacctggccgagattgaggacatgcccctgtttgagcccagggtcttcaccgctggcagcgaggagcgggtgacctgcctgccccccaagggcctgcctgagcccagcgtgtggtgggagcacgccggcgtgcggctgcccacccacggccgggtgtaccagaagggccacgagctggtgctggccaacattgctgagagtgatgctggggtgtacacctgccacgccgccaacctggccggccagaggcggcaggatgtgaacatcaccgtggccagcgagcacctgtgcccagagggccagggcgaggtggagggcaacacaggcctgggcgtgatggaccggggcttccctgctgtgcccagctggctgaagaagccccaggacagccagctggaggagggcaagccaggctacctggactgcctgacccaggccacccccaagcccaccgtggtgtggtacagaaaccagatgctgatcagcgaggacagcagatttgaggtgttcaagaatggcaccctgcgcatcaacagcgtggaggtgtatgatggcacctggtaccgctgcatgagcagcaccccagctggcagcatctag

SEQ ID NO: 166641 - DNA, 444 bp, Artificial Sequence
  Description of Artificial Sequence: Synthetic coding sequence
atgggcgccaccggcctgggcttcctgctgtcctggaggcaggacaacctgaatggaacagactgccagggctgcaacatcctgtacttcagcgagaccaccggctccatgtgcagcgagctgagcctgaacagaggcctggaggcccggaggaagaaggacctgaaggacagcttcctgtggaggtatggcaaggtgggctgcatcagcctgcccctgcgggagatgacagcctggatcaaccccccccagatcagcgagatcttccagggctaccaccagagggtgcatggagcagatgccctgagcctgcagaccaacagcctgcggagccggctgagcagccagtgcctgggccagagcttcctgctgcggaccctggagcggggccggggcttccgggccctgggggacatctgtggccacgtgcatgaggaggactag

SEQ ID NO: 166642 - DNA, 216 bp, Artificial Sequence
  Description of Artificial Sequence: Synthetic coding sequence
atgggcgccaccggcctgggcttcctgctgtcctggaggcaggacaacctgaatggaacagactgccagggctgcaacatcctgtacttcagcgagaccaccggctccatgtgcagcgagctgagcctgaacagaggcctggaggcccggaggaagaaggacctgaaggacagcttcctgtggagagatggagtgagcccctgcctgccctgctag

SEQ ID NO: 166643 - DNA, 444 bp, Artificial Sequence; identical to SEQ ID NO: 166641
  Description of Artificial Sequence: Synthetic coding sequence

SEQ ID NO: 166644 - DNA, 216 bp, Artificial Sequence; identical to SEQ ID NO: 166642
  Description of Artificial Sequence: Synthetic coding sequence

SEQ ID NO: 166645 - DNA, 3561 bp, Artificial Sequence
  Description of Artificial Sequence: Synthetic coding sequence
atgtctgtggcctgtgtgctgaagaggaaggctgtgctgtggcaggacagcttcagcccccacctgaagcaccacccccaggagcccgccaaccccaacatgcctgtggtgctgaccagcggcaccggcagccaggcccagccccagcctgctgccaaccaggccctggccgccggcacccacagcagccctgtgcccggcagcattggagtggccggccgcagccaggatgatgccatggtggactacttcttccagaggcagcacggggagcagctgggcggcggcggcagcggcggcggcggctacaacaacagcaagcaccgctggcccaccggggacaacatccacgccgagcaccaggtgcgctccatggatgagctgaaccacgacttccaggccctggccctggagggccgggccatgggagagcagctgctgcccgggaagaagttctgggagacagatgagagcagcaaggatggccccaagggcatcttcctgggggaccagtggagggacagcgcctggggcaccagtgaccacagcgtgtcccagcccatcatggtgcagaggcggcccggccagagcttccacgtgaacagcgaggtgaacagcgtgctgagccccaggtctgagagcggcggcctgggcgtgtccatggtggagtatgtgctgagcagcagccctggggacagctgcctgaggaaaggaggcttcggccccagagatgctgacagtgatgaaaatgacaagggggagaagaagaacaagggcacctttgatggagacaagctgggggacctgaaggaggagggagatgtgatggacaagaccaacggcctgcctgtgcagaatggaattgatgctgatgtgaaggacttcagcaggaccccaggcaactgccagaacagcgccaatgaggtggacctgctgggccccaaccagaatggaagtgagggcctggcccagctgaccagcaccaatggagccaagcctgtggaggacttcagcaacatggagagccagagcgtgcccctggaccccatggagcacgtgggcatggagcccctgcagtttgactacagcggcacccaggtgcctgtggacagcgctgctgccaccgtgggcctgtttgactacaacagccagcagcagctgttccagaggcccaatgccctggccgtgcagcagctgacagctgcccagcagcagcagtatgccctggccgccgcccaccagccccacatcggcctggccccagctgcctttgtgcccaacccctacatcatctctgctgcccctcctggaacagacccctacacagctggcctggccgccgccgccaccctgggccctgctgtggtgccccaccagtactatggagtgaccccctggggcgtgtacccagccagcctcttccagcagcaggccgctgctgctgctgctgccaccaacagcgccaaccagcagaccaccccccaggcccagcagggccagcagcaggtgctgcggggcggggccagccagaggcccctgacccccaaccagaaccagcagggccagcagacagaccccctggtggccgctgctgctgtgaacagcgccctggccttcggccagggcctggccgccggcatgcctggctaccctgtgctggccccagctgcctactatgaccagacaggagccctggtggtgaatgctggggccagaaatggcctgggcgcccctgtgcggctggtggccccagcccctgtgatcatcagcagcagcgctgcccaggccgctgtggccgctgctgctgccagcgccaacggggctgctgggggcctggccggcaccaccaacggccccttccggcccctgggcacccagcagccccagccccagccccagcagcagcccaacaacaacctggccagcagcagcttctacggcaacaacagcctgaacagcaacagccagagcagcagcctcttcagccagggcagcgcccagcctgccaacaccagcctgggcttcggcagcagcagcagcctgggcgccaccctgggcagcgccctgggcggcttcggcacagctgtggccaacagcaacacaggcagcggcagccggcgggacagcctgaccggcagcagtgacctgtacaagaggaccagcagcagcctgacccccatcggccacagcttctacaacggcctgtccttcagcagcagccctggccctgtgggcatgcccctgcccagccagggccctggccacagccagaccccaccacccagcctgagcagccacggcagcagcagcagcctgaacctgggcggcctgaccaatggaagtggccgctacatctctgctgcccctggagctgaggccaagtacagaagtgccagcagcgccagcagcctcttcagccccagcagcaccctcttcagcagcagccggctgcgctatggcatgtctgatgtgatgcccagcggccgcagccggctgctggaggacttcaggaacaaccgctaccccaacctgcagctgcgggagattgctggccacatcatggagttcagccaggaccagcacggcagccgcttcatccagctgaagctggagcgggccaccccagctgagcggcagctggtgttcaatgagatcctgcaggccgcctaccagctgatggtggatgtgtttggaaactacgtgatccagaagttctttgaatttggcagcctggagcagaagctggccctggccgagcgcatccggggccacgtgctgagcctggccctgcagatgtatggctgcagggtcatccagaaggccctggagttcatccccagcgaccagcagaatgagatggtgcgggagctggatggccacgtgctgaagtgtgtgaaggaccagaatggaaaccacgtggtgcagaagtgcattgaatgtgtgcagccccagagcctgcagttcatcattgatgccttcaagggccaggtgtttgccctgagcacccacccctacggctgcagggtcatccagaggatcctggagcactgcctgcctgaccagaccctgcccatcctggaggagctgcaccagcacacagagcagctggtgcaggaccagtatggcaactacgtgatccagcacgtgctggagcacggccggcctgaggacaagagcaagatcgtggccgagatcagaggaaatgtgctggtgctgagccagcacaagtttgccagcaatgtggtggagaagtgtgtgacccacgccagcaggacagaaagagctgtgctgattgatgaggtgtgcaccatgaatgatggcccccacagcgccctgtacaccatgatgaaggaccagtatgccaactacgtggtgcagaagatgattgatgtggccgagcccggccagaggaagatcgtgatgcacaagatccggccccacatcgccaccctgaggaagtacacctacggcaagcacatcctggccaagctggagaagtactacatgaagaatggagtggacctgggccccatctgtggccccccaaatggcatcatctag

SEQ ID NO: 166646 - DNA, 2781 bp, Artificial Sequence
  Description of Artificial Sequence: Synthetic coding sequence
atgtctgtggcctgtgtgctgaagaggaaggctgtgctgtggcaggacagcttcagcccccacctgaagcaccacccccaggagcccgccaaccccaacatgcctgtggtgctgaccagcggcaccggcagccaggcccagccccagcctgctgccaaccaggccctggccgccggcacccacagcagccctgtgcccggcagcattggagtggccggccgcagccaggatgatgccatggtggactacttcttccagaggcagcacggggagcagctgggcggcggcggcagcggcggcggcggctacaacaacagcaagcaccgctggcccaccaccgtgggcctgtttgactacaacagccagcagcagctgttccagaggcccaatgccctggccgtgcagcagctgacagctgcccagcagcagcagtatgccctggccgccgcccaccagccccacatcggcctggccccagctgcctttgtgcccaacccctacatcatctctgctgcccctcctggaacagacccctacacagctggcctggccgccgccgccaccctgggccctgctgtggtgccccaccagtactatggagtgaccccctggggcgtgtacccagccagcctcttccagcagcaggccgctgctgctgctgctgccaccaacagcgccaaccagcagaccaccccccaggcccagcagggccagcagcaggtgctgcggggcggggccagccagaggcccctgacccccaaccagaaccagcagggccagcagacagaccccctggtggccgctgctgctgtgaacagcgccctggccttcggccagggcctggccgccggcatgcctggctaccctgtgctggccccagctgcctactatgaccagacaggagccctggtggtgaatgctggggccagaaatggcctgggcgcccctgtgcggctggtggccccagcccctgtgatcatcagcagcagcgctgcccaggccgctgtggccgctgctgctgccagcgccaacggggctgctgggggcctggccggcaccaccaacggccccttccggcccctgggcacccagcagccccagccccagccccagcagcagcccaacaacaacctggccagcagcagcttctacggcaacaacagcctgaacagcaacagccagagcagcagcctcttcagccagggcagcgcccagcctgccaacaccagcctgggcttcggcagcagcagcagcctgggcgccaccctgggcagcgccctgggcggcttcggcacagctgtggccaacagcaacacaggcagcggcagccggcgggacagcctgaccggcagcagtgacctgtacaagaggaccagcagcagcctgacccccatcggccacagcttctacaacggcctgtccttcagcagcagccctggccctgtgggcatgcccctgcccagccagggccctggccacagccagaccccaccacccagcctgagcagccacggcagcagcagcagcctgaacctgggcggcctgaccaatggaagtggccgctacatctctgctgcccctggagctgaggccaagtacagaagtgccagcagcgccagcagcctcttcagccccagcagcaccctcttcagcagcagccggctgcgctatggcatgtctgatgtgatgcccagcggccgcagccggctgctggaggacttcaggaacaaccgctaccccaacctgcagctgcgggagattgctggccacatcatggagttcagccaggaccagcacggcagccgcttcatccagctgaagctggagcgggccaccccagctgagcggcagctggtgttcaatgagatcctgcaggccgcctaccagctgatggtggatgtgtttggaaactacgtgatccagaagttctttgaatttggcagcctggagcagaagctggccctggccgagcgcatccggggccacgtgctgagcctggccctgcagatgtatggctgcagggtcatccagaaggccctggagttcatccccagcgaccagcaggtgatcaatgagatggtgcgggagctggatggccacgtgctgaagtgtgtgaaggaccagaatggaaaccacgtggtgcagaagtgcattgaatgtgtgcagccccagagcctgcagttcatcattgatgccttcaagggccaggtgtttgccctgagcacccacccctacggctgcagggtcatccagaggatcctggagcactgcctgcctgaccagaccctgcccatcctggaggagctgcaccagcacacagagcagctggtgcaggaccagtatggcaactacgtgatccagcacgtgctggagcacggccggcctgaggacaagagcaagatcgtggccgagatcagaggaaatgtgctggtgctgagccagcacaagtttgccagcaatgtggtggagaagtgtgtgacccacgccagcaggacagaaagagctgtgctgattgatgaggtgtgcaccatgaatgatggcccccacagcgccctgtacaccatgatgaaggaccagtatgccaactacgtggtgcagaagatgattgatgtggccgagcccggccagaggaagatcgtgatgcacaagatccggccccacatcgccaccctgaggaagtacacctacggcaagcacatcctggccaagctggagaagtactacatgaagaatggagtggacctgggccccatctgtggccccccaaatggcatcatctag

SEQ ID NO: 166647 - DNA, 3135 bp, Artificial Sequence
  Description of Artificial Sequence: Synthetic coding sequence
atgtctgtggcctgtgtgctgaagaggaaggctgtgctgtggcaggacagcttcagcccccacctgaagcaccacccccaggagcccgccaaccccaacatgcctgtggtgctgaccagcggcaccggcagccaggcccagccccagcctgctgccaaccaggccctggccgccggcacccacagcagccctgtgcccggcagcattggagtggccggccgcagccaggatgatgccatggtggactacttcttccagaggcagcacggggagcagctgggcggcggcggcagcggcggcggcggctacaacaacagcaagcaccgctggcccaccggggacaacatccacgccgagcaccaggtgcgctccatggatgagctgaaccacgacttccaggccctggccctggagggccgggccatgggagagggccccagagatgctgacagtgatgaaaatgacaagggggagaagaagaacaagggcacctttgatggagacaagctgggggacctgaaggaggagggagatgtgatggacaagaccaacggcctgcctgtgcagaatggaattgatgctgatgtgaaggacttcagcaggaccccaggcaactgccagaacagcgccaatgaggtggacctgctgggccccaaccagaatggaagtgagggcctggcccagctgaccagcaccaatggagccaagcctgtggaggacttcagcaacatggagagccagagcgtgcccctggaccccatggagcacgtgggcatggagcccctgcagtttgactacagcggcacccaggtgcctgtggacagcgctgctgccaccgtgggcctgtttgactacaacagccagcagcagctgttccagaggcccaatgccctggccgtgcagcagctgacagctgcccagcagcagcagtatgccctggccgccgcccaccagccccacatcggcctggccccagctgcctttgtgcccaacccctacatcatctctgctgcccctcctggaacagacccctacacagctggcctggccgccgccgccaccctgggccctgctgtggtgccccaccagtactatggagtgaccccctggggcgtgtacccagccagcctcttccagcagcaggccgctgctgctgctgctgccaccaacagcgccaaccagcagaccaccccccaggcccagcagggccagcagcaggtgctgcggggcggggccagccagaggcccctgacccccaaccagaaccagcagggccagcagacagaccccctggtggccgctgctgctgtgaacagcgccctggccttcggccagggcctggccgccggcatgcctgctgtggccgctgctgctgccagcgccaacggggctgctgggggcctggccggcaccaccaacggccccttccggcccctgggcacccagcagccccagccccagccccagcagcagcccaacaacaacctggccagcagcagcttctacggcaacaacagcctgaacagcaacagccagagcagcagcctcttcagccagggcagcgcccagcctgccaacaccagcctgggcttcggcagcagcagcagcctgggcgccaccctgggcagcgccctgggcggcttcggcacagctgtggccaacagcaacacaggcagcggcagccggcgggacagcctgaccggcagcagtgacctgtacaagaggaccagcagcagcctgacccccatcggccacagcttctacaacggcctgtccttcagcagcagccctggccctgtgggcatgcccctgcccagccagggccctggccacagccagaccccaccacccagcctgagcagccacggcagcagcagcagcctgaacctgggcggcctgaccaatggaagtggccgctacatctctgctgcccctggagctgaggccaagtacagaagtgccagcagcgccagcagcctcttcagccccagcagcaccctcttcagcagcagccggctgcgctatggcatgtctgatgtgatgcccagcggccgcagccggctgctggaggacttcaggaacaaccgctaccccaacctgcagctgcgggagattgctggccacatcatggagttcagccaggaccagcacggcagccgcttcatccagctgaagctggagcgggccaccccagctgagcggcagctggtgttcaatgagatcctgcaggccgcctaccagctgatggtggatgtgtttggaaactacgtgatccagaagttctttgaatttggcagcctggagcagaagctggccctggccgagcgcatccggggccacgtgctgagcctggccctgcagatgtatggctgcagggtcatccagaaggccctggagttcatccccagcgaccagcaggtgatcaatgagatggtgcgggagctggatggccacgtgctgaagtgtgtgaaggaccagaatggaaaccacgtggtgcagaagtgcattgaatgtgtgcagccccagagcctgcagttcatcattgatgccttcaagggccaggtgtttgccctgagcacccacccctacggctgcagggtcatccagaggatcctggagcactgcctgcctgaccagaccctgcccatcctggaggagctgcaccagcacacagagcagctggtgcaggaccagtatggcaactacgtgatccagcacgtgctggagcacggccggcctgaggacaagagcaagatcgtggccgagatcagaggaaatgtgctggtgctgagccagcacaagtttgccagcaatgtggtggagaagtgtgtgacccacgccagcaggacagaaagagctgtgctgattgatgaggtgtgcaccatgaatgatggcccccacagcgccctgtacaccatgatgaaggaccagtatgccaactacgtggtgcagaagatgattgatgtggccgagcccggccagaggaagatcgtgatgcacaagatccggccccacatcgccaccctgaggaagtacacctacggcaagcacatcctggccaagctggagaagtactacatgaagaatggagtggacctgggccccatctgtggccccccaaatggcatcatctag

SEQ ID NO: 166648 - DNA, 3567 bp, Artificial Sequence
  Description of Artificial Sequence: Synthetic coding sequence
atgtctgtggcctgtgtgctgaagaggaaggctgtgctgtggcaggacagcttcagcccccacctgaagcaccacccccaggagcccgccaaccccaacatgcctgtggtgctgaccagcggcaccggcagccaggcccagccccagcctgctgccaaccaggccctggccgccggcacccacagcagccctgtgcccggcagcattggagtggccggccgcagccaggatgatgccatggtggactacttcttccagaggcagcacggggagcagctgggcggcggcggcagcggcggcggcggctacaacaacagcaagcaccgctggcccaccggggacaacatccacgccgagcaccaggtgcgctccatggatgagctgaaccacgacttccaggccctggccctggagggccgggccatgggagagcagctgctgcccgggaagaagttctgggagacagatgagagcagcaaggatggccccaagggcatcttcctgggggaccagtggagggacagcgcctggggcaccagtgaccacagcgtgtcccagcccatcatggtgcagaggcggcccggccagagcttccacgtgaacagcgaggtgaacagcgtgctgagccccaggtctgagagcggcggcctgggcgtgtccatggtggagtatgtgctgagcagcagccctggggacagctgcctgaggaaaggaggcttcggccccagagatgctgacagtgatgaaaatgacaagggggagaagaagaacaagggcacctttgatggagacaagctgggggacctgaaggaggagggagatgtgatggacaagaccaacggcctgcctgtgcagaatggaattgatgctgatgtgaaggacttcagcaggaccccaggcaactgccagaacagcgccaatgaggtggacctgctgggccccaaccagaatggaagtgagggcctggcccagctgaccagcaccaatggagccaagcctgtggaggacttcagcaacatggagagccagagcgtgcccctggaccccatggagcacgtgggcatggagcccctgcagtttgactacagcggcacccaggtgcctgtggacagcgctgctgccaccgtgggcctgtttgactacaacagccagcagcagctgttccagaggcccaatgccctggccgtgcagcagctgacagctgcccagcagcagcagtatgccctggccgccgcccaccagccccacatcggcctggccccagctgcctttgtgcccaacccctacatcatctctgctgcccctcctggaacagacccctacacagctggcctggccgccgccgccaccctgggccctgctgtggtgccccaccagtactatggagtgaccccctggggcgtgtacccagccagcctcttccagcagcaggccgctgctgctgctgctgccaccaacagcgccaaccagcagaccaccccccaggcccagcagggccagcagcaggtgctgcggggcggggccagccagaggcccctgacccccaaccagaaccagcagggccagcagacagaccccctggtggccgctgctgctgtgaacagcgccctggccttcggccagggcctggccgccggcatgcctggctaccctgtgctggccccagctgcctactatgaccagacaggagccctggtggtgaatgctggggccagaaatggcctgggcgcccctgtgcggctggtggccccagcccctgtgatcatcagcagcagcgctgcccaggccgctgtggccgctgctgctgccagcgccaacggggctgctgggggcctggccggcaccaccaacggccccttccggcccctgggcacccagcagccccagccccagccccagcagcagcccaacaacaacctggccagcagcagcttctacggcaacaacagcctgaacagcaacagccagagcagcagcctcttcagccagggcagcgcccagcctgccaacaccagcctgggcttcggcagcagcagcagcctgggcgccaccctgggcagcgccctgggcggcttcggcacagctgtggccaacagcaacacaggcagcggcagccggcgggacagcctgaccggcagcagtgacctgtacaagaggaccagcagcagcctgacccccatcggccacagcttctacaacggcctgtccttcagcagcagccctggccctgtgggcatgcccctgcccagccagggccctggccacagccagaccccaccacccagcctgagcagccacggcagcagcagcagcctgaacctgggcggcctgaccaatggaagtggccgctacatctctgctgcccctggagctgaggccaagtacagaagtgccagcagcgccagcagcctcttcagccccagcagcaccctcttcagcagcagccggctgcgctatggcatgtctgatgtgatgcccagcggccgcagccggctgctggaggacttcaggaacaaccgctaccccaacctgcagctgcgggagattgctggccacatcatggagttcagccaggaccagcacggcagccgcttcatccagctgaagctggagcgggccaccccagctgagcggcagctggtgttcaatgagatcctgcaggccgcctaccagctgatggtggatgtgtttggaaactacgtgatccagaagttctttgaatttggcagcctggagcagaagctggccctggccgagcgcatccggggccacgtgctgagcctggccctgcagatgtatggctgcagggtcatccagaaggccctggagttcatccccagcgaccagcaggtgatcaatgagatggtgcgggagctggatggccacgtgctgaagtgtgtgaaggaccagaatggaaaccacgtggtgcagaagtgcattgaatgtgtgcagccccagagcctgcagttcatcattgatgccttcaagggccaggtgtttgccctgagcacccacccctacggctgcagggtcatccagaggatcctggagcactgcctgcctgaccagaccctgcccatcctggaggagctgcaccagcacacagagcagctggtgcaggaccagtatggcaactacgtgatccagcacgtgctggagcacggccggcctgaggacaagagcaagatcgtggccgagatcagaggaaatgtgctggtgctgagccagcacaagtttgccagcaatgtggtggagaagtgtgtgacccacgccagcaggacagaaagagctgtgctgattgatgaggtgtgcaccatgaatgatggcccccacagcgccctgtacaccatgatgaaggaccagtatgccaactacgtggtgcagaagatgattgatgtggccgagcccggccagaggaagatcgtgatgcacaagatccggccccacatcgccaccctgaggaagtacacctacggcaagcacatcctggccaagctggagaagtactacatgaagaatggagtggacctgggccccatctgtggccccccaaatggcatcatctag

SEQ ID NO: 166649 - DNA, 3489 bp, Artificial Sequence
  Description of Artificial Sequence: Synthetic coding sequence
atgtctgtggcctgtgtgctgaagaggaaggctgtgctgtggcaggacagcttcagcccccacctgaagcaccacccccaggagcccgccaaccccaacatgcctgtggtgctgaccagcggcaccggcagccaggcccagccccagcctgctgccaaccaggccctggccgccggcacccacagcagccctgtgcccggcagcattggagtggccggccgcagccaggatgatgccatggtggactacttcttccagaggcagcacggggagcagctgggcggcggcggcagcggcggcggcggctacaacaacagcaagcaccgctggcccaccggggacaacatccacgccgagcaccaggtgcgctccatggatgagctgaaccacgacttccaggccctggccctggagggccgggccatgggagagcagctgctgcccgggaagaagttctgggagacagatgagagcagcaaggatggccccaagggcatcttcctgggggaccagtggagggacagcgcctggggcaccagtgaccacagcgtgtcccagcccatcatggtgcagaggcggcccggccagagcttccacgtgaacagcgaggtgaacagcgtgctgagccccaggtctgagagcggcggcctgggcgtgtccatggtggagtatgtgctgagcagcagccctggggacagctgcctgaggaaaggaggcttcggccccagagatgctgacagtgatgaaaatgacaagggggagaagaagaacaagggcacctttgatggagacaagctgggggacctgaaggaggagggagatgtgatggacaagaccaacggcctgcctgtgcagaatggaattgatgctgatgtgaaggacttcagcaggaccccaggcaactgccagaacagcgccaatgaggtggacctgctgggccccaaccagaatggaagtgagggcctggcccagctgaccagcaccaatggagccaagcctgtggaggacttcagcaacatggagagccagagcgtgcccctggaccccatggagcacgtgggcatggagcccctgcagtttgactacagcggcacccaggtgcctgtggacagcgctgctgccaccgtgggcctgtttgactacaacagccagcagcagctgttccagaggcccaatgccctggccgtgcagcagctgacagctgcccagcagcagcagtatgccctggccgccgcccaccagccccacatcgccggcctggccccagctgcctttgtgcccaacccctacatcatctctgctgcccctcctggaacagacccctacacagctggcctggccgctgctgccaccctgggccctgctgtggtgccccaccagtactacggcgtgaccccctggggcgtgtacccagccagcctcttccagcagcaggccgctgctgctgctgctgccaccaacagcgccaaccagcagaccaccccccaggcccagcagggccagcagcaggtgctgcggggcggggccagccagaggcccctgacccccaaccagaaccagcagggccagcagacagaccccctggtggccgctgctgctgtgaacagcgccctggccttcggccagggcctggccgccggcatgcctggctaccctgtgctggccccagctgcctactatgaccagacaggagccctggtggtgaatgctggggccagaaatggcctgggcgcccctgtgcggctggtggccccagcccctgtgatcatcagcagcagcgctgcccaggccggcacccagcagccccagccccagccccagcagcagcccaacaacaacctggccagcagcagcttctacggcaacaacagcctgaacagcaacagccagagcagcagcctcttcagccagggcagcgcccagcctgccaacaccagcctgggcttcggcagcagcagcagcctgggcgccaccctgggcagcgccctgggcggcttcggcacagctgtggccaacagcaacacaggcagcggcagccggcgggacagcctgaccggcagcagtgacctgtacaagaggaccagcagcagcctgacccccatcggccacagcttctacaacggcctgtccttcagcagcagccctggccctgtgggcatgcccctgcccagccagggccctggccacagccagaccccaccacccagcctgagcagccacggcagcagcagcagcctgaacctgggcggcctgaccaatggaagtggccgctacatctctgctgcccctggagctgaggccaagtacagaagtgccagcagcgccagcagcctcttcagccccagcagcaccctcttcagcagcagccggctgcgctatggcatgtctgatgtgatgcccagcggccgcagccggctgctggaggacttcaggaacaaccgctaccccaacctgcagctgcgggagattgctggccacatcatggagttcagccaggaccagcacggcagccgcttcatccagctgaagctggagcgggccaccccagctgagcggcagctggtgttcaatgagatcctgcaggccgcctaccagctgatggtggatgtgtttggaaactacgtgatccagaagttctttgaatttggcagcctggagcagaagctggccctggccgagcgcatccggggccacgtgctgagcctggccctgcagatgtatggctgcagggtcatccagaaggccctggagttcatccccagcgaccagcaggtgatcaatgagatggtgcgggagctggatggccacgtgctgaagtgtgtgaaggaccagaatggaaaccacgtggtgcagaagtgcattgaatgtgtgcagccccagagcctgcagttcatcattgatgccttcaagggccaggtgtttgccctgagcacccacccctacggctgcagggtcatccagaggatcctggagcactgcctgcctgaccagaccctgcccatcctggaggagctgcaccagcacacagagcagctggtgcaggaccagtatggcaactacgtgatccagcacgtgctggagcacggccggcctgaggacaagagcaagatcgtggccgagatcagaggaaatgtgctggtgctgagccagcacaagtttgccagcaatgtggtggagaagtgtgtgacccacgccagcaggacagaaagagctgtgctgattgatgaggtgtgcaccatgaatgatggcccccacagcgccctgtacaccatgatgaaggaccagtatgccaactacgtggtgcagaagatgattgatgtggccgagcccggccagaggaagatcgtgatgcacaagatccggccccacatcgccaccctgaggaagtacacctacggcaagcacatcctggccaagctggagaagtactacatgaagaatggagtggacctgggccccatctgtggccccccaaatggcatcatctag

SEQ ID NO: 166650 - DNA, 291 bp, Artificial Sequence
  Description of Artificial Sequence: Synthetic coding sequence
atgtctgtggcctgtgtgctgaagaggaaggctgtgctgtggcaggacagcttcagcccccacctgaagcaccacccccaggagcccgccaaccccaacatgcctgtggtgctgaccagcggcaccggcagccaggcccagccccagcctgctgccaaccaggccctggccgccggcacccacagcagccctgtgcccggcagcattggagtggccggccgcagccaggatgatgccatggtggactacttcttccagaggcagcacggggagcagctgggcggcggctag

SEQ ID NO: 166651 - DNA, 1551 bp, Artificial Sequence
  Description of Artificial Sequence: Synthetic coding sequence
atgtctgtggcctgtgtgctgaagaggaaggctgtgctgtggcaggacagcttcagcccccacctgaagcaccacccccaggagcccgccaaccccaacatgcctgtggtgctgaccagcggcaccggcagccaggcccagccccagcctgctgccaaccaggccctggccgccggcacccacagcagccctgtgcccggcagcattggagtggccggccgcagccaggatgatgccatggtggactacttcttccagaggcagcacggggagcagctgggcggcggcggcagcggcggcggcggctacaacaacagcaagcaccgctggcccaccggggacaacatccacgccgagcaccaggtgcgctccatggatgagctgaaccacgacttccaggccctggccctggagggccgggccatgggagagcagctgctgcccgggaagaagttctgggagacagatgagagcagcaaggatggccccaagggcatcttcctgggggaccagtggagggacagcgcctggggcaccagtgaccacagcgtgtcccagcccatcatggtgcagaggcggcccggccagagcttccacgtgaacagcgaggtgaacagcgtgctgagccccaggtctgagagcggcggcctgggcgtgtccatggtggagtatgtgctgagcagcagccctggggacagctgcctgaggaaaggaggcttcggccccagagatgctgacagtgatgaaaatgacaagggggagaagaagaacaagggcacctttgatggagacaagctgggggacctgaaggaggagggagatgtgatggacaagaccaacggcctgcctgtgcagaatggaattgatgctgatgtgaaggacttcagcaggaccccaggcaactgccagaacagcgccaatgaggtggacctgctgggccccaaccagaatggaagtgagggcctggcccagctgaccagcaccaatggagccaagcctgtggaggacttcagcaacatggagagccagagcgtgcccctggaccccatggagcacgtgggcatggagcccctgcagtttgactacagcggcacccaggtgcctgtggacagcgctgctgccaccgtgggcctgtttgactacaacagccagcagcagctgttccagaggcccaatgccctggccgtgcagcagctgacagctgcccagcagcagcagtatgccctggccgccgcccaccagccccacatcggcctggccccagctgcctttgtgcccaacccctacatcatctctgctgcccctcctggaacagacccctacacagctggcctggccgccgccgccaccctgggccctgctgtggtgccccaccagtactatggagtgaccccctggggcgtgtacccagccagcctcttccagcagcaggccgctgctgctgctgctgccaccaacagcgccaaccagcagaccaccccccaggcccagcagggccagcagcagacagagttctgcttctgctgccccggctggagcgccatggtgtag

SEQ ID NO: 166652 - DNA, 2964 bp, Artificial Sequence
  Description of Artificial Sequence: Synthetic coding sequence
atgaaccacgacttccaggccctggccctggagagccggggcatgggagagctgctgcccaccaagaagttctgggagccagatgacagcaccaaggatggccagaagggcatcttcctgggagatgatgagtggagggagacagcctggggcgccagccaccacagcatgagccagcccatcatggtgcagaggagaagtggccagggcttccacggcaacagcgaggtgaatgccatcctgagccccaggtctgagagcggcggcctgggcgtgtccatggtggagtatgtgctgagcagcagccctgctgacaagctggacagccgcttcagaaaaggaaactttggcaccagagatgctgagacagatggccctgagaagggggaccagaagggcaaggccagcccctttgaggaggaccagaacagagacctgaagcagggagatgatgatgacagcaagatcaatggccggggcctgcccaacggcatggatgctgactgcaaggacttcaacagaacacctggcagccggcaggccagccccacagaggtggtggagcggctgggccccaacaccaaccccagcgagggcctgggccccctgcccaaccccacagccaacaagcccctggtggaggagttcagcaaccctgagacccagaacctggatgccatggagcaggtgggcctggagagcctgcagtttgactacccaggcaaccaggtgcccatggacagcagcggggccaccgtgggcctgtttgactacaacagccagcagcagctgttccagaggaccaatgccctgactgtgcagcagctgacagctgcccagcagcagcagtatgccctggccgccgcccagcagccccacatcgccggggtcttctctgctggcctggccccagctgcctttgtgcccaacccctacatcatctctgctgcccctcctggaacagacccctacacagctgctggcctggccgccgccgccaccctggccggccctgctgtggtgcccccccagtactacggcgtgccctggggcgtgtacccagccaacctcttccagcagcaggccgctgctgctgccaacaacacagccagccagcaggccgccagccaggcccagcccggccagcagcaggtgctgcgggccggggccggccagaggcccctgacccccaaccagggccagcagggccagcaggccgagagcctggccgctgctgctgctgccaaccccaccctggccttcggccagggcctggccaccggcatgcctggctaccaggtgctggcccccacagcctactatgaccagacaggagccctggtggtgggccctggggccaggacaggcctgggcgcccctgtgcggctgatggcccccacccctgtgctgatcagcagcgctgctgcccaggccgctgctgctgctgctgctgggggcacagccagcagcctgaccggcagcaccaacggcctcttccggcccatcggcacccagcccccccagcagcagcagcagcagcccagcaccaacctgcagagcaacagcttctacggcagcagcagcctgaccaacagcagccagagcagcagcctcttcagccacggccctggccagcccggcagcaccagcctgggctttggaagtggcaacagcctgggcgccgccatcggcagcgccctgagcggcttcggcagcagcggcggcctgaccaacggcagcggccgctacatctctgctgcccctggagctgaggccaagtaccgcagcgccagcagcaccagcagcctcttcagcagcagcagccagctgttcccccccagccggctgcgctacaacagaagtgacatcatgcccagcggccgcagccggctgctggaggacttcaggaacaaccgcttccccaacctgcagctgcgggacctgattggccacatcgtggagttcagccaggaccagcacggcagccgcttcatccagcagaagctggagcgggccaccccagctgagcggcagatggtgttcaatgagatcctgcaggccgcctaccagctgatgacagatgtgtttggaaattatgtgatccagaagttctttgaatttggcagcctggaccagaagctggccctggccacccgcatccggggccacgtgctgcccctggccctgcagatgtatggctgcagggtcatccagaaggccctggagagcatcagcagtgaccagcaggtgatcagcgagatggtgaaggagctggatggccacgtgctgaagtgtgtgaaggaccagaatggaaatcatgtggtgcagaagtgcattgaatgtgtgcagccccagagcctgcagttcatcattgatgccttcaagggccaggtgtttgtgctgagcacccacccctacggctgcagggtcatccagaggatcctggagcactgcacagctgagcagaccctgcccatcctggaggagctgcaccagcacacagagcagctggtgcaggaccagtatggcaactacgtgatccagcacgtgctggagcacggccggcctgaggacaagagcaagatcgtgtctgagatccggggcaaggtgctggccctgagccagcacaagtttgccagcaatgtggtggagaagtgtgtgacccacgccagcagagctgagcgggccctgctgattgatgaggtgtgctgccagaatgatggcccccacagcgccctgtacaccatgatgaaggaccagtatgccaactacgtggtgcagaagatgattgacatggccgagcccgcccagaggaagatcatcatgcacaagatccggccccacatcaccaccctgaggaagtacacctacggcaagcacatcctggccaagctggagaagtactacctgaagaacagcccagacctgggccccatcggcggcccccccaacggcatgctgtag

SEQ ID NO: 166653 - DNA, 3195 bp, Artificial Sequence
  Description of Artificial Sequence: Synthetic coding sequence
atgaaccacgacttccaggccctggccctggagagccggggcatgggagagctgctgcccaccaagaagttctgggagccagatgacagcaccaaggatggccagaagggcatcttcctgggagatgatgagtggagggagacagcctggggcgccagccaccacagcatgagccagcccatcatggtgcagaggagaagtggccagggcttccacggcaacagcgaggtgaatgccatcctgagccccaggtctgagagcggcggcctgggcgtgtccatggtggagtatgtgctgagcagcagccctgctgacaagctggacagccgcttcagaaaaggaaactttggcaccagagatgctgagacagatggccctgagaagggggaccagaagggcaaggccagcccctttgaggaggaccagaacagagacctgaagcagggagatgatgatgacagcaagatcaatggccggggcctgcccaacggcatggatgctgactgcaaggacttcaacagaacacctggcagccggcaggccagccccacagaggtggtggagcggctgggccccaacaccaaccccagcgagggcctgggccccctgcccaaccccacagccaacaagcccctggtggaggagttcagcaaccctgagacccagaacctggatgccatggagcaggtgggcctggagagcctgcagtttgactacccaggcaaccaggtgcccatggacagcagcggggccaccgtgggcctgtttgactacaacagccagcagcagctgttccagaggaccaatgccctgactgtgcagcagctgacagctgcccagcagcagcagtatgccctggccgccgcccagcagccccacatcgccggggtcttctctgctggcctggccccagctgcctttgtgcccaacccctacatcatctctgctgcccctcctggaacagacccctacacagctgctggcctggccgccgccgccaccctggccggccctgctgtggtgcccccccagtactacggcgtgccctggggcgtgtacccagccaacctcttccagcagcaggccgctgctgctgccaacaacacagccagccagcaggccgccagccaggcccagcccggccagcagcaggtgctgcgggccggggccggccagaggcccctgacccccaaccagggccagcagggccagcaggccgagagcctggccgctgctgctgctgccaaccccaccctggccttcggccagggcctggccaccggcatgcctggctaccaggtgctggcccccacagcctactatgaccagacaggagccctggtggtgggccctggggccaggacaggcctgggcgcccctgtgcggctgatggcccccacccctgtgctgatcagcagcgctgctgcccaggccgctgctgctgctgctgctgggggcacagccagcagcctgaccggcagcaccaacggcctcttccggcccatcggcacccagcccccccagcagcagcagcagcagcccagcaccaacctgcagagcaacagcttctacggcagcagcagcctgaccaacagcagccagagcagcagcctcttcagccacggccctggccagcccggcagcaccagcctgggctttggaagtggcaacagcctgggcgccgccatcggcagcgccctgagcggcttcggcagctctgtgggcagcagcgccagcagcagcgccacccggcgggagagcctgagcaccagcagtgacctgtacaagaggagcagcagcagcctggcccccatcggccagcccttctacaacagcctgggcttcagcagcagccccagccccatcggcatgcccctgcccagccagaccccaggccacagcctgaccccaccacccagcctgagcagccacggcagcagcagcagcctgcacctgggcggcctgaccaatggaagtggccgctacatctctgctgcccctggagctgaggccaagtacagaagtgccagcagcaccagcagcctcttcagcagcagcagccagctgtttcctcccagccggctgcgctacaacagaagtgacatcatgcccagcggccgcagccggctgctggaggacttcaggaacaaccgcttccccaacctgcagctgcgggacctgattggccacatcgtggagttcagccaggaccagcacggcagccgcttcatccagcagaagctggagcgggccaccccagctgagcggcagatggtgttcaatgagatcctgcaggccgcctaccagctgatgacagatgtgtttggaaactacgtgatccagaagttctttgaatttggcagcctggaccagaagctggccctggccacccgcatccggggccacgtgctgcccctggccctgcagatgtatggctgcagggtcatccagaaggccctggagagcatcagcagtgaccagcagagcgagatggtgaaggagctggatggccacgtgctgaagtgtgtgaaggaccagaatggaaaccacgtggtgcagaagtgcattgaatgtgtgcagccccagagcctgcagttcatcattgatgccttcaagggccaggtgtttgtgctgagcacccacccctacggctgcagggtcatccagaggatcctggagcactgcacagctgagcagaccctgcccatcctggaggagctgcaccagcacacagagcagctggtgcaggaccagtatggcaactacgtgatccagcacgtgctggagcacggccggcctgaggacaagagcaagatcgtgtctgagatccggggcaaggtgctggccctgagccagcacaagtttgccagcaatgtggtggagaagtgtgtgacccacgccagcagagctgagcgggccctgctgattgatgaggtgtgctgccagaatgatggcccccacagcgccctgtacaccatgatgaaggaccagtatgccaactacgtggtgcagaagatgattgacatggccgagcccgcccagaggaagatcatcatgcacaagatccggccccacatcaccaccctgaggaagtacacctacggcaagcacatcctggccaagctggagaagtactacctgaagaacagcccagacctgggccccatcggcggccccccaaatggcatgctgtag

SEQ ID NO: 166654 - DNA, 3201 bp, Artificial Sequence
  Description of Artificial Sequence: Synthetic coding sequence
atgaaccacgacttccaggccctggccctggagagccggggcatgggagagctgctgcccaccaagaagttctgggagccagatgacagcaccaaggatggccagaagggcatcttcctgggagatgatgagtggagggagacagcctggggcgccagccaccacagcatgagccagcccatcatggtgcagaggagaagtggccagggcttccacggcaacagcgaggtgaatgccatcctgagccccaggtctgagagcggcggcctgggcgtgtccatggtggagtatgtgctgagcagcagccctgctgacaagctggacagccgcttcagaaaaggaaactttggcaccagagatgctgagacagatggccctgagaagggggaccagaagggcaaggccagcccctttgaggaggaccagaacagagacctgaagcagggagatgatgatgacagcaagatcaatggccggggcctgcccaacggcatggatgctgactgcaaggacttcaacagaacacctggcagccggcaggccagccccacagaggtggtggagcggctgggccccaacaccaaccccagcgagggcctgggccccctgcccaaccccacagccaacaagcccctggtggaggagttcagcaaccctgagacccagaacctggatgccatggagcaggtgggcctggagagcctgcagtttgactacccaggcaaccaggtgcccatggacagcagcggggccaccgtgggcctgtttgactacaacagccagcagcagctgttccagaggaccaatgccctgactgtgcagcagctgacagctgcccagcagcagcagtatgccctggccgccgcccagcagccccacatcgccggggtcttctctgctggcctggccccagctgcctttgtgcccaacccctacatcatctctgctgcccctcctggaacagacccctacacagctgctggcctggccgccgccgccaccctggccggccctgctgtggtgcccccccagtactacggcgtgccctggggcgtgtacccagccaacctcttccagcagcaggccgctgctgctgccaacaacacagccagccagcaggccgccagccaggcccagcccggccagcagcaggtgctgcgggccggggccggccagaggcccctgacccccaaccagggccagcagggccagcaggccgagagcctggccgctgctgctgctgccaaccccaccctggccttcggccagggcctggccaccggcatgcctggctaccaggtgctggcccccacagcctactatgaccagacaggagccctggtggtgggccctggggccaggacaggcctgggcgcccctgtgcggctgatggcccccacccctgtgctgatcagcagcgctgctgcccaggccgctgctgctgctgctgctgggggcacagccagcagcctgaccggcagcaccaacggcctcttccggcccatcggcacccagcccccccagcagcagcagcagcagcccagcaccaacctgcagagcaacagcttctacggcagcagcagcctgaccaacagcagccagagcagcagcctcttcagccacggccctggccagcccggcagcaccagcctgggctttggaagtggcaacagcctgggcgccgccatcggcagcgccctgagcggcttcggcagctctgtgggcagcagcgccagcagcagcgccacccggcgggagagcctgagcaccagcagtgacctgtacaagaggagcagcagcagcctggcccccatcggccagcccttctacaacagcctgggcttcagcagcagccccagccccatcggcatgcccctgcccagccagaccccaggccacagcctgaccccaccacccagcctgagcagccacggcagcagcagcagcctgcacctgggcggcctgaccaatggaagtggccgctacatctctgctgcccctggagctgaggccaagtacagaagtgccagcagcaccagcagcctcttcagcagcagcagccagctgtttcctcccagccggctgcgctacaacagaagtgacatcatgcccagcggccgcagccggctgctggaggacttcaggaacaaccgcttccccaacctgcagctgcgggacctgattggccacatcgtggagttcagccaggaccagcacggcagccgcttcatccagcagaagctggagcgggccaccccagctgagcggcagatggtgttcaatgagatcctgcaggccgcctaccagctgatgacagatgtgtttggaaactacgtgatccagaagttctttgaatttggcagcctggaccagaagctggccctggccacccgcatccggggccacgtgctgcccctggccctgcagatgtatggctgcagggtcatccagaaggccctggagagcatcagcagtgaccagcaggtgatcagcgagatggtgaaggagctggatggccacgtgctgaagtgtgtgaaggaccagaatggaaaccacgtggtgcagaagtgcattgaatgtgtgcagccccagagcctgcagttcatcattgatgccttcaagggccaggtgtttgtgctgagcacccacccctacggctgcagggtcatccagaggatcctggagcactgcacagctgagcagaccctgcccatcctggaggagctgcaccagcacacagagcagctggtgcaggaccagtatggcaactacgtgatccagcacgtgctggagcacggccggcctgaggacaagagcaagatcgtgtctgagatccggggcaaggtgctggccctgagccagcacaagtttgccagcaatgtggtggagaagtgtgtgacccacgccagcagagctgagcgggccctgctgattgatgaggtgtgctgccagaatgatggcccccacagcgccctgtacaccatgatgaaggaccagtatgccaactacgtggtgcagaagatgattgacatggccgagcccgcccagaggaagatcatcatgcacaagatccggccccacatcaccaccctgaggaagtacacctacggcaagcacatcctggccaagctggagaagtactacctgaagaacagcccagacctgggccccatcggcggccccccaaatggcatgctgtag

SEQ ID NO: 166655 - DNA, 3195 bp, Artificial Sequence; identical to SEQ ID NO: 166653
  Description of Artificial Sequence: Synthetic coding sequence

SEQ ID NO: 166656 - DNA, 105 bp, Artificial Sequence
  Description of Artificial Sequence: Synthetic coding sequence
atgaaccacgacttccaggccctggccctggagagccggggcatgggagagctgctgcccaccaagaagttctgggagccagatgacagcaccaaggatggatag

SEQ ID NO: 166657 - DNA, 882 bp, Artificial Sequence
  Description of Artificial Sequence: Synthetic coding sequence
atgaaccacgacttccaggccctggccctggagagccggggcatgggagagctgctgcccaccaagaagttctgggagccagatgacagcaccaaggatggccagaagggcatcttcctgggagatgatgagtggagggagacagcctggggcgccagccaccacagcatgagccagcccatcatggtgcagaggagaagtggccagggcttccacggcaacagcgaggtgaatgccatcctgagccccaggtctgagagcggcggcctgggcgtgtccatggtggagtatgtgctgagcagcagccctgctgacaagctggacagccgcttcagaaaaggaaactttggcaccagagatgctgagacagatggccctgagaagggggaccagaagggcaaggccagcccctttgaggaggaccagaacagagacctgaagcagggagatgatgatgacagcaagatcaatggccggggcctgcccaacggcatggatgctgactgcaaggacttcaacagaacacctggcagccggcaggccagccccacagaggtggtggagcggctgggccccaacaccaaccccagcgagggcctgggccccctgcccaaccccacagccaacaagcccctggtggaggagttcagcaaccctgagacccagaacctggatgccatggagcaggtgggcctggagagcctgcagtttgactacccaggcaaccaggtgcccatggacagcagcggggccaccgtgggcctgtttgactacaacagccagcagcagctgttccagaggaccaatgccctgactgtgcagcagctgacagctgcccagcagcagcagtatgccctggccgccgcccagcagccccactag

SEQ ID NO: 166658 - DNA, 3027 bp, Artificial Sequence
  Description of Artificial Sequence: Synthetic coding sequence
atgagccagcccatcatggtgcagaggagaagtggccagggcttccacggcaacagcgaggtgaatgccatcctgagccccaggtctgagagcggcggcctgggcgtgtccatggtggagtatgtgctgagcagcagccctgctgacaagctggacagccgcttcagaaaaggaaactttggcaccagagatgctgagacagatggccctgagaagggggaccagaagggcaaggccagcccctttgaggaggaccagaacagagacctgaagcagggagatgatgatgacagcaagatcaatggccggggcctgcccaacggcatggatgctgactgcaaggacttcaacagaacacctggcagccggcaggccagccccacagaggtggtggagcggctgggccccaacaccaaccccagcgagggcctgggccccctgcccaaccccacagccaacaagcccctggtggaggagttcagcaaccctgagacccagaacctggatgccatggagcaggtgggcctggagagcctgcagtttgactacccaggcaaccaggtgcccatggacagcagcggggccaccgtgggcctgtttgactacaacagccagcagcagctgttccagaggaccaatgccctgactgtgcagcagctgacagctgcccagcagcagcagtatgccctggccgccgcccagcagccccacatcgccggggtcttctctgctggcctggccccagctgcctttgtgcccaacccctacatcatctctgctgcccctcctggaacagacccctacacagctgctggcctggccgccgccgccaccctggccggccctgctgtggtgcccccccagtactacggcgtgccctggggcgtgtacccagccaacctcttccagcagcaggccgctgctgctgccaacaacacagccagccagcaggccgccagccaggcccagcccggccagcagcaggtgctgcgggccggggccggccagaggcccctgacccccaaccagggccagcagggccagcaggccgagagcctggccgctgctgctgctgccaaccccaccctggccttcggccagggcctggccaccggcatgcctggctaccaggtgctggcccccacagcctactatgaccagacaggagccctggtggtgggccctggggccaggacaggcctgggcgcccctgtgcggctgatggcccccacccctgtgctgatcagcagcgctgctgcccaggccgctgctgctgctgctgctgggggcacagccagcagcctgaccggcagcaccaacggcctcttccggcccatcggcacccagcccccccagcagcagcagcagcagcccagcaccaacctgcagagcaacagcttctacggcagcagcagcctgaccaacagcagccagagcagcagcctcttcagccacggccctggccagcccggcagcaccagcctgggctttggaagtggcaacagcctgggcgccgccatcggcagcgccctgagcggcttcggcagctctgtgggcagcagcgccagcagcagcgccacccggcgggagagcctgagcaccagcagtgacctgtacaagaggagcagcagcagcctggcccccatcggccagcccttctacaacagcctgggcttcagcagcagccccagccccatcggcatgcccctgcccagccagaccccaggccacagcctgaccccaccacccagcctgagcagccacggcagcagcagcagcctgcacctgggcggcctgaccaatggaagtggccgctacatctctgctgcccctggagctgaggccaagtacagaagtgccagcagcaccagcagcctcttcagcagcagcagccagctgtttcctcccagccggctgcgctacaacagaagtgacatcatgcccagcggccgcagccggctgctggaggacttcaggaacaaccgcttccccaacctgcagctgcgggacctgattggccacatcgtggagttcagccaggaccagcacggcagccgcttcatccagcagaagctggagcgggccaccccagctgagcggcagatggtgttcaatgagatcctgcaggccgcctaccagctgatgacagatgtgtttggaaactacgtgatccagaagttctttgaatttggcagcctggaccagaagctggccctggccacccgcatccggggccacgtgctgcccctggccctgcagatgtatggctgcagggtcatccagaaggccctggagagcatcagcagtgaccagcagagcgagatggtgaaggagctggatggccacgtgctgaagtgtgtgaaggaccagaatggaaaccacgtggtgcagaagtgcattgaatgtgtgcagccccagagcctgcagttcatcattgatgccttcaagggccaggtgtttgtgctgagcacccacccctacggctgcagggtcatccagaggatcctggagcactgcacagctgagcagaccctgcccatcctggaggagctgcaccagcacacagagcagctggtgcaggaccagtatggcaactacgtgatccagcacgtgctggagcacggccggcctgaggacaagagcaagatcgtgtctgagatccggggcaaggtgctggccctgagccagcacaagtttgccagcaatgtggtggagaagtgtgtgacccacgccagcagagctgagcgggccctgctgattgatgaggtgtgctgccagaatgatggcccccacagcgccctgtacaccatgatgaaggaccagtatgccaactacgtggtgcagaagatgattgacatggccgagcccgcccagaggaagatcatcatgcacaagatccggccccacatcaccaccctgaggaagtacacctacggcaagcacatcctggccaagctggagaagtactacctgaagaacagcccagacctgggccccatcggcggccccccaaatggcatgctgtag

SEQ ID NO: 166659 - DNA, 870 bp, Artificial Sequence
  Description of Artificial Sequence: Synthetic coding sequence
atggagaatggctacacctatgaggactacaagaacacagctgagtggctgctgagccacaccaagcaccggccccaggtggccatcatctgtggcagcggcctgggcggcctgacagacaagctgacccaggcccagatctttgattatggagagatccccaacttccccaggagcacagtgcccggccatgctggccgcctggtgtttggcttcctgaatggccgggcctgtgtgatgatgcagggccgcttccacatgtatgagggctaccccctgtggaaggtgaccttccctgtgcgggtcttccacctgctgggcgtggacaccctggtggtgaccaatgctgctgggggcctgaaccccaagtttgaggtgggggacatcatgctgatccgggaccacatcaacctgcccggcttcagcggccagaaccccctgcggggccccaatgatgaaagatttggagaccgcttccctgccatgtctgatgcctatgacaggaccatgaggcagagggccctgagcacctggaagcagatgggagagcagcgggagctgcaggagggcacctacgtgatggtggccggccccagctttgagaccgtggctgaatgtcgggtgctgcagaagctgggcgcagatgctgtgggcatgagcacagtgcctgaggtgattgtggcccggcactgcggcctgcgggtgtttggcttcagcctcatcaccaacaaggtgatcatggactatgagagcctggagaaggccaaccacgaggaggtgctggccgccggcaagcaggccgcccagaagctggagcagtttgtgtccatcctgatggccagcatccccctgcctgacaaggccagctag

SEQ ID NO: 166660 - DNA, 282 bp, Artificial Sequence
  Description of Artificial Sequence: Synthetic coding sequence
atggagaatggctacacctatgaggactacaagaacacagctgagtggctgctgagccacaccaagcaccggccccaggtggccatcatctgtggcagcggcctgggcggcctgacagacaagctgacccaggcccagatctttgattatggagagatccccaacttccccaggagcacagtgcccggccatgctggccgcctggtgtttggcttcctgaatggccgggcctgtgtgatgatgcagggccgcttccacatgtatgagggctaccccctgtag

SEQ ID NO: 166661 - DNA, 375 bp, Artificial Sequence
  Description of Artificial Sequence: Synthetic coding sequence
atgagctacatccctggccagcctgtgacagctgtggtgcagagggtggagatccacaagctgcggcagggagaaaatctcatcctgggcttcagcattggaggcggcatcgaccaggaccccagccagaaccccttcagcgaggacaagacagacaagggcatctacgtgaccagggtgtctgagggcggccctgctgagattgctggcctgcagattggagacaagatcatgcaggtgaatggctgggacatgaccatggtgacccatgaccaggccaggaagaggctgaccaagaggtctgaggaggtggtgcggctgctggtgacccggcagagcctgcagaaggctgtgcagcagagcatgctgtcctag

SEQ ID NO: 166662 - DNA, 1194 bp, Artificial Sequence
  Description of Artificial Sequence: Synthetic coding sequence
atgaactgcatcagtgacttcttcacctatgagaccaccaagtctgtggtggtgaagtcctggaccatcggcatcatcaacagagtggtgcagctgctgatcatctcctactttgtgggctgggtgttcctgcacgagaaggcctaccaggtgcgggacacagccatcgagagctctgtggtgaccaaggtgaagggcagcggcctgtatgccaacagagtgatggatgtgtctgactatgtgaccccaccccagggcacctctgtgtttgtgatcatcaccaagatgattgtgacagagaaccagatgcagggcttctgcccagagagcgaggagaagtaccgctgtgtgtctgacagccagtgtggccctgagcggctgcccggcggcggcatcctgaccggccgctgtgtgaactacagctctgtgctgcggacctgtgagatccagggctggtgccccacagaggtggacacagtggagacccccatcatgatggaggccgagaacttcaccatcttcatcaagaacagcatccgcttccccctcttcaactttgagaagggcaacctgctgcccaacctgacagcccgggacatgaagacctgccgcttccacccagacaaggaccccttctgccccatcctgcgggtgggagatgtggtgaagtttgctggccaggactttgccaagctggccaggactggaggagtgctgggcatcaagattggctgggtgtgtgacctggacaaggcctgggaccagtgcatccccaagtacagcttcacccggctggacagcgtgtctgagaagagctctgtgtccccaggctacaacttccgctttgccaagtactacaagatggagaatggcagcgagtaccgcaccctgctgaaggccttcggcatccgctttgatgtgctggtgtatggaaatgccggcaagttcaacatcatccccaccatcatcagctctgtggccgccttcacctctgtgggcgtgggcaccgtgctgtgtgacatcatcctgctgaacttcctgaagggagctgaccagtacaaggccaagaagtttgaggaggtgaatgagaccaccctgaagattgctgccctgaccaaccctgtgtaccccagcgaccagaccacagctgagaagcagagcacagacagcggggccttcagcatcggccactag

SEQ ID NO: 166663 - DNA, 1191 bp, Artificial Sequence
  Description of Artificial Sequence: Synthetic coding sequence
atgaactgcatcagtgacttcttcacctatgagaccaccaagtctgtggtggtgaagtcctggaccatcggcatcatcaacagagtggtgcagctgctgatcatctcctactttgtgggctgggtgttcctgcacgagaaggcctaccaggtgcgggacacagccatcgagagctctgtggtgaccaaggtgaagggcagcggcctgtatgccaacagagtgatggatgtgtctgactatgtgaccccaccccagggcacctctgtgtttgtgatcatcaccaagatgattgtgacagagaaccagatgcagggcttctgcccagagagcgaggagaagtaccgctgtgtgtctgacagccagtgtggccctgagcggctgcccggcggcggcatcctgaccggccgctgtgtgaactacagctctgtgctgcggacctgtgagatccagggctggtgccccacagaggtggacacagtggagacccccatcatgatggaggccgagaacttcaccatcttcatcaagaacagcatccgcttccccctcttcaactttgagaagggcaacctgctgcccaacctgacagcccgggacatgaagacctgccgcttccacccagacaaggaccccttctgccccatcctgcgggtgggagatgtggtgaagtttgctggccaggactttgccaagctggccaggactggaggagtgctgggcatcaagattggctgggtgtgtgacctggacaaggcctgggaccagtgcatccccaagtacagcttcacccggctggacagcgtgtctgagaagagctctgtgtccccaggctacaacttccgctttgccaagtactacaagatggagaatggcagcgagtaccgcaccctgctgaaggccttcggcatccgctttgatgtgctgtacaccggggccggcaagttcaacatcatccccaccatcatcagctctgtggccgccttcacctctgtgggcgtgggcaccgtgctgtgtgacatcatcctgctgaacttcctgaagggagctgaccagtacaaggccaagaagtttgaggaggtgaatgagaccaccctgaagattgctgccctgaccaaccctgtgtaccccagcgaccagaccacagctgagaagcagagcacagattctggggccttcagcatcggccactag

SEQ ID NO: 166664 - DNA, 1167 bp, Artificial Sequence
  Description of Artificial Sequence: Synthetic coding sequence
atggccggctgctgtgccgccctggccgccttcctgtttgaatatgacaccccccgcatcgtgctgatccgcagcaggaaggtgggcctgatgaacagagctgtgcagctgctgatcctggcctacgtgattggctgggtgtttgtgtgggagaagggctaccaggagacagattctgtggtgtcctctgtgaccaccaaggtgaagggcgtggccgtgaccaacaccagcaagctgggcttccgcatctgggatgtggccgactatgtgatcccagcccaggaggagaacagcctgtttgtgatgaccaacgtcatcctgaccatgaaccagacccagggcctgtgcccagagatcccagatgccaccaccgtgtgcaagagtgatgccagctgcacagctggcagcgctggcacccacagcaatggagtgtccacaggccgctgtgtggccttcaatggatctgtgaagacctgtgaggtggccgcctggtgccctgtggaggatgacacccacgtgccccagcctgccttcctgaaggctgctgagaacttcaccctgctggtgaagaacaacatctggtaccccaagttcaacttcagcaagaggaacatcctgcccaacatcaccaccacctacctgaagagctgcatctatgatgccaagacagaccccttctgccccatcttccggctgggcaagatcgtggagaatgccggccacagcttccaggacatggctgtggagggcggcatcatgggcatccaggtgaactgggactgcaacctggaccgggccgccagcctgtgcctgccccgctacagcttccggcggctggacaccagagatgtggagcacaacgtgtccccaggctacaacttccgctttgccaagtactacagagacctggccggaaatgagcagaggaccctcatcaaggcctacggcatccgctttgacatcatcgtgtttgggaaggccggcaagtttgacatcatccccaccatgatcaacatcggcagcggcctggccctgctgggcatggccaccgtgctgtgtgacatcatcgtgctgtactgcatgaagaagaggctgtactaccgggagaagaagtacaagtatgtggaggactatgagcagggcctggccagcgagctggaccagtag

SEQ ID NO: 166665 - DNA, 1215 bp, Artificial Sequence
  Description of Artificial Sequence: Synthetic coding sequence
atggccggctgctgtgccgccctggccgccttcctgtttgaatatgacaccccccgcatcgtgctgatccgcagcaggaaggtgggcctgatgaacagagctgtgcagctgctgatcctggcctacgtgattggctgctaccacccccacctggccgaggtggagatggagagcccccggcgctgggtgtttgtgtgggagaagggctaccaggagacagattctgtggtgtcctctgtgaccaccaaggtgaagggcgtggccgtgaccaacaccagcaagctgggcttccgcatctgggatgtggccgactatgtgatcccagcccaggaggagaacagcctgtttgtgatgaccaacgtcatcctgaccatgaaccagacccagggcctgtgcccagagatcccagatgccaccaccgtgtgcaagagtgatgccagctgcacagctggcagcgctggcacccacagcaatggagtgtccacaggccgctgtgtggccttcaatggatctgtgaagacctgtgaggtggccgcctggtgccctgtggaggatgacacccacgtgccccagcctgccttcctgaaggctgctgagaacttcaccctgctggtgaagaacaacatctggtaccccaagttcaacttcagcaagaggaacatcctgcccaacatcaccaccacctacctgaagagctgcatctatgatgccaagacagaccccttctgccccatcttccggctgggcaagatcgtggagaatgccggccacagcttccaggacatggctgtggagggcggcatcatgggcatccaggtgaactgggactgcaacctggaccgggccgccagcctgtgcctgccccgctacagcttccggcggctggacaccagagatgtggagcacaacgtgtccccaggctacaacttccgctttgccaagtactacagagacctggccggaaatgagcagaggaccctcatcaaggcctacggcatccgctttgacatcatcgtgtttgggaaggccggcaagtttgacatcatccccaccatgatcaacatcggcagcggcctggccctgctgggcatggccaccgtgctgtgtgacatcatcgtgctgtactgcatgaagaagaggctgtactaccgggagaagaagtacaagtatgtggaggactatgagcagggcctggccagcgagctggaccagtag

SEQ ID NO: 166666 - DNA, 441 bp, Artificial Sequence
  Description of Artificial Sequence: Synthetic coding sequence
atggccggctgctgtgccgccctggccgccttcctgtttgaatatgacaccccccgcatcgtgctgatccgcagcaggaaggtgggcctgatgaacagagctgtgcagctgctgatcctggcctacgtgattggctgggtgtttgtgtgggagaagggctaccaggagacagattctgtggtgtcctctgtgaccaccaaggtgaagggcgtggccgtgaccaacaccagcaagctgggcttccgcatctgggatgtggccgactatgtgatcccagcccaggaggagaacagcctgtttgtgatgaccaacgtcatcctgaccatgaaccagacccagggcctgtgcccagagatcccagatgccaccaccgtgtgcaagagtgatgccagctgcacagctggcagcgctggcacccacagcaatgacctgctcttctag

SEQ ID NO: 166667 - DNA, 1086 bp, Artificial Sequence
  Description of Artificial Sequence: Synthetic coding sequence
atggccggctgctgtgccgccctggccgccttcctgtttgaatatgacaccccccgcatcgtgctgatccgcagcaggaaggtgggcctgatgaacagagctgtgcagctgctgatcctggcctacgtgattggctgggtgtttgtgtgggagaagggctaccaggagacagattctgtggtgtcctctgtgaccaccaaggtgaagggcgtggccgtgaccaacaccagcaagctgggcttccgcatctgggatgtggccgactatgtgatcccagcccaggaggagaacagcctgtttgtgatgaccaacgtcatcctgaccatgaaccagacccagggcctgtgcccagagatcccagatgccaccaccgtgtgcaagagtgatgccagctgcacagctggcagcgctggcacccacagcaatggagtgtccacaggccgcccagccttcctgaaggctgctgagaacttcaccctgctggtgaagaacaacatctggtaccccaagttcaacttcagcaagaggaacatcctgcccaacatcaccaccacctacctgaagagctgcatctatgatgccaagacagaccccttctgccccatcttccggctgggcaagatcgtggagaatgccggccacagcttccaggacatggctgtggagggcggcatcatgggcatccaggtgaactgggactgcaacctggacagagctgccagcctgtgcctgccccgctacagcttccggcggctggacaccagagatgtggagcacaacgtgtccccaggctacaacttccgctttgccaagtactacagagacctggccggaaatgagcagaggaccctcatcaaggcctacggcatccgctttgacatcatcgtgtttgggaaggccggcaagtttgacatcatccccaccatgatcaacatcggcagcggcctggccctgctgggcatggccaccgtgctgtgtgacatcatcgtgctgtactgcatgaagaagaggctgtactaccgggagaagaagtacaagtatgtggaggactatgagcagggcctggccagcgagctggaccagtag

SEQ ID NO: 166668 - DNA, 864 bp, Artificial Sequence
  Description of Artificial Sequence: Synthetic coding sequence
atgaccaacgtcatcctgaccatgaaccagacccagggcctgtgcccagagatcccagatgccaccaccgtgtgcaagagtgatgccagctgcacagctggcagcgctggcacccacagcaatggagtgtccacaggccgctgtgtggccttcaacggctctgtgaagacctgtgaggtggccgcctggtgccctgtggaggatgacacccacgtgccccagcctgccttcctgaaggctgctgagaacttcaccctgctggtgaagaacaacatctggtaccccaagttcaacttcagcaagaggaacatcctgcccaacatcaccaccacctacctgaagagctgcatctatgatgccaagacagaccccttctgccccatcttccggctgggcaagatcgtggagaatgccggccacagcttccaggacatggctgtggagggcggcatcatgggcatccaggtgaactgggactgcaacctggacagagctgccagcctgtgcctgccccgctacagcttccggcggctggacaccagagatgtggagcacaacgtgtccccaggctacaacttccgctttgccaagtactacagagacctggccggaaatgagcagaggaccctcatcaaggcctacggcatccgctttgacatcatcgtgtttgggaaggccggcaagtttgacatcatccccaccatgatcaacatcggcagcggcctggccctgctgggcatggccaccgtgctgtgtgacatcatcgtgctgtactgcatgaagaagaggctgtactaccgggagaagaagtacaagtatgtggaggactatgagcagggcctggccagcgagctggaccagtag

SEQ ID NO: 166669 - DNA, 1278 bp, Artificial Sequence
  Description of Artificial Sequence: Synthetic coding sequence
atggatggccctgctgagcagaggcctgccctgctgaacagcgctgagaacttcaccgtgctgatcaagaacaacatcgacttccctggccacaactacaccaccaggaacatcctgcccggcctgaacatcacctgcaccttccacaagacccagaacccccagtgccccatcttccggctgggggacatcttccgggagaccggggacaacttcagtgatgtggccatccagggcggcatcatgggcatcgagatctactgggactgcaacctggaccgctggttccaccactgccggcccaagtacagcttccggcggctggatgacaagaccaccaacgtgtccctgtacccaggctacaacttccgctatgccaagtactacaaggaaaataatgtggagaagaggaccctcatcaaggtgtttggcatccgctttgacatcctggtgtttggcaccggcggcaagtttgacatcatccagctggtggtgtacatcggcagcaccctgagctacttcggcctggccgctgtgttcatcgacttcctgattgacacctacagcagcaactgctgccgcagccacatctacccctggtgcaagtgctgccagccctgtgtggtgaatgagtactactacaggaagaagtgtgagagcatcgtggagcccaagcccaccctgaagtatgtgtcctttgtggatgagagccacatccgcatggtgaaccagcagctgctgggccgcagcctgcaggatgtgaagggccaggaggtgcccaggcctgccatggacttcacagacctgagccggctgcccctggccctgcatgacaccccacccatccctggccagcctgaggagatccagctgctgaggaaggaggccacccccaggagccgggacagccctgtgtggtgccagtgtggcagctgcctgcccagccagctgcctgagagccaccgctgcctggaggagctgtgctgcaggaagaagccaggggcctgcatcaccaccagcgagctgttcaggaagctggtgctgagcagacatgtgctgcagttcctgctgctgtaccaggagcccctgctggccctggatgtggacagcaccaacagccggctgcggcactgtgcctaccgctgctacgccacctggaggtttggcagccaggacatggctgactttgccaacctgcccagctgctgccgctggaggatcaggaaggagttccccaagtctgagggccagtacagcggcttcaagagcccctactag

SEQ ID NO: 166670 - DNA, 828 bp, Artificial Sequence
  Description of Artificial Sequence: Synthetic coding sequence
atgcctgcctgctgcagctgcagtgatgtgttccagtatgagaccaacaaggtgacccgcatccagagcatgaactacggcaccatcaagtggttcttccacgtgatcatcttctcctatgtgtgctttgccctggtgtctgacaagctgtaccagaggaaggagcccgtcatcagctctgtgcacaccaaggtgaagggcattgctgaggtgaaggaggagatcgtggagaatggagtgaagaagctggtgcacagcgtgtttgacacagctgactacaccttccccctgcagggcaacagcttctttgtgatgaccaacttcctgaagacagagggccaggagcagaggctgtgcccagagtaccccaccaggaggaccctgtgcagcagtgaccggggctgcaagaagggctggatggacccccagagcaagggcatccagacaggccgctgtgtggtgtatgagggcaaccagaagacctgtgaggtgtctgcctggtgccccatcgaggccgtggaggaggcccccaggcctgccctgctgaacagcgctgagaacttcaccgtgctgatcaagaacaacatcgacttccctggccacaactacaccacctacgccaagtactacaaggagaacaacgtggagaagaggaccctcatcaaggtgtttggcatccgctttgacatcctggtgtttggaactggaggcaagtttgacatcatccagctggtggtgtacatcggcagcaccctgagctacttcggcctggtgcgggacagcctcttccacgccctgggcaagtggtttggagagggcagtgactag

SEQ ID NO: 166671 - DNA, 1518 bp, Artificial Sequence
  Description of Artificial Sequence: Synthetic coding sequence
atgacccctggggaccacagctggggcaacagcttctttgtgatgaccaacttcctgaagacagagggccaggagcagaggctgtgcccagagtaccccaccaggaggaccctgtgcagcagtgaccggggctgcaagaagggctggatggacccccagagcaagggcatccagacaggccgctgtgtggtgtatgagggcaaccagaagacctgtgaggtgtctgcctggtgccccatcgaggccgtggaggaggcccccaggcctgccctgctgaacagcgctgagaacttcaccgtgctgatcaagaacaacatcgacttccctggccacaactacaccaccaggaacatcctgcccggcctgaacatcacctgcaccttccacaagacccagaacccccagtgccccatcttccggctgggggacatcttccgggagaccggggacaacttcagtgatgtggccatccagggcggcatcatgggcatcgagatctactgggactgcaacctggaccgctggttccaccactgccggcccaagtacagcttccggcggctggatgacaagaccaccaacgtgtccctgtacccaggctacaacttccgctatgccaagtactacaaggaaaataatgtggagaagaggaccctcatcaaggtgtttggcatccgctttgacatcctggtgtttggcaccggcggcaagtttgacatcatccagctggtggtgtacatcggcagcaccctgagctacttcggcctggccgctgtgttcatcgacttcctgattgacacctacagcagcaactgctgccgcagccacatctacccctggtgcaagtgctgccagccctgtgtggtgaatgagtactactacaggaagaagtgtgagagcatcgtggagcccaagcccaccctgaagtatgtgtcctttgtggatgagagccacatccgcatggtgaaccagcagctgctgggccgcagcctgcaggatgtgaagggccaggaggtgcccaggcctgccatggacttcacagacctgagccggctgcccctggccctgcatgacaccccacccatccctggccagcctgaggagatccagctgctgaggaaggaggccacccccaggagccgggacagccctgtgtggtgccagtgtggcagctgcctgcccagccagctgcctgagagccaccgctgcctggaggagctgtgctgcaggaagaagccaggggcctgcatcaccaccagcgagctgttcaggaagctggtgctgagcagacatgtgctgcagttcctgctgctgtaccaggagcccctgctggccctggatgtggacagcaccaacagccggctgcggcactgtgcctaccgctgctacgccacctggaggtttggcagccaggacatggctgactttgccaacctgcccagctgctgccgctggaggatcaggaaggagttccccaagtctgagggccagtacagcggcttcaagagcccctactag

SEQ ID NO: 166672 - DNA, 387 bp, Artificial Sequence
  Description of Artificial Sequence: Synthetic coding sequence
atgcctgcctgctgcagctgcagtgatgtgttccagtatgagaccaacaaggtgacccgcatccagagcatgaactacggcaccatcaagtggttcttccacgtgatcatcttctcctatgtgtgctttgccctggtgtctgacaagctgtaccagaggaaggagcccgtcatcagctctgtgcacaccaaggtgaagggcattgctgaggtgaaggaggagatcgtggagaatggagtgaagaagctggtgcacagcgtgtttgacacagctgactacaccttccccctgcagggcaacagcttctttgtgatgaccaacttcctgaagacagagggccaggagcagaggctgtgcccagaggagttccggcctgagggcgtgtag

SEQ ID NO: 166673 - DNA, 921 bp, Artificial Sequence
  Description of Artificial Sequence: Synthetic coding sequence
atgtggcagttccgctatgccaagtactacaaggagaacaacgtggagaagaggaccctcatcaaggtgtttggcatccgctttgacatcctggtgtttggaactggaggcaagtttgacatcatccagctggtggtgtacatcggcagcaccctgagctacttcggcctggccgctgtgttcatcgacttcctgattgacacctacagcagcaactgctgccgcagccacatctacccctggtgcaagtgctgccagccctgtgtggtgaatgagtactactacaggaagaagtgtgagagcatcgtggagcccaagcccaccctgaagtatgtgtcctttgtggatgagagccacatccgcatggtgaaccagcagctgctgggccgcagcctgcaggatgtgaagggccaggaggtgcccaggcctgccatggacttcacagacctgagccggctgcccctggccctgcatgacaccccacccatccctggccagcctgaggagatccagctgctgaggaaggaggccacccccaggagccgggacagccctgtgtggtgccagtgtggcagctgcctgcccagccagctgcctgagagccaccgctgcctggaggagctgtgctgcaggaagaagccaggggcctgcatcaccaccagcgagctgttcaggaagctggtgctgagccgccacgtgctgcagttcctgctgctgtaccaggagcccctgctggccctggatgtggacagcaccaacagccggctgcggcactgtgcctaccgctgctacgccacctggaggtttggcagccaggacatggctgactttgccaacctgcccagctgctgccgctggaggatcaggaaggagttccccaagtctgagggccagtacagcggcttcaagagcccctactag

SEQ ID NO: 166674 - DNA, 387 bp, Artificial Sequence; identical to SEQ ID NO: 166672
  Description of Artificial Sequence: Synthetic coding sequence

SEQ ID NO: 166675 - DNA, 1788 bp, Artificial Sequence
  Description of Artificial Sequence: Synthetic coding sequence
atgcctgcctgctgcagctgcagtgatgtgttccagtatgagaccaacaaggtgacccgcatccagagcatgaactacggcaccatcaagtggttcttccacgtgatcatcttctcctatgtgtgctttgccctggtgtctgacaagctgtaccagaggaaggagcccgtcatcagctctgtgcacaccaaggtgaagggcattgctgaggtgaaggaggagatcgtggagaatggagtgaagaagctggtgcacagcgtgtttgacacagctgactacaccttccccctgcagggcaacagcttctttgtgatgaccaacttcctgaagacagagggccaggagcagaggctgtgcccagagtaccccaccaggaggaccctgtgcagcagtgaccggggctgcaagaagggctggatggacccccagagcaagggcatccagacaggccgctgtgtggtgtatgagggcaaccagaagacctgtgaggtgtctgcctggtgccccatcgaggccgtggaggaggcccccaggcctgccctgctgaacagcgctgagaacttcaccgtgctgatcaagaacaacatcgacttccctggccacaactacaccaccaggaacatcctgcccggcctgaacatcacctgcaccttccacaagacccagaacccccagtgccccatcttccggctgggggacatcttccgggagaccggggacaacttcagtgatgtggccatccagggcggcatcatgggcatcgagatctactgggactgcaacctggaccgctggttccaccactgccggcccaagtacagcttccggcggctggatgacaagaccaccaacgtgtccctgtacccaggctacaacttccgctatgccaagtactacaaggaaaataatgtggagaagaggaccctcatcaaggtgtttggcatccgctttgacatcctggtgtttggcaccggcggcaagtttgacatcatccagctggtggtgtacatcggcagcaccctgagctacttcggcctggccgctgtgttcatcgacttcctgattgacacctacagcagcaactgctgccgcagccacatctacccctggtgcaagtgctgccagccctgtgtggtgaatgagtactactacaggaagaagtgtgagagcatcgtggagcccaagcccaccctgaagtatgtgtcctttgtggatgagagccacatccgcatggtgaaccagcagctgctgggccgcagcctgcaggatgtgaagggccaggaggtgcccaggcctgccatggacttcacagacctgagccggctgcccctggccctgcatgacaccccacccatccctggccagcctgaggagatccagctgctgaggaaggaggccacccccaggagccgggacagccctgtgtggtgccagtgtggcagctgcctgcccagccagctgcctgagagccaccgctgcctggaggagctgtgctgcaggaagaagccaggggcctgcatcaccaccagcgagctgttcaggaagctggtgctgagcagacatgtgctgcagttcctgctgctgtaccaggagcccctgctggccctggatgtggacagcaccaacagccggctgcggcactgtgcctaccgctgctacgccacctggaggtttggcagccaggacatggctgactttgccaacctgcccagctgctgccgctggaggatcaggaaggagttccccaagtctgagggccagtacagcggcttcaagagcccctactag

SEQ ID NO: 166676 - DNA, 1122 bp, Artificial Sequence
  Description of Artificial Sequence: Synthetic coding sequence
atgacagaggtgctgtggccagctgtgcccaatggaacagatgctgccttcctggccggccctggcagctcctggggcaacagcacagtggccagcacagctgctgtgagcagcagcttcaagtgtgccctgaccaagacaggcttccagttctactacctgcctgctgtgtacatcctggtgttcatcatcggcttcctgggcaacagcgtggccatctggatgtttgtgttccacatgaagccctggagcggcatctctgtgtacatgttcaacctggccctggccgacttcctgtatgtgctgaccctgcctgccctgatcttctactacttcaacaagacagactggatctttggagatgccatgtgcaagctgcagcgcttcatcttccacgtgaacctgtatggcagcatcctcttcctgacctgcatcagcgcccaccgctacagcggcgtggtgtaccccctgaagagcctgggccgcctgaagaagaagaatgccatctgcatctctgtgctggtgtggctgattgtggtggtggccatcagccccatcctcttctacagcggcaccggggtgaggaagaacaagaccatcacctgctatgacaccaccagtgatgagtacctgcggagctacttcatctacagcatgtgcaccaccgtggccatgttctgtgtgcccctggtgctgatcctgggctgctacggcctcatcgtgcgggccctgatctacaaggacctggacaacagccccctgcggaggaagagcatctacctggtgatcatcgtgctgactgtgtttgctgtgtcctacatccccttccacgtgatgaagaccatgaacctgcgggcccggctggacttccagaccccagccatgtgtgccttcaatgacagagtgtatgccacctaccaggtgacccggggcctggccagcctgaacagctgtgtggaccccatcctgtacttcctggccggggacaccttcagaagaaggctgagccgggccaccaggaaggccagccgccgctctgaggccaacctgcagagcaagtctgaggacatgaccctgaacatcctgcctgagttcaagcagaatggagacaccagcctgtag

SEQ ID NO: 166677 - DNA, 1125 bp, Artificial Sequence
  Description of Artificial Sequence: Synthetic coding sequence
atggccgccaacgtgtctggggccaagagctgcccagccaacttcctggccgctgctgatgacaagctgagcggcttccagggcgacttcctgtggcccatcctggtggtggagttcctggtggccgtggccagcaatggcctggccctgtaccgcttcagcatcaggaagcagaggccctggcaccctgctgtggtgttttctgtgcagctggccgtgtctgacctgctgtgtgccctgaccctgccccccctggccgcctacctgtacccacccaagcactggaggtatggagaggccgcctgccgcctggagcgcttcctgttcacctgcaacctgctgggcagcgtcatcttcatcacctgcatcagcctgaaccgctacctgggcatcgtgcaccccttctttgcccggagccacctgcggcccaagcacgcctgggccgtgtctgctgctggctgggtgctggccgccctgctggccatgcccaccctgtccttcagccacctgaagaggccccagcagggcgccggcaactgcagcgtggcccggcctgaggcctgcatcaagtgcctgggcacagctgaccacggcctggccgcctaccgggcctacagcctggtgctggccggcctgggctgcggcctgcccctgctgctgaccctggccgcctatggagccctgggccgggctgtgctgcggagccctggcatgacagtggccgagaagctgcgggtggccgccctggtggccagcggcgtggccctgtatgccagcagctatgtgccctaccacatcatgagggtgctgaatgtggatgcccggcggcgctggagcacccgctgccccagctttgctgacatcgcccaggccacagctgccctggagctgggcccctacgtgggctaccaggtgatgaggggcctgatgcccctggccttctgtgtgcaccccctgctgtacatggctgctgtgcccagcctgggctgctgctgccgccactgccccggctacagagacagctggaacccagaagatgccaagagcacaggccaggccctgcccctgaatgccacagctgcccccaagcccagcgagccccagagccgggagctgagccagtag

SEQ ID NO: 166678 - DNA, 1029 bp, Artificial Sequence
  Description of Artificial Sequence: Synthetic coding sequence
atgcaggccgtggacaacctgaccagcgcccctggcaacaccagcctgtgcacccgggactacaagatcacccaggtgctcttccccctgctgtacacagtgctcttctttgtgggcctcatcaccaacggcctggccatgaggatcttcttccagatccgcagcaagagcaacttcatcatcttcctgaagaacacagtcatcagtgacctgctgatgatcctgaccttccccttcaagatcctgagtgatgccaagctgggcaccggccccctgcggacctttgtgtgccaggtgaccagcgtcatcttctacttcaccatgtacatcagcatctccttcctgggcctcatcaccatcgaccgctaccagaagaccacccggcccttcaagaccagcaaccccaagaacctgctgggcgccaagatcctgtctgtggtgatctgggccttcatgttcctgctgagcctgcccaacatgatcctgaccaaccggcagccccgggacaagaatgtgaagaagtgcagcttcctgaagtcagaatttggcctggtgtggcatgaaattgtgaactacatctgccaggtgatcttctggatcaacttcctgattgtcatcgtgtgctacaccctcatcaccaaggagctgtaccgctcctatgtgaggacccggggcgtgggcaaggtgcccaggaagaaggtgaatgtgaaggtgttcatcatcatcgctgtgttcttcatctgctttgtgcccttccactttgcccgcatcccctacaccctgagccagaccagagatgtgtttgactgcacagctgagaacaccctcttctacgtgaaggagagcaccctgtggctgaccagcctgaatgcctgcctggaccccttcatctacttcttcctgtgcaagagcttcaggaacagcctcatctccatgctgaagtgccccaacagcgccaccagcctgagccaggacaacaggaagaaggagcaggacggcggggaccccaatgaggagacccccatgtag

SEQ ID NO: 166679 - DNA, 738 bp, Artificial Sequence
  Description of Artificial Sequence: Synthetic coding sequence
atgcaggccgtggacaacctgaccagcgcccctggcaacaccagcctgtgcacccgggactacaagatcacccaggtgctcttccccctgctgtacacagtgctcttctttgtgggcctcatcaccaacggcctggccatgaggatcttcttccagatccgcagcaagagcaacttcatcatcttcctgaagaacacagtcatcagtgacctgctgatgatcctgaccttccccttcaagatcctgagtgatgccaagctgggcaccggccccctgcggacctttgtgtgccaggtgatcttctggatcaacttcctgattgtgattgtgtgctacaccctcatcaccaaggagctgtaccgctcctatgtgaggacccggggcgtgggcaaggtgcccaggaagaaggtgaatgtgaaggtgttcatcatcatcgctgtgttcttcatctgctttgtgcccttccactttgcccgcatcccctacaccctgagccagaccagagatgtgtttgactgcacagctgagaacaccctcttctacgtgaaggagagcaccctgtggctgaccagcctgaatgcctgcctggaccccttcatctacttcttcctgtgcaagagcttcaggaacagcctcatctccatgctgaagtgccccaacagcgccaccagcctgagccaggacaacaggaagaaggagcaggatggaggagaccccaatgaggagacccccatgtag

SEQ ID NO: 166680 - DNA, 1134 bp, Artificial Sequence
  Description of Artificial Sequence: Synthetic coding sequence
atggctgctgacctgggcccctggaatgacaccatcaatggcacctgggatggagatgagctgggctaccgctgccgcttcaatgaagacttcaagtatgtgctgctgcctgtgtcctatggagtggtgtgtgtgcccggcctgtgcctgaatgctgtggccctgtacatcttcctgtgccgcctgaagacctggaatgccagcaccacctacatgttccacctggccgtgtctgatgccctgtatgctgccagcctgcccctgctggtgtactactatgcccggggggaccactggcccttcagcacagtgctgtgcaagctggtgcgcttcctgttctacaccaacctgtactgcagcatcctcttcctgacctgcatctctgtgcaccgctgcctgggcgtgctgcggcccctgcggagcctgcgctggggccgggcccgctatgccaggagagtggccggggctgtgtgggtgctggtgctggcctgccaggcccctgtgctgtactttgtgaccaccagcgcccggggcggccgggtgacctgccacgacaccagcgcccctgagctgttcagcagatttgtggcctacagctctgtgatgctgggcctgctgtttgctgtgccctttgctgtgatcctggtgtgctacgtgctgatggcccggcggctgctgaagccagcctacggcaccagcggcggcctgccccgggccaagaggaagtctgtgaggaccatcgctgtggtgctggccgtgtttgccctgtgcttcctgcccttccacgtgaccaggaccctgtactacagcttccgcagcctggacctgagctgccacaccctgaatgccatcaacatggcctacaaggtgacccggcccctggccagcgccaacagctgcctggaccctgtgctgtacttcctggccggccagaggctggtgcgctttgccagagatgccaagccacccaccggccccagccctgccaccccagcccggcggcggctgggcctgcggcggagtgacagaacagacatgcagagaattgaagatgtgctgggcagcagcgaggacagcagaagaacagagagcaccccagctggcagcgagaacaccaaggacatccggctgtag

SEQ ID NO: 166681 - DNA, 1134 bp, Artificial Sequence; identical to SEQ ID NO: 166680
  Description of Artificial Sequence: Synthetic coding sequence

SEQ ID NO: 166682 - DNA, 1134 bp, Artificial Sequence; identical to SEQ ID NO: 166680
  Description of Artificial Sequence: Synthetic coding sequence

SEQ ID NO: 166683 - DNA, 1080 bp, Artificial Sequence
  Description of Artificial Sequence: Synthetic coding sequence
atgcaggtgcccaacagcactggaccagacaatgccaccctgcagatgctgaggaacccagccatcgctgtggccctgcctgtggtgtacagcctggtggccgctgtgtccatccctggcaacctcttcagcctgtgggtgctgtgcaggaggatgggccccaggagccccagcgtcatcttcatgatcaacctgtctgtgacagacctgatgctggcctctgtgctgcccttccagatctactaccactgcaacagacaccactgggtgtttggagtgctgctgtgcaatgtggtgacagtggccttctacgccaacatgtacagcagcatcctgaccatgacctgcatctctgtggagcgcttcctgggcgtgctgtaccccctgagcagcaagcgctggaggagaagaagatatgctgtggccgcctgtgccggcacctggctgctgctgctgacagccctgagccccctggccaggacagacctgacctaccctgtgcacgccctgggcatcatcacctgctttgatgtgctgaagtggaccatgctgcccagcgtggccatgtgggccgtgttcctgttcaccatcttcatcctgctcttcctgatccccttcgtcatcaccgtggcctgctacacagccaccatcctgaagctgctgaggacagaggaggcccacggccgggagcagaggagaagagctgtgggcctggccgctgtggtgctgctggcctttgtgacctgctttgcccccaacaactttgtgctgctggcccacatcgtgagccgcctcttctacggcaagagctactaccacgtgtacaagctgaccctgtgcctgagctgcctgaacaactgcctggacccctttgtgtactactttgccagccgggagttccagctgcggctgcgggagtacctgggctgcagaagagtgccccgggacaccctggacacccggcgggagagcctcttcagcgcccggaccacctctgtgcgctctgaggccggggcccaccctgagggcatggagggcgccacccggcccggcctgcagaggcaggagagcgtcttctag

SEQ ID NO: 166684 - DNA, 189 bp, Artificial Sequence
  Description of Artificial Sequence: Synthetic coding sequence
atgtctgagcggcagggcgctggggccaccaacgggaaggacaagaccagcggagaaaatgatggccagaagaaggtgcaggaggagtttgacatcgacatggatgcccctgagacagaaagagctgctgtggccatccagagccagttcaggaagttccagaagaagaaggccggcagccagagctag

SEQ ID NO: 166685 - DNA, 1914 bp, Artificial Sequence
  Description of Artificial Sequence: Synthetic coding sequence
atggccagcaatgaaagagatgccatctcctggtaccagaagaagatcggggcctatgaccagcagatctgggagaagagcattgagcagacccagatcaagggcctgaagaacaagcccaagaagatgggccacatcaagccagacctgattgatgtggacctgatccggggcagcacctttgccaaggccaagccagagatcccctggaccagcctgaccaggaagggcctggtgcgggtggtgttcttccccctcttcagcaactggtggatccaggtgaccagcctgcgcatctttgtgtggctgctgctgctgtacttcatgcaggtgattgccatcgtgctgtacctgatgatgcccatcgtgaacatcagcgaggtgctgggccccctgtgcctgatgctgctgatgggcaccgtgcactgccagatcgtgtccacccagatcacccggcccagcggcaacaatggaaacagaagaagaaggaagctgaggaagacagtgaatggagatggcagccgggagaatggaaacaacagcagtgacaaggtgcggggcatcgagaccctggagagcgtgcccatcattggaggcttctgggagaccatctttggaaaccgcatcaagagggtgaagctgatcagcaacaagggcacagaaacagacaatgaccccagctgtgtgcaccccatcatcaagaggcggcagtgcaggcctgagatccgcatgtggcagacccgggagaaggccaagttcagtgatggagagaagtgccggcgggaggccttccggcggctgggcaatggagtgtctgatgacctgagcagtgaagaagatggagaggcccggacccagatgatcctgctgcggcgctctgtggagggcgccagcagtgacaatggctgtgaggtgaagaacaggaagagcatcctgagccgccacctgaacagccaggtgaagaagaccaccacccgctggtgccacatcgtgcgggacagcgacagcctggccgagagcgagtttgagagcgctgccttcagccagggcagccgctctggagtgtctgggggcagccgcagcctgaacatgagccggcgggacagcgagagcaccaggcatgacagcgagacagaggacatgctgtgggatgacctgctgcacggcccagaatgtcgcagctctgtgaccagtgacagcgagggcgcccacgtgaacaccctgcacagcggcaccaagagggaccccaaggaggatgtgttccagcagaaccacctgttctggctgcagaacagcagccccagcagtgacagagtgtctgccatcatctgggagggcaatgaatgcaagaagatggacatgtctgtgctggagatcagcggcatcatcatgagccgggtgaatgcctaccagcagggcgtgggctaccagatgctgggcaatgtggtgaccatcggcctggccttcttccccttcctgcacaggctcttccgggagaagagcctggaccagctgaagagcatctctgctgaggagatcctgaccctcttctgtggggcccctcctgtgacccccatcatcgtgctgagcatcatcaacttctttgagcggctgtgcctgacctggatgttcttcttcatgatgtgtgtggccgagaggacctacaagcagcgcttcctgtttgccaagctgttcagccacatcaccagcgccaggaaggccaggaaatatgagatcccccacttccggctgaagaaggtggagaacatcaagatctggctgagcctgcggagctacctgaagaggcggggcccccagaggtctgtggatgtggtggtgtcctctgtgttcctgctgaccctgagcatcgccttcatctgctgtgcccaggtgaaggtgagccacctgctgtag

SEQ ID NO: 166686 - DNA, 2130 bp, Artificial Sequence
  Description of Artificial Sequence: Synthetic coding sequence
atggccagcaatgaaagagatgccatctcctggtaccagaagaagatcggggcctatgaccagcagatctgggagaagagcattgagcagacccagatcaagggcctgaagaacaagcccaagaagatgggccacatcaagccagacctgattgatgtggacctgatccgggtgattgccatcgtgctgtacctgatgatgcccatcgtgaacatcagcgaggtgctgggccccctgtgcctgatgctgctgatgggcaccgtgcactgccagatcgtgtccacccagatcacccggcccagcggcaacaacggcaacagaagaagaaggaagctgaggaagacagtgaatggagatggcagcagagaaaatggaaacaacagcagtgacaaggtgcggggcatcgagaccctggagagcgtgcccatcatcggcggcttctgggagaccatcttcggcaaccgcatcaagagggtgaagctgatcagcaacaagggcacagaaacagacaatgaccccagctgtgtgcaccccatcatcaagaggcggcagtgcaggcctgagatccgcatgtggcagacccgggagaaggccaagttcagtgatggagagaagtgcagaagagaggccttccggcggctgggcaatggagtgtctgatgacctgagcagcgaggaggatggagaggcccggacccagatgatcctgctgcggcgctctgtggagggcgccagcagtgacaatggctgtgaggtgaagaacaggaagagcatcctgagccgccacctgaacagccaggtgaagaagaccaccacccgctggtgccacatcgtgcgggacagcgacagcctggccgagagcgagtttgaatctgctgccttcagccagggcagccgcagcggcgtgtctgggggcagccgcagcctgaacatgagcagaagagacagcgagagcaccaggcatgattctgaaacagaggacatgctgtgggatgacctgctgcacggccctgagtgccgcagctctgtgaccagtgacagcgagggcgcccacgtgaacaccctgcacagcggcaccaagagggaccccaaggaggatgtgttccagcagaaccacctgttctggctgcagaacagcagccccagcagtgacagagtgtctgccatcatctgggagggcaatgaatgcaagaagatggacatgtctgtgctggagatcagcggcatcatcatgagccgggtgaatgcctaccagcagggcgtgggctaccagatgctgggcaatgtggtgaccatcggcctggccttcttccccttcctgcacaggctcttccgggagaagagcctggaccagctgaagagcatctctgctgaggagatcctgaccctcttctgtggggcccctcctgtgacccccatcatcgtgctgagcatcatcaacttctttgagcggctgtgcctgacctggatgttcttcttcatgatgtgtgtggccgagaggacctacaagcagcgcttcctgtttgccaagctgttcagccacatcaccagcgccaggaaggccaggaaatatgagatcccccacttccggctgaagaaggtggagaacatcaagatctggctgagcctgcggagctacctgaagagaagaggcccccagaggtctgtggatgtggtggtgagcagcgtcttcctgctgaccctgagcatcgccttcatctgctgtgcccaggtgctgcagggccacaagaccttcctgaatgatgcctacaactgggagttcctgatctgggagacagccctgctgctcttcctgctgcggctggccagcctgggcagcgagaccaacaagaagtacagcaatgtgtccatcctgctgacagagcagatcaacctgtacctgaagatggagaagaagcccaacaagaaggagcagctgaccctggtgaacaacgtgctgaagctgagcaccaagctgctgaaggagctggacacccccttccggctgtatggcctgaccatgaaccccctcatctacaacatcaccagggtggtgatcctgtctgctgtgtctggagtcatcagtgacctgctgggcttcaacatccggctgtggaagatcaagagctag

SEQ ID NO: 166687 - DNA, 2154 bp, Artificial Sequence
  Description of Artificial Sequence: Synthetic coding sequence
atggccagcaatgaaagagatgccatctcctggtaccagaagaagatcggggcctatgaccagcagatctgggagaagagcattgagcagacccagatcaagggcctgaagaacaagcccaagaagatgggccacatcaagccagacctgattgatgtggacctgatccggggcagcacctttgccaaggccaagccagagatcccctggaccagcctgaccaggaagggcctggtgcgggtggtgttcttccccctcttcagcaactggtggatccaggtgaccagcctgcgcatctttgtgtggctgctgctgctgtacttcatgcaggtgattgccatcgtgctgtacctgatgatgcccatcgtgaacatcagcgaggtgctgggccccctgtgcctgatgctgctgatgggcaccgtgcactgccagatcgtgtccacccagatcacccggcccagcggcaacaatggaaacagaagaagacgcatcaagagggtgaagctgatcagcaacaagggcacagaaacagacaatgaccccagctgtgtgcaccccatcatcaagaggcggcagtgcaggcctgagatccgcatgtggcagacccgggagaaggccaagttcagtgatggagagaagtgcagaagagaggccttccggcggctgggcaatggagtgtctgatgacctgagcagcgaggaggatggagaggcccggacccagatgatcctgctgcggcgctctgtggagggcgccagcagtgacaatggctgtgaggtgaagaacaggaagagcatcctgagccgccacctgaacagccaggtgaagaagaccaccacccgctggtgccacatcgtgcgggacagcgacagcctggccgagagcgagtttgaatctgctgccttcagccagggcagccgcagcggcgtgtctgggggcagccgcagcctgaacatgagcagaagagacagcgagagcaccaggcatgattctgaaacagaggacatgctgtgggatgacctgctgcacggccctgagtgccgcagctctgtgaccagtgacagcgagggcgcccacgtgaacaccctgcacagcggcaccaagagggaccccaaggaggatgtgttccagcagaaccacctgttctggctgcagaacagcagccccagcagtgacagagtgtctgccatcatctgggagggcaatgaatgcaagaagatggacatgtctgtgctggagatcagcggcatcatcatgagccgggtgaatgcctaccagcagggcgtgggctaccagatgctgggcaatgtggtgaccatcggcctggccttcttccccttcctgcacaggctcttccgggagaagagcctggaccagctgaagagcatctctgctgaggagatcctgaccctcttctgtggggcccctcctgtgacccccatcatcgtgctgagcatcatcaacttctttgagcggctgtgcctgacctggatgttcttcttcatgatgtgtgtggccgagaggacctacaagcagcgcttcctgtttgccaagctgttcagccacatcaccagcgccaggaaggccaggaaatatgagatcccccacttccggctgaagaaggtggagaacatcaagatctggctgagcctgcggagctacctgaagagaagaggcccccagaggtctgtggatgtggtggtgagcagcgtcttcctgctgaccctgagcatcgccttcatctgctgtgcccaggtgctgcagggccacaagaccttcctgaatgatgcctacaactgggagttcctgatctgggagacagccctgctgctcttcctgctgcggctggccagcctgggcagcgagaccaacaagaagtacagcaatgtgtccatcctgctgacagagcagatcaacctgtacctgaagatggagaagaagcccaacaagaaggagcagctgaccctggtgaacaacgtgctgaagctgagcaccaagctgctgaaggagctggacacccccttccggctgtatggcctgaccatgaaccccctcatctacaacatcaccagggtggtgatcctgtctgctgtgtctggagtcatcagtgacctgctgggcttcaacatccgcatctggaagcacagcagctag

SEQ ID NO: 166688 - DNA, 2154 bp, Artificial Sequence
  Description of Artificial Sequence: Synthetic coding sequence
atggccagcaatgaaagagatgccatctcctggtaccagaagaagatcggggcctatgaccagcagatctgggagaagagcattgagcagacccagatcaagggcctgaagaacaagcccaagaagatgggccacatcaagccagacctgattgatgtggacctgatccggggcagcacctttgccaaggccaagccagagatcccctggaccagcctgaccaggaagggcctggtgcgggtggtgttcttccccctcttcagcaactggtggatccaggtgaccagcctgcgcatctttgtgtggctgctgctgctgtacttcatgcaggtgattgccatcgtgctgtacctgatgatgcccatcgtgaacatcagcgaggtgctgggccccctgtgcctgatgctgctgatgggcaccgtgcactgccagatcgtgtccacccagatcacccggcccagcggcaacaatggaaacagaagaagacgcatcaagagggtgaagctgatcagcaacaagggcacagaaacagacaatgaccccagctgtgtgcaccccatcatcaagaggcggcagtgcaggcctgagatccgcatgtggcagacccgggagaaggccaagttcagtgatggagagaagtgcagaagagaggccttccggcggctgggcaatggagtgtctgatgacctgagcagcgaggaggatggagaggcccggacccagatgatcctgctgcggcgctctgtggagggcgccagcagtgacaatggctgtgaggtgaagaacaggaagagcatcctgagccgccacctgaacagccaggtgaagaagaccaccacccgctggtgccacatcgtgcgggacagcgacagcctggccgagagcgagtttgaatctgctgccttcagccagggcagccgcagcggcgtgtctgggggcagccgcagcctgaacatgagcagaagagacagcgagagcaccaggcatgattctgaaacagaggacatgctgtgggatgacctgctgcacggccctgagtgccgcagctctgtgaccagtgacagcgagggcgcccacgtgaacaccctgcacagcggcaccaagagggaccccaaggaggatgtgttccagcagaaccacctgttctggctgcagaacagcagccccagcagtgacagagtgtctgccatcatctgggagggcaatgaatgcaagaagatggacatgtctgtgctggagatcagcggcatcatcatgagccgggtgaatgcctaccagcagggcgtgggctaccagatgctgggcaatgtggtgaccatcggcctggccttcttccccttcctgcacaggctcttccgggagaagagcctggaccagctgaagagcatctctgctgaggagatcctgaccctcttctgtggggcccctcctgtgacccccatcatcgtgctgagcatcatcaacttctttgagcggctgtgcctgacctggatgttcttcttcatgatgtgtgtggccgagaggacctacaagcagcgcttcctgtttgccaagctgttcagccacatcaccagcgccaggaaggccaggaaatatgagatcccccacttccggctgaagaaggtggagaacatcaagatctggctgagcctgcggagctacctgaagagaagaggcccccagaggtctgtggatgtggtggtgagcagcgtcttcctgctgaccctgagcatcgccttcatctgctgtgcccaggtgctgcagggccacaagaccttcctgaatgatgcctacaactgggagttcctgatctgggagacagccctgctgctcttcctgctgcggctggccagcctgggcagcgagaccaacaagaagtacagcaatgtgtccatcctgctgacagagcagatcaacctgtacctgaagatggagaagaagcccaacaagaaggagcagctgaccctggtgaacaacgtgctgaagctgagcaccaagctgctgaaggagctggacacccccttccggctgtatggcctgaccatgaaccccctcatctacaacatcaccagggtggtgatcctgtctgctgtgtctggagtcatcagtgacctgctgggcttcaacatccggctgtggaagatcaagagctag

SEQ ID NO: 166689 - DNA, 2130 bp, Artificial Sequence; identical to SEQ ID NO: 166686
  Description of Artificial Sequence: Synthetic coding sequence

SEQ ID NO: 166690 - DNA, 2289 bp, Artificial Sequence
  Description of Artificial Sequence: Synthetic coding sequence
atggccagcaatgaaagagatgccatctcctggtaccagaagaagatcggggcctatgaccagcagatctgggagaagagcattgagcagacccagatcaagggcctgaagaacaagcccaagaagatgggccacatcaagccagacctgattgatgtggacctgatccggggcagcacctttgccaaggccaagccagagatcccctggaccagcctgaccaggaagggcctggtgcgggtggtgttcttccccctcttcagcaactggtggatccaggtgaccagcctgcgcatctttgtgtggctgctgctgctgtacttcatgcaggtgattgccatcgtgctgtacctgatgatgcccatcgtgaacatcagcgaggtgctgggccccctgtgcctgatgctgctgatgggcaccgtgcactgccagatcgtgtccacccagatcacccggcccagcggcaacaatggaaacagaagaagaaggaagctgaggaagacagtgaatggagatggcagccgggagaatggaaacaacagcagtgacaaggtgcggggcatcgagaccctggagagcgtgcccatcattggaggcttctgggagaccatctttggaaaccgcatcaagagggtgaagctgatcagcaacaagggcacagaaacagacaatgaccccagctgtgtgcaccccatcatcaagaggcggcagtgcaggcctgagatccgcatgtggcagacccgggagaaggccaagttcagtgatggagagaagtgccggcgggaggccttccggcggctgggcaatggagtgtctgatgacctgagcagtgaagaagatggagaggcccggacccagatgatcctgctgcggcgctctgtggagggcgccagcagtgacaatggctgtgaggtgaagaacaggaagagcatcctgagccgccacctgaacagccaggtgaagaagaccaccacccgctggtgccacatcgtgcgggacagcgacagcctggccgagagcgagtttgagagcgctgccttcagccagggcagccgctctggagtgtctgggggcagccgcagcctgaacatgagccggcgggacagcgagagcaccaggcatgacagcgagacagaggacatgctgtgggatgacctgctgcacggcccagaatgtcgcagctctgtgaccagtgacagcgagggcgcccacgtgaacaccctgcacagcggcaccaagagggaccccaaggaggatgtgttccagcagaaccacctgttctggctgcagaacagcagccccagcagtgacagagtgtctgccatcatctgggagggcaatgaatgcaagaagatggacatgtctgtgctggagatcagcggcatcatcatgagccgggtgaatgcctaccagcagggcgtgggctaccagatgctgggcaatgtggtgaccatcggcctggccttcttccccttcctgcacaggctcttccgggagaagagcctggaccagctgaagagcatctctgctgaggagatcctgaccctcttctgtggggcccctcctgtgacccccatcatcgtgctgagcatcatcaacttctttgagcggctgtgcctgacctggatgttcttcttcatgatgtgtgtggccgagaggacctacaagcagcgcttcctgtttgccaagctgttcagccacatcaccagcgccaggaaggccaggaaatatgagatcccccacttccggctgaagaaggtggagaacatcaagatctggctgagcctgcggagctacctgaagaggcggggcccccagaggtctgtggatgtggtggtgtcctctgtgttcctgctgaccctgagcatcgccttcatctgctgtgcccaggtgctgcagggccacaagaccttcctgaatgatgcctacaactgggagttcctgatctgggagacagccctgctgctcttcctgctgcggctggccagcctgggcagcgagaccaacaagaagtacagcaatgtgtccatcctgctgacagagcagatcaacctgtacctgaagatggagaagaagcccaacaagaaggagcagctgaccctggtgaacaacgtgctgaagctgagcaccaagctgctgaaggagctggacacccccttccggctgtatggcctgaccatgaaccccctcatctacaacatcaccagggtggtgatcctgtctgctgtgtctggagtcatcagtgacctgctgggcttcaacatccggctgtggaagatcaagagctag

SEQ ID NO: 166691 - DNA, 2289 bp, Artificial Sequence; identical to SEQ ID NO: 166690
  Description of Artificial Sequence: Synthetic coding sequence

SEQ ID NO: 166692 - DNA, 996 bp, Artificial Sequence
  Description of Artificial Sequence: Synthetic coding sequence
tgacagacccgggagaaggccaagttcagtgatggagagaagtgccggcgggaggccttccggcggctgggcaatggagtgtctgatgacctgagcagtgaagaagatggagaggcccggacccagatgatcctgctgcggcgctctgtggagggcgccagcagtgacaatggctgtgaggtgaagaacaggaagagcatcctgagccgccacctgaacagccaggtgaagaagaccaccacccgctggtgccacatcgtgcgggacagcgacagcctggccgagagcgagtttgagagcgctgccttcagccagggcagccgctctggagtgtctgggggcagccgcagcctgaacatgagccggcgggacagcgagagcaccaggcatgacagcgagacagaggacatgctgtgggatgacctgctgcacggcccagaatgtcgcagctctgtgaccagtgacagcgagggcgcccacgtgaacaccctgcacagcggcaccaagagggaccccaaggaggatgtgttccagcagaaccacctgttctggctgcagaacagcagccccagcagtgacagagtgtctgccatcatctgggagggcaatgaatgcaagaagatggacatgtctgtgctggagatcagcggcatcatcatgagccgggtgaatgcctaccagcagggcgtgggctaccagatgctgggcaatgtggtgaccatcggcctggccttcttccccttcctgcacaggctcttccgggagaagagcctggaccagctgaagagcatctctgctgaggagatcctgaccctcttctgtggggcccctcctgtgacccccatcatcgtgctgagcatcatcaacttctttgagcggctgtgcctgacctggatgttcttcttcatgatgtgtgtggccgagaggacctacaagcaggtgtctggagagatcaggaagatcttctacctgttcctgtacatgatcttccactag

SEQ ID NO: 166693 - DNA, 318 bp, Artificial Sequence
  Description of Artificial Sequence: Synthetic coding sequence
atggccagcaatgaaagagatgccatctcctggtaccagaagaagatcggggcctatgaccagcagatctgggagaagagcattgagcagacccagatcaagggcctgaagaacaagcccaagaagatgggccacatcaagccagacctgattgatgtggacctgatccggggcagcacctttgccaaggccaagccagagatcccctggaccagcctgaccaggaagggcctggtgcgggtggtgttcttccccctcttcagcaactggtggatccaggtgaccagcctgcgcatctttgtgtggctgctgctgtag

SEQ ID NO: 166694 - DNA, 702 bp, Artificial Sequence
  Description of Artificial Sequence: Synthetic coding sequence
atggccagcaatgaaagagatgccatctcctggtaccagaagaagatcggggcctatgaccagcagatctgggagaagagcattgagcagacccagatcaagggcctgaagaacaagcccaagaagatgggccacatcaagccagacctgattgatgtggacctgatccggggcagcacctttgccaaggccaagccagagatcccctggaccagcctgaccaggaagggcctggtgcgggtggtgttcttccccctcttcagcaactggtggatccaggtgaccagcctgcgcatctttgtgtggctgctgctgctgtacttcatgcaggtgattgccatcgtgctgtacctgatgatgcccatcgtgaacatcagcgaggtgctgggccccctgtgcctgatgctgctgatgggcaccgtgcactgccagatcgtgtccacccagatcacccggcccagcggcaacaatggaaacagaagaagaaggaagctgaggaagacagtgaatggagatggcagccgggagaatggaaacaacagcagtgacaaggtgcggggcatcgagaccctggagagcgtgcccatcattggaggcttctgggagaccatctttggaaacagaaggctgctgggcgtgtgggtgatgggctgcctgatgacctgccaggtgaagaagatggtgaagcacggccacaggtag

SEQ ID NO: 166695 - DNA, 2760 bp, Artificial Sequence
  Description of Artificial Sequence: Synthetic coding sequence
atgaagtttgcctaccgcttcagcaacctgctgggcaccgtgtaccgccggggcaacctgaacttcacctgtgatggcaacagcgtcatcagccctgtgggcaacagagtgacagtgtttgacctgaagaacaacaagagtgacaccctgcccctggccacccgctacaacgtgaagtgtgtgggcctgagcccagatggccgcctggccatcatcgtggatgagggcggagatgccctgctggtgtccctggtgtgccgctctgtgctgcaccacttccacttcaagggctctgtgcacagcgtgtccttctccccagatggcaggaagtttgtggtgaccaagggcaacatcgcccagatgtaccacgcccctgggaagaagcgggagttcaatgcctttgtgctggacaagacctacttcggcccctatgatgagaccacctgcatcgactggacagatgacagccgctgctttgtggtgggcagcaaggacatgagcacctgggtgtttggagctgagcgctgggacaacctgatctactatgccctgggcggccacaaggatgccatcgtggcctgcttctttgagagcaacagcctggacctgtacagcctgagccaggatggagtgctgtgcatgtggcagtgtgacaccccacctgagggcctgcggctgaagcccccagctggctggaaggctgacctgctgcagcgggaggaggaggaggaggaggaggaggaccaggagggggaccgggagaccaccatccggggcaaggccaccccagctgaggaggagaagacaggcaaggtgaagtacagccggctggccaagtacttcttcaacaaggagggggacttcaacaacctgacagctgctgccttccacaagaagagccacctgctggtgactggatttgccagcggcatcttccacctgcacgagctgcctgagttcaacctgatccacagcctgagcatcagtgaccagagcatcgcctctgtggccatcaacagcagcggggactggatcgccttcggctgcagcggcctgggccagctgctggtgtgggagtggcagagcgagagctatgtgctgaagcagcagggccacttcaacagcatggtggccctggcctacagcccagatggccagtacatcgtgactggaggagatgatggcaaggtgaaggtgtggaacaccctgagcggcttctgctttgtgaccttcacagagcacagcagcggcgtgactggagtgaccttcaccgccaccggctacgtggtggtgaccagctccatggatggcaccgtgcgggcctttgacctgcaccgctacagaaacttccgcaccttcaccagcccccggcccacccagttcagctgtgtggccgtggatgccagcggggagatcgtgtctgctggggcccaggacagctttgagatctttgtgtggagcatgcagacaggccgcctgctggatgtgctgagcggccacgagggccccatcagcggcctgtgcttcaaccccatgaagtctgtgctggccagcgcctcctgggacaagacagtgcggctgtgggacatgtttgacagctggaggaccaaggagaccctggccctgaccagtgatgccctggccgtgaccttccggccagatggagctgagctggccgtggccaccctgaacagccagatcaccttctgggaccctgaaaatgctgtgcagacaggcagcattgagggcagacatgacctgaagacaggcaggaaggagctggacaagatcacagccaagcacgccgccaagggcaaggccttcaccgccctgtgctacagcgcagatggccacagcatcctggccggcggcatgagcaagtttgtgtgcatctaccacgtgcgggagcagatcctgatgaagagatttgagatcagctgcaacctgagcctggatgccatggaggagttcctgaacagaaggaagatgacagaatttggaaacctggccctgattgaccaggatgctggccaggaggatggagtggccatccccctgcccggggtgaggaaaggagacatgagcagccgccacttcaagccagagatccgggtgaccagcctgcgcttcagccccaccggccgctgctgggccgccaccaccacagagggcctgctgatctacagcctggacaccagggtgctgtttgacccctttgagctggacacctctgtgaccccaggccgggtgcgggaggccctgcggcagcaggacttcacccgggccatcctgatggccctgcggctgaatgaaagcaagctggtgcaggaggccctggaggccgtgcccagaggagaaattgaggtggtgaccagcagcctgcctgagctgtatgtggagaaggtgctggagttcctggccagcagctttgaggtgagccgccacctggagttctacctgctgtggacccacaagctgctgatgctgcacggccagaagctgaagagccgggccggcaccctgctgcctgtgatccagttcctgcagaagagcatccagaggcacctggatgacctgagcaagctgtgctcctggaaccactacaacatgcagtatgccctggccgtgtccaagcagaggggcaccaagaggagcctggaccccctgggcagcgaggaggaggccgaggcctctgaagatgacagcctgcacctgctgggcggcggcggccgggacagcgaggaggagatgctggcctag

SEQ ID NO: 166696 - DNA, 1686 bp, Artificial Sequence
  Description of Artificial Sequence: Synthetic coding sequence
atggccttcatggagaagcccccagctgggaaggtgctgctggatgacacagtgcccctgacagctgccatcgaggccagccagagcctgcagagccacaccatcgtgcggcgctacagcgactttgacctgctgaacaacagcctgcagattgctggcctgagcctgcccctgccccccaagaagctgattggcaacatggaccgggagttcatcgccgagcggcagaagggcctgcagaactacctgaatgtcatcaccaccaaccacatcctgagcaactgtgagctggtgaagaagttcctggaccccaacaactacagcgccaactacacagagatcgccctgcagcaggtgtccatgttcttccgctctgagcccaagtgggaggtggtggagcccctgaaggacatcggctggaggatcaggaagaagtacttcctgatgaagatcaagaaccagcccaaggagcggctggtgctgtcctgggccgacctgggccctgacaagtacctgagtgacaaggacttccagtgcctgatcaagctgctgcccagctgcctgcacccctacatctacagagtgacctttgccacagccaatgaaagcagcgccctgctgatccgcatgtttaatgagaagggcaccctgaaggacctgatctacaaggccaagcccaaggaccccttcctgaagaagtactgcaaccccaagaagatccagggcctggagctgcagcagatcaagacctacggccggcagatcctggaggtgctgaagttcctgcatgacaagggcttcccctacggccacctgcacgccagcaatgtgatgctggatggagacacctgccgcctgctggacctggagaacagcctgctgggcctgcccagcttctaccgcagctacttcagccagttcaggaagatcaacaccctggagagcgtggatgtgcactgcttcggccacctgctgtatgagatgacctacggccggcccccagacagcgtgcctgtggacagcttccccccagcccccagcatggctgtggtggccgtgctggagagcaccctgagctgtgaggcctgcaagaatggcatgcccaccatcagccggctgctgcagatgcccctcttcagtgatgtgctgctgaccaccagcgagaagccccagttcaagatccccaccaagctgaaggaggccctgcgcatcgccaaggaatgtattgagaagaggctcatcgaggagcagaagcagatccaccagcaccggcggctgacccgggcccagagccaccacggcagcgaggaggagaggaagaagaggaagatcctggccaggaagaagagcaagaggtctgccctggagaacagcgaggagcacagcgccaagtacagcaacagcaacaacagcgctggcagcggggccagcagccccctgaccagccccagcagccccaccccacccagcaccagcggcatcagcgccctgcccccacctcctcctcctcctcctcctcctgctgcccccctgcccccagccagcacagaggccccagcccagctgagcagccaggccgtgaatggcatgagcagaggagccctgctgagcagcatccagaacttccagaagggcaccctgaggaaggccaagacctgtgaccacagcgcccccaagattggatag

SEQ ID NO: 166697 - DNA, 1737 bp, Artificial Sequence
  Description of Artificial Sequence: Synthetic coding sequence
atggccttcatggagaagcccccagctgggaaggtgctgctggatgacacagtgcccctgacagctgccatcgaggccagccagagcctgcagagccacacagagtacatcatccgggtgcagaggggcatctctgtggagaacagctggcagatcgtgcggcgctacagcgactttgacctgctgaacaacagcctgcagattgctggcctgagcctgcccctgccccccaagaagctgattggcaacatggaccgggagttcatcgccgagcggcagaagggcctgcagaactacctgaatgtcatcaccaccaaccacatcctgagcaactgtgagctggtgaagaagttcctggaccccaacaactacagcgccaactacacagaaattgccctgcagcaggtgtccatgttcttccgctctgagcccaagtgggaggtggtggagcccctgaaggacatcggctggaggatcaggaagaagtacttcctgatgaagatcaagaaccagcccaaggagcggctggtgctgtcctgggccgacctgggccctgacaagtacctgagtgacaaggacttccagtgcctgatcaagctgctgcccagctgcctgcacccctacatctacagagtgacctttgccacagccaatgaatcttctgccctgctgatccgcatgtttaatgagaagggcaccctgaaggacctgatctacaaggccaagcccaaggaccccttcctgaagaagtactgcaaccccaagaagatccagggcctggagctgcagcagatcaagacctacggccggcagatcctggaggtgctgaagttcctgcatgacaagggcttcccctacggccacctgcacgccagcaatgtgatgctggatggagacacctgccgcctgctggacctggagaacagcctgctgggcctgcccagcttctaccgcagctacttcagccagttcaggaagatcaacaccctggagagcgtggatgtgcactgcttcggccacctgctgtatgagatgacctacggccggcccccagattctgtgcctgtggacagcttccccccagcccccagcatggctgtggtggccgtgctggagagcaccctgagctgtgaggcctgcaagaatggcatgcccaccatcagccggctgctgcagatgcccctcttcagtgatgtgctgctgaccaccagcgagaagccccagttcaagatccccaccaagctgaaggaggccctgagaattgccaaggagtgcatcgagaagaggctgattgaggagcagaagcagatccaccagcaccggcggctgacccgggcccagagccaccacggcagcgaggaggagaggaagaagaggaagatcctggccaggaagaagagcaagaggtctgccctggagaacagcgaggagcacagcgccaagtacagcaacagcaacaacagcgctggcagcggggccagcagccccctgaccagccccagcagccccaccccacccagcaccagcggcatcagcgccctgcccccacctcctcctcctcctcctcctcctgctgcccccctgcccccagccagcacagaggccccagcccagctgagcagccaggccgtgaatggcatgagcagaggagccctgctgagcagcatccagaacttccagaagggcaccctgaggaaggccaagacctgtgaccacagcgcccccaagattggatag

SEQ ID NO: 166698 - DNA, 1638 bp, Artificial Sequence
  Description of Artificial Sequence: Synthetic coding sequence
atggccttcatggagaagcccccagctgggaaggtgctgctggatgacacagtgcccctgacagctgccatcgaggccagccagagcctgcagagccacaccatcgccggcctgagcctgcccctgccccccaagaagctgattggcaacatggaccgggagttcatcgccgagcggcagaagggcctgcagaactacctgaatgtcatcaccaccaaccacatcctgagcaactgtgagctggtgaagaagttcctggaccccaacaactacagcgccaactacacagagatcgccctgcagcaggtgtccatgttcttccgctctgagcccaagtgggaggtggtggagcccctgaaggacatcggctggaggatcaggaagaagtacttcctgatgaagatcaagaaccagcccaaggagcggctggtgctgtcctgggccgacctgggccctgacaagtacctgagtgacaaggacttccagtgcctgatcaagctgctgcccagctgcctgcacccctacatctacagagtgacctttgccacagccaatgaaagcagcgccctgctgatccgcatgtttaatgagaagggcaccctgaaggacctgatctacaaggccaagcccaaggaccccttcctgaagaagtactgcaaccccaagaagatccagggcctggagctgcagcagatcaagacctacggccggcagatcctggaggtgctgaagttcctgcatgacaagggcttcccctacggccacctgcacgccagcaatgtgatgctggatggagacacctgccgcctgctggacctggagaacagcctgctgggcctgcccagcttctaccgcagctacttcagccagttcaggaagatcaacaccctggagagcgtggatgtgcactgcttcggccacctgctgtatgagatgacctacggccggcccccagacagcgtgcctgtggacagcttccccccagcccccagcatggctgtggtggccgtgctggagagcaccctgagctgtgaggcctgcaagaatggcatgcccaccatcagccggctgctgcagatgcccctcttcagtgatgtgctgctgaccaccagcgagaagccccagttcaagatccccaccaagctgaaggaggccctgcgcatcgccaaggaatgtattgagaagaggctcatcgaggagcagaagcagatccaccagcaccggcggctgacccgggcccagagccaccacggcagcgaggaggagaggaagaagaggaagatcctggccaggaagaagagcaagaggtctgccctggagaacagcgaggagcacagcgccaagtacagcaacagcaacaacagcgctggcagcggggccagcagccccctgaccagccccagcagccccaccccacccagcaccagcggcatcagcgccctgcccccacctcctcctcctcctcctcctcctgctgcccccctgcccccagccagcacagaggccccagcccagctgagcagccaggccgtgaatggcatgagcagaggagccctgctgagcagcatccagaacttccagaagggcaccctgaggaaggccaagacctgtgaccacagcgcccccaagattggatag

SEQ ID NO: 166699 - DNA, 1548 bp, Artificial Sequence
  Description of Artificial Sequence: Synthetic coding sequence
atggccttcatggagaagcccccagctgggaaggtgctgctggatgacacagtgcccctgacagctgccatcgaggccagccagagcctgcagagccacacagagtacatcatccgggtgcagaggggcatctctgtggagaacagctggcagatcgtgcggcgctacagcgactttgacctgctgaacaacagcctgcagattgctggcctgagcctgcccctgccccccaagaagctgattggcaacatggaccgggagttcatcgccgagcggcagaagggcctgcagaactacctgaatgtcatcaccaccaaccacatcctgagcaactgtgagctggtgaagaagttcctggaccccaacaactacagcgccaactacacagaaattgccctgcagcaggtgtccatgttcttccgctctgagcccaagtgggaggtggtggagcccctgaaggacatcggctggaggatcaggaagaagtacttcctgatgaagatcaagaaccagcccaaggagcggctggtgctgtcctgggccgacctgggccctgacaagtacctgagtgacaaggacttccagtgcctgatcaagctgctgcccagctgcctgcacccctacatctacagagtgacctttgccacagccaatgaatcttctgccctgctgatccgcatgtttaatgagaagggcaccctgaaggacctgatctacaaggccaagcccaaggaccccttcctgaagaagtactgcaaccccaagaagatccagggcctggagctgcagcagatcaagacctacggccggcagatcctggaggtgctgaagttcctgcatgacaagggcttcccctacggccacctgcacgccagcaatgtgatgctggatggagacacctgccgcctgctggacctggagaacagcctgctgggcctgcccagcttctaccgcagctacttcagccagttcaggaagatcaacaccctggagagcgtggatgtgcactgcttcggccacctgctgtatgagatgacctacggccggcccccagattctgtgcctgtggacagcttccccccagcccccagcatggctgtggtggccgtgctggagagcaccctgagctgtgaggcctgcaagaatggcatgcccaccatcagccggctgctgcagatgcccctcttcagtgatgtgctgctgaccaccagcgagaagccccagttcaagatccccaccaagctgaaggaggccctgagaattgccaaggagtgcatcgagaagaggctgattgaggagcagaagcagatccaccagcaccggcggctgacccgggcccagagccaccacggcagcgaggaggagaggaagaagaggaagatcctggccaggaagaagagcaagaggtctgccctggagaacagcgaggagcacagcgccaagtacagcaacagcaacaacagcgctggcagcggggccagcagccccctgaccagccccagcagccccaccccacccagcacctctgtggagcacgcccccttctag

SEQ ID NO: 166700 - DNA, 1326 bp, Artificial Sequence
  Description of Artificial Sequence: Synthetic coding sequence
atgttcttccgctctgagcccaagtgggaggtggtggagcccctgaaggacatcggctggaggatcaggaagaagtacttcctgatgaagatcaagaaccagcccaaggagcggctggtgctgtcctgggccgacctgggccctgacaagtacctgagtgacaaggacttccagtgcctgatcaagctgctgcccagctgcctgcacccctacatctacagagtgacctttgccacagccaatgaaagcagcgccctgctgatccgcatgtttaatgagaagggcaccctgaaggacctgatctacaaggccaagcccaaggaccccttcctgaagaagtactgcaaccccaagaagatccagggcctggagctgcagcagatcaagacctacggccggcagatcctggaggtgctgaagttcctgcatgacaagggcttcccctacggccacctgcacgccagcaatgtgatgctggatggagacacctgccgcctgctggacctggagaacagcctgctgggcctgcccagcttctaccgcagctacttcagccagttcaggaagatcaacaccctggagagcgtggatgtgcactgcttcggccacctgctgtatgagatgacctacggccggcccccagacagcgtgcctgtggacagcttccccccagcccccagcatggctgtggtggccgtgctggagagcaccctgagctgtgaggcctgcaagaatggcatgcccaccatcagccggctgctgcagatgcccctcttcagtgatgtgctgctgaccaccagcgagaagccccagttcaagatccccaccaagctgaaggaggccctgcgcatcgccaaggaatgtattgagaagaggctcatcgaggagcagaagcagatccaccagcaccggcggctgacccgggcccagagccaccacggcagcgaggaggagaggaagaagaggaagatcctggccaggaagaagagcaagaggtctgccctggagaacagcgaggagcacagcgccaagtacagcaacagcaacaacagcgctggcagcggggccagcagccccctgaccagccccagcagccccaccccacccagcaccagcggcatcagcgccctgcccccacctcctcctcctcctcctcctcctgctgcccccctgcccccagccagcacagaggccccagcccagctgagcagccaggccgtgaatggcatgagcagaggagccctgctgagcagcatccagaacttccagaagggcaccctgaggaaggccaagacctgtgaccacagcgcccccaagattggatag

SEQ ID NO: 166701 - DNA, 1005 bp, Artificial Sequence
  Description of Artificial Sequence: Synthetic coding sequence
atgttcttccgctctgagcccaagtgggaggtggtggagcccctgaaggacatcggctggaggatcaggaagaagtacttcctgatgaagatcaagaaccagcccaaggagcggctggtgctgtcctgggccgacctgggccctgacaagtacctgagtgacaaggacttccagtgcctgatcaagctgctgcccagctgcctgcacccctacatctacagagtgacctttgccacagccaatgaaagcagcgccctgctgatccgcatgtttaatgagaagggcaccctgaaggacctgatctacaaggccaagcccaaggaccccttcctgaagaagtactgcaaccccaagaagatccagggcctggagctgcagcagatcaagacctacggccggcagatcctggaggtgctgaagttcctgcatgacaagggcttcccctacggccacctgcacgccagcaatgtgatgctggatggagacacctgccgcctgctggacctggagaacagcctgctgggcctgcccagcttctaccgcagctacttcagccagttcaggaagatcaacaccctggagagcgtggatgtgcactgcttcggccacctgctgtatgagatgacctacggccggcccccagacagcgtgcctgtggacagcttccccccagcccccagcatggctgtggtggccgtgctggagagcaccctgagctgtgaggcctgcaagaatggcatgcccaccatcagccggctgctgcagatgcccctcttcagtgatgtgctgctgaccaccagcgagaagccccagttcaagatccccaccaagctgaaggaggccctgcgcatcgccaaggaatgtattgagaagaggctcatcgaggagcagaagcagatccaccagcaccggcggctgacccgggcccagagccaccacggcagcgaggaggagaggaagaagaaggacttcagcagcaaggaggtgaagaccatctgcagctag

SEQ ID NO: 166702 - DNA, 1110 bp, Artificial Sequence
  Description of Artificial Sequence: Synthetic coding sequence
atgaagagccctgagaagaagaggaggaagagcaacacccagggccctgcctacagccacctgacagaatttgcccccccacccacccccatggtggaccacctggtggccagcaacccctttgaagatgactttggagcccccaaggtgggcgtggccgccccacccttcctgggcagccctgtgccctttggaggcttccgggtgcagggcggcatggccggccaggtgcccccaggctacagcactggaggcggcggcggcccccagcccctgcggcggcagcccccacccttcccccccaaccccatgggccctgccttcaacatgccaccccagggccctggctacccacctcctggcaacatgaacttccccagccagcccttcaaccagcccctgggccagaacttcagcccccccagcggccagatgatgcctggccctgtgggcggcttcggccccatgatcagccccaccatgggccagccccccagggctgagctgggcccccccagcctgagccagagatttgcccagcccggggcccccttcggccccagccccctgcagaggcctggccagggcctgcccagcctgccccccaacaccagccccttccctggccctgaccccggcttccctggccctggaggagaagatggcggcaagcccctgaaccccccagccagcacagccttcccccaggagccccacagcggcagccctgctgctgctgtgaatggaaaccagcccagcttcccccccaacagcagcggccggggcggcggcaccccagatgccaacagcctggcccctcctgggaaggccggcggcggcagcggcccccagcccccacctggcctggtgtacccctgtggggcctgccgctctgaggtgaatgatgaccaggatgccatcctgtgtgaggccagctgccagaagtggttccaccgggagtgcaccggcatgacagaaagtgcctacggcctgctgaccacagaggccagcgctgtgtgggcctgtgacctgtgcctgaagaccaaggagatccagagcgtgtacatccgggagggcatgggccagctggtggccgccaatgatggatag

SEQ ID NO: 166703 - DNA, 1221 bp, Artificial Sequence
  Description of Artificial Sequence: Synthetic coding sequence
atggccgccagcgcccctcctcctccagacaagctggagggcggcggcggccctgcccctcctccagccccacccagcactggaaggaagcagggcaaggccggcctgcagatgaagagccctgagaagaagaggaggaagagcaacacccagggccctgcctacagccacctgacagaatttgcccccccacccacccccatggtggaccacctggtggccagcaacccctttgaagatgactttggagcccccaaggtgggcgtggccgccccacccttcctgggcagccctgtgccctttggaggcttccgggtgcagggcggcatggccggccaggtgcccccaggctacagcactggaggcggcggcggcccccagcccctgcggcggcagcccccacccttcccccccaaccccatgggccctgccttcaacatgccaccccagggccctggctacccacctcctggcaacatgaacttccccagccagcccttcaaccagcccctgggccagaacttcagccccccatctggccagatgatgcctggccctgtgggcggcttcggccccatgatcagccccaccatgggccagccccccagggctgagctgggcccccccagcctgagccagagatttgcccagcccggggcccccttcggccccagccccctgcagaggcctggccagggcctgcccagcctgccccccaacaccagccccttccctggccctgaccccggcttccctggccctggaggagaagatggcggcaagcccctgaaccccccagccagcacagccttcccccaggagccccacagcggcagccctgctgctgctgtgaatggaaaccagcccagcttcccccccaacagcagcggccggggcggcggcaccccagatgccaacagcctggcccctcctgggaaggccggcggcggcagcggcccccagcccccacctggcctggtgtacccctgtggggcctgccgctctgaggtgaatgatgaccaggatgccatcctgtgtgaggccagctgccagaagtggttccacagagaatgtacaggcatgacagagagcgcctacggcctgctgaccacagaggccagcgctgtgtgggcctgtgacctgtgcctgaagaccaaggagatccagagcgtgtacatccgggagggcatgggccagctggtggccgccaatgatggatag

SEQ ID NO: 166704 - DNA, 939 bp, Artificial Sequence
  Description of Artificial Sequence: Synthetic coding sequence
atggaggaggagtgccgggtgctgagcatccagagccacgtgatccggggctacgtgggcaacagagctgccaccttccccctgcaggtgctgggctttgaaattgatgctgtgaacagcgtgcagttcagcaaccacacaggctacgcccactggaagggccaggtgctgaacagtgatgagctgcaggagctgtatgagggcctgcggctgaacaacatgaacaagtatgactatgtgctgaccggctacacccgggacaagagcttcctggccatggtggtggacatcgtgcaggagctgaagcagcagaacccccggctggtgtatgtgtgtgaccctgtgctgggggacaagtgggatggagagggctccatgtatgtgcctgaggacctgctgcctgtgtacaaggagaaggtggtgcccctggccgacatcatcacccccaaccagtttgaggccgagctgctgagcggcaggaagatccacagccaggaggaggccctgcgggtgatggacatgctgcacagcatgggccctgacacagtggtgatcaccagcagtgacctgcccagcccccagggcagcaactacctgattgtgctgggcagccagaggagaagaaatcctgctggctctgtggtgatggagcgcatccgcatggacatcaggaaggtggatgctgtgtttgtgggcactggagacctgtttgctgccatgctgctggcctggacccacaagcaccccaacaacctgaaggtggcctgtgagaagacagtgtccaccctgcaccacgtgctgcagaggaccatccagtgtgccaaggcccaggccggggagggcgtgcggcccagccccatgcagctggagctgaggatggtgcagagcaagagggacattgaagatcctgagatcgtggtgcaggccaccgtgctgtag

SEQ ID NO: 166705 - DNA, 855 bp, Artificial Sequence
  Description of Artificial Sequence: Synthetic coding sequence
atggaggaggagtgccgggtgctgagcatccagagccacgtgatccggggctacgtgggcaacagagctgccaccttccccctgcaggtgctgggctttgaaattgatgctgtgaacagcgtgcagttcagcaaccacacaggctacgcccactggaagggccaggtgctgaacagtgatgagctgcaggagctgtatgagggcctgcggctgaacaacatgaacaagtatgactatgtgctgactgtgtgtgaccctgtgctgggggacaagtgggatggagagggctccatgtatgtgcctgaggacctgctgcctgtgtacaaggagaaggtggtgcccctggccgacatcatcacccccaaccagtttgaggccgagctgctgagcggcaggaagatccacagccaggaggaggccctgcgggtgatggacatgctgcacagcatgggccctgacacagtggtgatcaccagcagtgacctgcccagcccccagggcagcaactacctgattgtgctgggcagccagaggagaagaaatcctgctggctctgtggtgatggagcgcatccgcatggacatcaggaaggtggatgctgtgtttgtgggcactggagacctgtttgctgccatgctgctggcctggacccacaagcaccccaacaacctgaaggtggcctgtgagaagacagtgtccaccctgcaccacgtgctgcagaggaccatccagtgtgccaaggcccaggccggggagggcgtgcggcccagccccatgcagctggagctgaggatggtgcagagcaagagggacattgaagatcctgagatcgtggtgcaggccaccgtgctgtag

SEQ ID NO: 166706 - DNA, 2322 bp, Artificial Sequence
  Description of Artificial Sequence: Synthetic coding sequence
atgggcaagaacctgaaggaggccgtgaagatgctggaggacagccagaggagaacagaggaggagaatggcaagaagctgatcagcggggacatccctggccccctgcagggcagcggccaggacatggtgtccatcctgcagctggtgcagaacctgatgcatggagatgaagatgaggagccccagagcccccgcatccagaacatcggggagcagggccacatggccctgctgggccacagcctgggcgcctacatcagcaccctggacaaggagaagctgaggaagctgaccacccgcatcctgagtgacaccaccctgtggctgtgccgcatcttccgctatgaaaatggctgtgcctacttccacgaggaggagcgggagggcctggccaagatctgccgcctggccatccacagccgctatgaggactttgtggtggatggcttcaacgtgctgtacaacaagaagcctgtgatctacctgtctgctgctgcccggcccggcctgggccagtacctgtgcaaccagctgggcctgcccttcccctgcctgtgccgggtgccctgcaacacagtgtttggcagccagcaccagatggatgtggccttcctggagaagctgatcaaggatgacatcgagcggggccgcctgcccctgctgctggtggccaatgccggcacagctgctgtgggccacacagacaagattggccgcctgaaggagctgtgtgagcagtatggcatctggctgcacgtggagggcgtgaacctggccaccctggccctgggctacgtgagcagctctgtgctggccgccgccaagtgtgacagcatgaccatgaccccaggcccctggctgggcctgcctgctgtgcctgctgtgaccctgtacaagcatgatgatcctgccctgaccctggtggccggcctgaccagcaacaagcccacagacaagctgcgggccctgcccctgtggctgagcctgcagtacctgggcctggatggctttgtggagcgcatcaagcacgcctgccagctgagccagaggctgcaggagagcctgaagaaggtgaactacatcaagatcctggtggaggatgagctgagcagccctgtggtggtgttccgcttcttccaggagctgcccggcagtgaccccgtcttcaaggctgtgcctgtgcccaacatgaccccatctggagtgggccgggagcggcacagctgtgatgccctgaaccgctggctgggggagcagctgaagcagctggtgcctgccagcggcctgactgtgatggacctggaggccgagggcacctgcctgcgcttcagccccctgatgacagctgctgtgctgggcaccagaggagaagatgtggaccagctggtggcctgcatcgagagcaagctgcctgtgctgtgctgcaccctgcagctgcgggaggagttcaagcaggaggtggaggccacagctggcctgctgtatgtggatgaccccaactggagcggcattggagtggtgcgctatgagcacgccaatgatgacaagagcagcctgaagagtgaccctgaaggagagaacatccatgctggcctgctgaagaagctgaatgagctggagagtgacctgaccttcaagattggccctgagtacaagtccatgaagagctgcctgtatgtgggcatggccagtgacaacgtggatgctgctgagctggtggagaccatcgccgccacagcccgggagattgaggagaacagccggctgctggagaacatgacagaggtggtgaggaagggcatccaggaggcccaggtggagctgcagaaggccagcgaggagcggctgctggaggagggcgtgctgcggcagatccctgtggtgggctctgtgctgaactggttcagccctgtgcaggccctgcagaagggccgcaccttcaacctgacagctggcagcctggagagcacagagcccatctacgtgtacaaggcccagggcgctggggtgaccctgccccccacccccagcggcagcaggaccaagcagaggctgcccggccagaagcccttcaagaggagcctgcggggcagtgatgccctgtctgagaccagctctgtgagccacatcgaggacctggagaaggtggagcggctgagcagcggccctgagcagatcaccctggaggccagcagcacagagggccaccctggggcccccagcccccagcacacagaccagacagaggccttccagaagggcgtgccccacccagaagatgaccacagccaggtggagggccctgagagcctgaggtag

SEQ ID NO: 166707 - DNA, 2367 bp, Artificial Sequence
  Description of Artificial Sequence: Synthetic coding sequence
atggatgccagcctggagaagattgctgaccccaccctggccgagatgggcaagaacctgaaggaggccgtgaagatgctggaggacagccagaggagaacagaggaggagaatggcaagaagctgatcagcggggacatccctggccccctgcagggcagcggccaggacatggtgtccatcctgcagctggtgcagaacctgatgcatggagatgaagatgaggagccccagagcccccgcatccagaacattggagagcagggccacatggccctgctgggccacagcctgggcgcctacatcagcaccctggacaaggagaagctgaggaagctgaccacccgcatcctgagtgacaccaccctgtggctgtgccgcatcttccgctatgaaaatggctgtgcctacttccacgaggaggagcgggagggcctggccaagatctgccgcctggccatccacagccgctatgaagattttgtggtggatggcttcaacgtgctgtacaacaagaagcctgtgatctacctgtctgctgctgcccggcccggcctgggccagtacctgtgcaaccagctgggcctgcccttcccctgcctgtgccgggtgccctgcaacacagtgtttggcagccagcaccagatggatgtggccttcctggagaagctgatcaaggatgacatcgagcggggccgcctgcccctgctgctggtggccaatgccggcacagctgctgtgggccacacagacaagattggccgcctgaaggagctgtgtgagcagtatggcatctggctgcacgtggagggcgtgaacctggccaccctggccctgggctacgtgagcagctctgtgctggccgccgccaagtgtgacagcatgaccatgaccccaggcccctggctgggcctgcctgctgtgcctgctgtgaccctgtacaagcatgatgatcctgccctgaccctggtggccggcctgaccagcaacaagcccacagacaagctgcgggccctgcccctgtggctgagcctgcagtacctgggcctggatggctttgtggagcgcatcaagcacgcctgccagctgagccagaggctgcaggagagcctgaagaaggtgaactacatcaagatcctggtggaggatgagctgagcagccctgtggtggtgttccgcttcttccaggagctgcccggcagtgaccctgtgttcaaggctgtgcctgtgcccaacatgacccccagcggcgtgggccgggagcggcacagctgtgatgccctgaaccgctggctgggggagcagctgaagcagctggtgcctgccagcggcctgactgtgatggacctggaggccgagggcacctgcctgcgcttcagccccctgatgacagctgctgtgctgggcaccagaggagaagatgtggaccagctggtggcctgcatcgagagcaagctgcctgtgctgtgctgcaccctgcagctgcgggaggagttcaagcaggaggtggaggccacagctggcctgctgtatgtggatgaccccaactggagcggcatcggcgtggtgcgctatgaacatgccaatgatgacaagagcagcctgaagagtgaccctgagggggagaacatccacgccggcctgctgaagaagctgaatgagctggagagtgacctgaccttcaagattggccctgagtacaagtccatgaagagctgcctgtatgtgggcatggccagtgacaacgtggatgctgctgagctggtggagaccatcgccgccacagcccgggagattgaggagaacagccggctgctggagaacatgacagaggtggtgaggaagggcatccaggaggcccaggtggagctgcagaaggccagcgaggagcggctgctggaggagggcgtgctgcggcagatccctgtggtgggctctgtgctgaactggttcagccctgtgcaggccctgcagaagggccgcaccttcaacctgacagctggcagcctggagagcacagagcccatctacgtgtacaaggcccagggcgctggggtgaccctgccccccaccccatctggcagcaggaccaagcagaggctgcccggccagaagcccttcaagaggagcctgcggggcagtgatgccctgtctgagaccagctctgtgagccacatcgaggacctggagaaggtggagcggctgagcagcggccctgagcagatcaccctggaggccagcagcacagagggccaccctggggcccccagcccccagcacacagaccagacagaggccttccagaagggcgtgccccacccagaagatgaccacagccaggtggagggccctgagagcctgaggtag

SEQ ID NO: 166708 - DNA, 2094 bp, Artificial Sequence
  Description of Artificial Sequence: Synthetic coding sequence
atgggcaagaacctgaaggaggccgtgaagatgctggaggacagccagaggagaacagaggaggagaatggcaagaagctgatcagcggggacatccctggccccctgcagggccgctatgaaaatggctgtgcctacttccacgaggaggagcgggagggcctggccaagatctgccgcctggccatccacagccgctatgaggactttgtggtggatggcttcaacgtgctgtacaacaagaagcctgtgatctacctgtctgctgctgcccggcccggcctgggccagtacctgtgcaaccagctgggcctgcccttcccctgcctgtgccgggtgccctgcaacacagtgtttggcagccagcaccagatggatgtggccttcctggagaagctgatcaaggatgacatcgagcggggccgcctgcccctgctgctggtggccaatgccggcacagctgctgtgggccacacagacaagattggccgcctgaaggagctgtgtgagcagtatggcatctggctgcacgtggagggcgtgaacctggccaccctggccctgggctacgtgagcagctctgtgctggccgccgccaagtgtgacagcatgaccatgaccccaggcccctggctgggcctgcctgctgtgcctgctgtgaccctgtacaagcatgatgatcctgccctgaccctggtggccggcctgaccagcaacaagcccacagacaagctgcgggccctgcccctgtggctgagcctgcagtacctgggcctggatggctttgtggagcgcatcaagcacgcctgccagctgagccagaggctgcaggagagcctgaagaaggtgaactacatcaagatcctggtggaggatgagctgagcagccctgtggtggtgttccgcttcttccaggagctgcccggcagtgaccccgtcttcaaggctgtgcctgtgcccaacatgaccccatctggagtgggccgggagcggcacagctgtgatgccctgaaccgctggctgggggagcagctgaagcagctggtgcctgccagcggcctgactgtgatggacctggaggccgagggcacctgcctgcgcttcagccccctgatgacagctgctgtgctgggcaccagaggagaagatgtggaccagctggtggcctgcatcgagagcaagctgcctgtgctgtgctgcaccctgcagctgcgggaggagttcaagcaggaggtggaggccacagctggcctgctgtatgtggatgaccccaactggagcggcattggagtggtgcgctatgagcacgccaatgatgacaagagcagcctgaagagtgaccctgaaggagagaacatccatgctggcctgctgaagaagctgaatgagctggagagtgacctgaccttcaagattggccctgagtacaagtccatgaagagctgcctgtatgtgggcatggccagtgacaacgtggatgctgctgagctggtggagaccatcgccgccacagcccgggagattgaggagaacagccggctgctggagaacatgacagaggtggtgaggaagggcatccaggaggcccaggtggagctgcagaaggccagcgaggagcggctgctggaggagggcgtgctgcggcagatccctgtggtgggctctgtgctgaactggttcagccctgtgcaggccctgcagaagggccgcaccttcaacctgacagctggcagcctggagagcacagagcccatctacgtgtacaaggcccagggcgctggggtgaccctgccccccacccccagcggcagcaggaccaagcagaggctgcccggccagaagcccttcaagaggagcctgcggggcagtgatgccctgtctgagaccagctctgtgagccacatcgaggacctggagaaggtggagcggctgagcagcggccctgagcagatcaccctggaggccagcagcacagagggccaccctggggcccccagcccccagcacacagaccagacagaggccttccagaagggcgtgccccacccagaagatgaccacagccaggtggagggccctgagagcctgaggtag

SEQ ID NO: 166709 - DNA, 2283 bp, Artificial Sequence
  Description of Artificial Sequence: Synthetic coding sequence
atggatgccagcctggagaagattgctgaccccaccctggccgagatgggcaagaacctgaaggaggccgtgaagatgctggaggacagccagaggacagaggaggagaatggcaagaagctgatcagcggggacatccctggccccctgcagggccgcatccagaacattggagagcagggccacatggccctgctgggccacagcctgggcgcctacatcagcaccctggacaaggagaagctgaggaagctgaccacccgcatcctgagtgacaccaccctgtggctgtgccgcatcttccgctatgaaaatggctgtgcctacttccacgaggaggagcgggagggcctggccaagatctgccgcctggccatccacagccgctatgaagattttgtggtggatggcttcaacgtgctgtacaacaagaagcctgtgatctacctgtctgctgctgcccggcccggcctgggccagtacctgtgcaaccagctgggcctgcccttcccctgcctgtgccgggtgccctgcaacacagtgtttggcagccagcaccagatggatgtggccttcctggagaagctgatcaaggatgacatcgagcggggccgcctgcccctgctgctggtggccaatgccggcacagctgctgtgggccacacagacaagattggccgcctgaaggagctgtgtgagcagtatggcatctggctgcacgtggagggcgtgaacctggccaccctggccctgggctacgtgagcagctctgtgctggccgccgccaagtgtgacagcatgaccatgaccccaggcccctggctgggcctgcctgctgtgcctgctgtgaccctgtacaagcatgatgatcctgccctgaccctggtggccggcctgaccagcaacaagcccacagacaagctgcgggccctgcccctgtggctgagcctgcagtacctgggcctggatggctttgtggagcgcatcaagcacgcctgccagctgagccagaggctgcaggagagcctgaagaaggtgaactacatcaagatcctggtggaggatgagctgagcagccctgtggtggtgttccgcttcttccaggagctgcccggcagtgaccctgtgttcaaggctgtgcctgtgcccaacatgacccccagcggcgtgggccgggagcggcacagctgtgatgccctgaaccgctggctgggggagcagctgaagcagctggtgcctgccagcggcctgactgtgatggacctggaggccgagggcacctgcctgcgcttcagccccctgatgacagctgctgtgctgggcaccagaggagaagatgtggaccagctggtggcctgcatcgagagcaagctgcctgtgctgtgctgcaccctgcagctgcgggaggagttcaagcaggaggtggaggccacagctggcctgctgtatgtggatgaccccaactggagcggcatcggcgtggtgcgctatgaacatgccaatgatgacaagagcagcctgaagagtgaccctgagggggagaacatccacgccggcctgctgaagaagctgaatgagctggagagtgacctgaccttcaagattggccctgagtacaagtccatgaagagctgcctgtatgtgggcatggccagtgacaacgtggatgctgctgagctggtggagaccatcgccgccacagcccgggagattgaggagaacagccggctgctggagaacatgacagaggtggtgaggaagggcatccaggaggcccaggtggagctgcagaaggccagcgaggagcggctgctggaggagggcgtgctgcggcagatccctgtggtgggctctgtgctgaactggttcagccctgtgcaggccctgcagaagggccgcaccttcaacctgacagctggcagcctggagagcacagagcccatctacgtgtacaaggcccagggcgctggggtgaccctgccccccaccccatctggcagcaggaccaagcagaggctgcccggccagaagcccttcaagaggagcctgcggggcagtgatgccctgtctgagaccagctctgtgagccacatcgaggacctggagaaggtggagcggctgagcagcggccctgagcagatcaccctggaggccagcagcacagagggccaccctggggcccccagcccccagcacacagaccagacagaggccttccagaagggcgtgccccacccagaagatgaccacagccaggtggagggccctgagagcctgaggtag

SEQ ID NO: 166710 - DNA, 1290 bp, Artificial Sequence
  Description of Artificial Sequence: Synthetic coding sequence
ctgagcagcaccctgcggagaattgctgaccccaccctggccgagatgggcaagaacctgaaggaggccgtgaagatgctggaggacagccagaggagaacagaggaggagaatggcaagaagctgatcagcggggacatccctggccccctgcagggcagcggccaggacatggtgtccatcctgcagctggtgcagaacctgatgcatggagatgaagatgaggagccccagagcccccgcatccagaacattggagagcagggccacatggccctgctgggccacagcctgggcgcctacatcagcaccctggacaaggagaagctgaggaagctgaccacccgcatcctgagtgacaccaccctgtggctgtgccgcatcttccgctatgaaaatggctgtgcctacttccacgaggaggagcgggagggcctggccaagatctgccgcctggccatccacagccgctatgaagattttgtggtggatggcttcaacgtgctgtacaacaagaagcctgtgatctacctgtctgctgctgcccggcccggcctgggccagtacctgtgcaaccaggatgtggccttcctggagaagctgatcaaggatgacatcgagcggggccgcctgcccctgctgctggtggccaatgccggcacagctgctgtgggccacacagacaagattggccgcctgaaggagctgtgtgagcagtatggcatctggctgcacgtggagggcgtgaacctggccaccctggccctgggctacgtgagcagctctgtgctggccgccgccaagtgtgacagcatgaccatgaccccaggcccctggctgggcctgcctgctgtgcctgctgtgaccctgtacaagcatgatgatcctgccctgaccctggtggccggcctgaccagcaacaagcccacagacaagctgcgggccctgcccctgtggctgagcctgcagtacctgggcctggatggctttgtggagcgcatcaagcacgcctgccagctgagccagaggctgcaggagagcctgaagaaggtgaactacatcaagatcctggtggaggatgagctgagcagccctgtggtggtgttccgcttcttccaggagctgcccggcagtgaccccgtcttcaaggctgtgcctgtgcccaacatgaccccatctggagtgggccgggagcggcacagctgtgatgccctgaaccgctgggtgaggatggctgtgacccccctgtccttccaggtgcctgtgcaccaccaccccacctgctggtag

SEQ ID NO: 166711 - DNA, 1497 bp, Artificial Sequence
  Description of Artificial Sequence: Synthetic coding sequence
atggatgccagcctggagaagattgctgaccccaccctggccgagatgggcaagaacctgaaggaggccgtgaagatgctggaggacagccagaggagaacagaggaggagaatggcaagaagctgatcagcggggacatccctggccccctgcagggcagcggccaggacatggtgtccatcctgcagctggtgcagaacctgatgcatggagatgaagatgaggagccccagagcccccgcatccagaacattggagagcagggccacatggccctgctgggccacagcctgggcgcctacatcagcaccctggacaaggagaagctgaggaagctgaccacccgcatcctgagtgacaccaccctgtggctgtgccgcatcttccgctatgaaaatggctgtgcctacttccacgaggaggagcgggagggcctggccaagatctgccgcctggccatccacagccgctatgaagattttgtggtggatggcttcaacgtgctgtacaacaagaagcctgtgatctacctgtctgctgctgcccggcccggcctgggccagtacctgtgcaaccagctgggcctgcccttcccctgcctgtgccgggtgccctgcaacacagtgtttggcagccagcaccagatggatgtggccttcctggagaagctgatcaaggatgacatcgagcggggccgcctgcccctgctgctggtggccaatgccggcacagctgctgtgggccacacagacaagattggccgcctgaaggagctgtgtgagcagtatggcatctggctgcacgtggagggcgtgaacctggccaccctggccctgggctacgtgagcagctctgtgctggccgccgccaagtgtgacagcatgaccatgaccccaggcccctggctgggcctgcctgctgtgcctgctgtgaccctgtacaagcatgatgatcctgccctgaccctggtggccggcctgaccagcaacaagcccacagacaagctgcgggccctgcccctgtggctgagcctgcagtacctgggcctggatggctttgtggagcgcatcaagcacgcctgccagctgagccagaggctgcaggagagcctgaagaaggtgaactacatcaagatcctggtggaggatgagctgagcagccctgtggtggtgttccgcttcttccaggagctgcccggcagtgaccctgtgttcaaggctgtgcctgtgcccaacatgacccccagcggcgtgggccgggagcggcacagctgtgatgccctgaaccgctggctgggggagcagctgaagcagctggtgcctgccagcggcctgactgtgatggacctggaggccgagggcacctgcctgcgcttcagccccctgatgacagctgctggctggagccactgcggcaccaccaccaggtatgactgtgtgcgcagccggctgaccacccggctgcccggcagcactggagagcaggcccctccttag

SEQ ID NO: 166712 - DNA, 615 bp, Artificial Sequence
  Description of Artificial Sequence: Synthetic coding sequence
atgaccatgaccccaggcccctggctgggcctgcctgctgtgcctgctgtgaccctgtacaagcatgatgatcctgccctgaccctggtggccggcctgaccagcaacaagcccacagacaagctgcgggccctgcccctgtggctgagcctgcagtacctgggcctggatggctttgtggagcgcatcaagcacgcctgccagctgagccagaggctgcaggagagcctgaagaaggtgaactacatcaagatcctggtggaggatgagctgagcagccctgtggtggtgttccgcttcttccaggagctgcccggcagtgaccctgtgttcaaggctgtgcctgtgcccaacatgacccccagcggcgtgggccgggagcggcacagctgtgatgccctgaaccgctggctgggggagcagctgaagcagctggtgcctgccagcggcctgactgtgatggacctggaggccgagggcacctgcctgcgcttcagccccctgatgacagctgctggctggagccactgcggcaccaccaccaggtatgactgtgtgcgcagccggctgaccacccggctgcccggcagcactggagagcaggcccctccttag

SEQ ID NO: 166713 - DNA, 642 bp, Artificial Sequence
  Description of Artificial Sequence: Synthetic coding sequence
atggaccccctcttccagcagacccacaagcaggtgcatgagatccagagctgcatgggccgcctggagacagctgacaagcagagcgtgcacatcgtggagaatgagatccaggccagcattgaccagatcttcagccggctggagcggctggagatcctgagcagcaaggagccccccaacaagaggcagaatgcccggctgcgggtggaccagctgaagtatgatgtgcagcacctgcagacagccctgaggaacttccagcacagaagacatgcccgggagcagcaggagcggcagcgggaggagctgctgagcaggaccttcaccaccaatgacagcgacaccaccatccccatggatgagagcctgcagttcaacagcagcctgcagaaggtgcacaacggcatggatgacctgatcctggatggccacaacatcctggatggcctgcggacccagaggctgaccctgaagggcacccagaagaagatcctggacatcgccaacatgctgggcctgagcaacacagtgatgaggctcatcgagaagagggccttccaggacaagtacttcatgattggcacccagggcagctgccagacagcccactttggaggccgctctgctggcagcagctag

SEQ ID NO: 166714 - DNA, 657 bp, Artificial Sequence
  Description of Artificial Sequence: Synthetic coding sequence
atgacctgctggctgcggggcgtgacagccaccttcggccggcctgctgagtggccaggctacctgagccacctgtgtggccgctctgctgccatggacctgggccccatgaggaagagctacagaggagaccgggaggcctttgaggagacccacctgaccagcctggaccctgtgaagcagtttgctgcctggtttgaggaggccgtgcagtgcccagacattggagaggccaatgccatgtgcctggccacctgcaccagagatggcaagcccagcgccaggatgctgctgctgaagggctttgggaaggatggcttccgcttcttcaccaactttgagagcaggaagggcaaggagctggacagcaacccctttgccagcctggtgttctactgggagcccctgaaccggcagtacctgaggaagaagaatgaggagctggagcagctgtaccaggaccaggaggtgcccaagcccaagtcctggggcggctacgtgctgtacccccaggtgatggagttctggcagggccagaccaaccggctgcatgacagaattgtgttccggcggggcctgcccactggagacagccccctgggccccatgacccacagaggagaggaggactggctgtatgagcggctggccccctag

SEQ ID NO: 166715 - DNA, 501 bp, Artificial Sequence
  Description of Artificial Sequence: Synthetic coding sequence
atgctgctgctgaagggctttgggaaggatggcttccgcttcttcaccaactttgagagcaggaagggcaaggagctggacagcaacccctttgccagcctggtgttctactgggagcccctgaaccggcaggtgcgggtggagggccctgtgaagaagctgcctgaggaggaggccgagtgctacttccacagccggcccaagagcagccagatcggggctgtggtgagccaccagagcagcgtcatcccagaccgggagtacctgaggaagaagaatgaggagctggagcagctgtaccaggaccaggaggtgcccaagcccaagtcctggggcggctacgtgctgtacccccaggtgatggagttctggcagggccagaccaaccggctgcatgacagaattgtgttccggcggggcctgcccactggagacagccccctgggccccatgacccacagaggagaggaggactggctgtatgagcggctggccccctag

SEQ ID NO: 166716 - DNA, 732 bp, Artificial Sequence
  Description of Artificial Sequence: Synthetic coding sequence
atgacctgctggctgcggggcgtgacagccaccttcggccggcctgctgagtggccaggctacctgagccacctgtgtggccgctctgctgccatggacctgggccccatgaggaagagctacagaggagaccgggaggcctttgaggagacccacctgaccagcctggaccctgtgaagcagtttgctgcctggtttgaggaggccgtgcagtgcccagacattggagaggccaatgccatgtgcctggccacctgcaccagagatggcaagcccagcgccaggatgctgctgctgaagggctttgggaaggatggcttccgcttcttcaccaactttgagagcaggaagggcaaggagctggtgcgggtggagggccctgtgaagaagctgcctgaggaggaggccgagtgctacttccacagccggcccaagagcagccagattggagctgtggtgagccaccagagcagcgtcatcccagaccgggagtacctgaggaagaagaatgaggagctggagcagctgtaccaggaccaggaggtgcccaagcccaagtcctggggcggctacgtgctgtacccccaggtgatggagttctggcagggccagaccaaccggctgcatgaccgcatcgtgttcagaagaggcctgcccaccggggacagccccctgggccccatgacccacagaggagaggaggactggctgtatgaaaggctggccccctag

SEQ ID NO: 166717 - DNA, 1098 bp, Artificial Sequence
  Description of Artificial Sequence: Synthetic coding sequence
atggccagcacagagagcagcctgctgcggagcctgggcctgagccctggccctggcagcagcgaggtggagctggactgctggtttgatgaggacttcaagttcatcctgctgcctgtgtcctatgctgtggtgtttgtgctgggcctgggcctgaatgcccccaccctgtggctgttcatcttccggctgcggccctgggatgccacagccacctacatgttccacctggccctgagtgacaccctgtatgtgctgagcctgcccaccctcatctactactatgctgcccacaaccactggccctttggaacagagatctgcaagtttgtgcgcttcctgttctactggaacctgtactgcagcgtgctcttcctgacctgcatctctgtgcaccgctacctgggcatctgccaccccctgcgggccctgcgctggggccggccccggctggccggcctgctgtgcctggccgtgtggctggtggtggccggctgcctggtgcccaacctcttctttgtgaccaccagcaacaagggcaccaccgtgctgtgccacgacaccaccaggcctgaggagtttgaccactacgtgcacttcagcagcgctgtgatgggcctgctgtttggagtgccctgcctggtgaccctggtgtgctacggcctgatggcccggcggctgtaccagcccctgcccggcagcgcccagagcagcagccggctgcggagcctgcggaccatcgctgtggtgctgactgtgtttgctgtgtgctttgtgcccttccacatcaccaggaccatctactacctggcccggctgctggaggccgactgccgggtgctgaacatcgtgaatgtggtgtacaaggtgacccggcccctggccagcgccaacagctgcctggaccctgtgctgtacctgctgactggagacaagtaccgccggcagctgcggcagctgtgtggcggcggcaagccccagcccaggacagctgccagcagcctggccctggtgtccctgcctgaggacagcagctgccgctgggccgccaccccccaggacagcagctgcagcacccccagggctgaccggctgtag

SEQ ID NO: 166718 - DNA, 987 bp, Artificial Sequence
  Description of Artificial Sequence: Synthetic coding sequence
atggagtgggacaatggaacaggccaggccctgggcctgccccccaccacctgtgtgtaccgggagaacttcaagcagctgctgctgccccctgtgtacagcgctgtgctggccgccggcctgcccctgaacatctgtgtgatcacccagatctgcaccagcagaagagccctgaccaggacagctgtgtacaccctgaacctggccctggccgacctgctgtatgcctgcagcctgcccctgctgatctacaactatgcccagggcgaccactggccctttggagactttgcctgccgcctggtgcgcttcctgttctacgccaacctgcacggcagcatcctcttcctgacctgcatctccttccagcgctacctgggcatctgccaccccctggccccctggcacaagagaggaggaagaagagctgcctggctggtgtgtgtggccgtgtggctggccgtgaccacccagtgcctgcccacagccatctttgctgccaccggcatccagaggaacagaacagtgtgctatgacctgagccccccagccctggccacccactacatgccctacggcatggccctgactgtgattggcttcctgctgccctttgctgccctgctggcctgctactgcctgctggcctgccgcctgtgccggcaggacggccctgctgagcctgtggcccaggagcggcggggcaaggccgccaggatggctgtggtggtggccgccgcctttgccatctccttcctgcccttccacatcaccaagacagcctacctggccgtgcgcagcaccccaggagtgccctgcaccgtgctggaggcctttgctgctgcctacaagggcacccggccctttgccagcgccaacagcgtgctggaccccatcctcttctacttcacccagaagaagttcagaagaagacctcatgagctgctgcagaagctgacagccaagtggcagaggcagggccgctag

SEQ ID NO: 166719 - DNA, 987 bp, Artificial Sequence; identical to SEQ ID NO: 166718
  Description of Artificial Sequence: Synthetic coding sequence

SEQ ID NO: 166720 - DNA, 987 bp, Artificial Sequence; identical to SEQ ID NO: 166718
  Description of Artificial Sequence: Synthetic coding sequence

SEQ ID NO: 166721 - DNA, 987 bp, Artificial Sequence; identical to SEQ ID NO: 166718
  Description of Artificial Sequence: Synthetic coding sequence

SEQ ID NO: 166722 - DNA, 738 bp, Artificial Sequence
  Description of Artificial Sequence: Synthetic coding sequence
atggagtgggacaatggaacaggccaggccctgggcctgccccccaccacctgtgtgtaccgggagaacttcaagcagctgctgctgccccctgtgtacagcgctgtgctggccgccggcctgcccctgaacatctgtgtgatcacccagatctgcaccagcagaagagccctgaccaggacagctgtgtacaccctgaacctggccctggccgacctgctgtatgcctgcagcctgcccctgctgatctacaactatgcccagggcgaccactggccctttggagactttgcctgccgcctggtgcgcttcctgttctacgccaacctgcacggcagcatcctcttcctgacctgcatctccttccagcgctacctgggcatctgccaccccctggccccctggcacaagagaggaggaagaagagctgcctggctggtgtgtgtggccgtgtggctggccgtgaccacccagtgcctgcccacagccatctttgctgccaccggcatccagaggaacagaacagtgtgctatgacctgagccccccagccctggccacccactacatgccctacggcatggccctgactgtgattggcttcctgctgccctttgctgccctgctggcctgctactgcctgctggcctgccgcctgtgccggcaggacggccctgctgagcctgtggcccaggagcggcggggcaaggccgccaggatggctgtggtggtggcctag

SEQ ID NO: 166723 - DNA, 987 bp, Artificial Sequence; identical to SEQ ID NO: 166718
  Description of Artificial Sequence: Synthetic coding sequence

SEQ ID NO: 166724 - DNA, 987 bp, Artificial Sequence; identical to SEQ ID NO: 166718
  Description of Artificial Sequence: Synthetic coding sequence

SEQ ID NO: 166725 - DNA, 987 bp, Artificial Sequence; identical to SEQ ID NO: 166718
  Description of Artificial Sequence: Synthetic coding sequence

SEQ ID NO: 166726 - DNA, 987 bp, Artificial Sequence; identical to SEQ ID NO: 166718
  Description of Artificial Sequence: Synthetic coding sequence

SEQ ID NO: 166727 - DNA, 387 bp, Artificial Sequence
  Description of Artificial Sequence: Synthetic coding sequence
atggagtgggacaatggaacaggccaggccctgggcctgccccccaccacctgtgtgtaccgggagaacttcaagcagctgctgctgccccctgtgtacagcgctgtgctggccgccggcctgcccctgaacatctgtgtgatcacccagatctgcaccagcagaagagccctgaccaggacagctgtgtacaccctgaacctggccctggccgacctgctgtatgcctgcagcctgcccctgctgatctacaactatgcccagggcgaccactggccctttggagactttgcctgccgcctggtgcgcttcctgttctacgccaacctgcacggcagcatcctcttcctgacctgcatctccttccagcgctacctgggcatctag

SEQ ID NO: 166728 - DNA, 738 bp, Artificial Sequence
  Description of Artificial Sequence: Synthetic coding sequence
atggccaacaactacaagaagatcgtgctgctgaagggcctggaggtgatcaatgactaccacttccgcatcgtgaagagcctgctgagcaatgacctgaagctgaaccccaagatgaaggaggagtatgacaagatccagattgctgacctgatggaggagaagtttcctggagatgctggcctgggcaagctgattgagttcttcaaggagatccccaccctgggggacctggccgagaccctgaagcgggagaagctgaaggtggccaacaagattgagagcatccctgtgaagggcatcatccccagcaagaagaccaagcagaaggaggtgtacccagccaccccagcctgcacccccagcaaccggctgacagccaagggagctgaggagaccctgggcccccagaagaggaagaagcccagcgaggaggagaccggcaccaagaggagcaagatgagcaaggagcagacccggcccagctgcagcgctggggccagcaccagcacagccatgggccgcagccccccaccccagaccagcagcagcgccccacccaacaccagcagcacagaggcctacctgatgaacctgaccctgagcctgacagctggcagcttcctgagctgtgctgtgtggggccgggaccgggagctgaggaacctggagctgagcgccacagacagcctgagcacagcccccatctactacacccccatcccctttgcccactag

SEQ ID NO: 166729 - DNA, 1452 bp, Artificial Sequence
  Description of Artificial Sequence: Synthetic coding sequence
atggccaacaactacaagaagatcgtgctgctgaagggcctggaggtgatcaatgactaccacttccgcatcgtgaagagcctgctgagcaatgacctgaagctgaaccccaagatgaaggaggagtatgacaagatccagattgctgacctgatggaggagaagtttcctggagatgctggcctgggcaagctgattgagttcttcaaggagatccccaccctgggggacctggccgagaccctgaagcgggagaagctgaaggtgaagggcatcatccccagcaagaagaccaagcagaaggaggtgtacccagccaccccagcctgcacccccagcaaccggctgacagccaagggagctgaggagaccctgggcccccagaagaggaagaagcccagcgaggaggagaccggcaccaagaggagcaagatgagcaaggagcagacccggcccagctgcagcgctggggccagcaccagcacagccatgggccgcagccccccaccccagaccagcagcagcgccccacccaacaccagcagcacagagagcctgaagcccctggccaacagacatgccacagccagcaagaacatcttccgggaggaccccatcatcgccatggtgctgaatgccaccaaggtgttcaagtatgagagcagtgaaaatgagcagaggaggatgtttcatgccaccgtggccacccagacccagttcttccacgtgaaggtgctgaacatcaacctgaagaggaagttcatcaagaagaggatcatcatcatcagcaactacagcaagaggaacagcctgctggaggtgaatgaggccagctctgtgtctgaggccggccctgaccagacctttgaggtgcccaaggacatcatcagaagagccaagaagatccccaagatcaacatcctgcacaagcagaccagcggctacatcgtgtatggcctcttcatgctgcacaccaagatcgtgaacaggaagaccaccatctatgagatccaggacaagacaggctccatggctgtggtgggcaaaggagagtgccacaacatcccctgtgagaagggggacaagctgcggctcttctgcttccggctgaggaagcgggagaacatgagcaagctgatgtctgagatgcacagcttcatccagatccagaagaacaccaaccagaggagccatgacagccgctccatggccctgccccaggagcagagccagcaccccaagcccagcgaggccagcaccaccctgcctgagagccacctgaagaccccccagatgccacccaccacccccagcagcagcagcttcaccaagaaggatgagacccaccctggggcccagagcagccctgccaacttccgcatcaccagccccaccgtggccccacccctgagcagtgacaccagcaccaacagacaccctgctgtgccctag

SEQ ID NO: 166730 - DNA, 1479 bp, Artificial Sequence
  Description of Artificial Sequence: Synthetic coding sequence
atggccaacaactacaagaagatcgtgctgctgaagggcctggaggtgatcaatgactaccacttccgcatcgtgaagagcctgctgagcaatgacctgaagctgaaccccaagatgaaggaggagtatgacaagatccagattgctgacctgatggaggagaagtttcctggagatgctggcctgggcaagctgattgagttcttcaaggagatccccaccctgggggacctggccgagaccctgaagcgggagaagctgaaggtggccaacaagattgagagcatccctgtgaagggcatcatccccagcaagaagaccaagcagaaggaggtgtacccagccaccccagcctgcacccccagcaaccggctgacagccaagggagctgaggagaccctgggcccccagaagaggaagaagcccagcgaggaggagaccggcaccaagaggagcaagatgagcaaggagcagacccggcccagctgcagcgctggggccagcaccagcacagccatgggccgcagccccccaccccagaccagcagcagcgccccacccaacaccagcagcacagagagcctgaagcccctggccaacagacatgccacagccagcaagaacatcttccgggaggaccccatcatcgccatggtgctgaatgccaccaaggtgttcaagtatgagagcagtgaaaatgagcagaggaggatgttccacgccaccgtggccacccagacccagttcttccacgtgaaggtgctgaacatcaacctgaagaggaagttcatcaagaagaggatcatcatcatcagcaactacagcaagaggaacagcctgctggaggtgaatgaggccagctctgtgtctgaggccggccctgaccagacctttgaggtgcccaaggacatcatccggcgggccaagaagatccccaagatcaacatcctgcacaagcagaccagcggctacatcgtgtatggcctcttcatgctgcacaccaagatcgtgaacaggaagaccaccatctatgagatccaggacaagacaggctccatggctgtggtgggcaagggggagtgccacaacatcccctgtgagaagggggacaagctgcggctcttctgcttccggctgaggaagcgggagaacatgagcaagctgatgtctgagatgcacagcttcatccagatccagaagaacaccaaccagaggagccatgacagccgctccatggccctgccccaggagcagagccagcaccccaagcccagcgaggccagcaccaccctgcctgagagccacctgaagaccccccagatgccacccaccacccccagcagcagcagcttcaccaagaaggatgagacccaccctggggcccagagcagccctgccaacttccgcatcaccagccccaccgtggccccacccctgagcagtgacaccagcaccaacagacaccctgctgtgccctag

SEQ ID NO: 166731 - DNA, 1359 bp, Artificial Sequence
  Description of Artificial Sequence: Synthetic coding sequence
atggccaacaactacaagaagatcgtgctgctgaagggcctggaggtgatcaatgactaccacttccgcatcgtgaagagcctgctgagcaatgacctgaagctgaaccccaagatgaaggaggagtatgacaagatccagattgctgacctgatggaggagaagtttcctggagatgctggcctgggcaagctgattgagttcttcaaggagatccccaccctgggggacctggccgagaccctgaagcgggagaagctgaaggtgaagggcatcatccccagcaagaagaccaagcagaaggaggtgtacccagccaccccagcctgcacccccagcaaccggctgacagccaagggagctgaggagaccctgggcccccagaagaggaagaagcccagcgaggaggagaccggcaccaagaggagcaagatgagcaaggagcagacccggcccagctgcagcgctggggccagcaccagcacagccatgggccgcagccccccaccccagaccagcagcagcgccccacccaacaccagcagcacagagagcctgaagcccctggccaacagacatgccacagccagcaagaacatcttccgggaggaccccatcatcgccatggtgctgaatgccaccaaggtgttcaagtatgagagcagtgaaaatgagcagaggaggatgtttcatgccaccgtggccacccagacccagttcttccacgtgaaggtgctgaacatcaacctgaagaggaagttcatcaagaagaggatcatcatcatcagcaactacagcaagaggaacagcctgctggaggtgaatgaggccagctctgtgtctgaggccggccctgaccagacctttgaggtgcccaaggacatcatcagaagagccaagaagatccccaagatcaacatcctgcacaagcagaccagcggctacatcgtgtatggcctcttcatgctgcacaccaagatcgtgaacaggaagaccaccatctatgagatccaggacaagacaggctccatggctgtggtgggcaaaggagagtgccacaacatcccctgtgagaagggggacaagctgcggctcttctgcttccggctgaggaagcgggagaacatgagcaagctgatgtctgagatgcacagcttcatccagatccagaagaacaccaaccagaggagccatgacagccgctccatggccctgccccaggagcagagccagcaccccaagcccagcgaggccagcaccaccctgcctgagagccacctgaagaccccccagatgccacccaccacccccagcagcagcagcttcaccaaggtgaccaaggacaaggacatcaagtag

SEQ ID NO: 166732 - DNA, 1386 bp, Artificial Sequence
  Description of Artificial Sequence: Synthetic coding sequence
atggccaacaactacaagaagatcgtgctgctgaagggcctggaggtgatcaatgactaccacttccgcatcgtgaagagcctgctgagcaatgacctgaagctgaaccccaagatgaaggaggagtatgacaagatccagattgctgacctgatggaggagaagtttcctggagatgctggcctgggcaagctgattgagttcttcaaggagatccccaccctgggggacctggccgagaccctgaagcgggagaagctgaaggtggccaacaagattgagagcatccctgtgaagggcatcatccccagcaagaagaccaagcagaaggaggtgtacccagccaccccagcctgcacccccagcaaccggctgacagccaagggagctgaggagaccctgggcccccagaagaggaagaagcccagcgaggaggagaccggcaccaagaggagcaagatgagcaaggagcagacccggcccagctgcagcgctggggccagcaccagcacagccatgggccgcagccccccaccccagaccagcagcagcgccccacccaacaccagcagcacagagagcctgaagcccctggccaacagacatgccacagccagcaagaacatcttccgggaggaccccatcatcgccatggtgctgaatgccaccaaggtgttcaagtatgagagcagtgaaaatgagcagaggaggatgttccacgccaccgtggccacccagacccagttcttccacgtgaaggtgctgaacatcaacctgaagaggaagttcatcaagaagaggatcatcatcatcagcaactacagcaagaggaacagcctgctggaggtgaatgaggccagctctgtgtctgaggccggccctgaccagacctttgaggtgcccaaggacatcatccggcgggccaagaagatccccaagatcaacatcctgcacaagcagaccagcggctacatcgtgtatggcctcttcatgctgcacaccaagatcgtgaacaggaagaccaccatctatgagatccaggacaagacaggctccatggctgtggtgggcaagggggagtgccacaacatcccctgtgagaagggggacaagctgcggctcttctgcttccggctgaggaagcgggagaacatgagcaagctgatgtctgagatgcacagcttcatccagatccagaagaacaccaaccagaggagccatgacagccgctccatggccctgccccaggagcagagccagcaccccaagcccagcgaggccagcaccaccctgcctgagagccacctgaagaccccccagatgccacccaccacccccagcagcagcagcttcaccaaggtgaccaaggacaaggacatcaagtag

SEQ ID NO: 166733 - DNA, 453 bp, Artificial Sequence
  Description of Artificial Sequence: Synthetic coding sequence
atggccaacaactacaagaagatcgtgctgctgaagggcctggaggtgatcaatgactaccacttccgcatcgtgaagagcctgctgagcaatgacctgaagctgaaccccaagatgaaggaggagtatgacaagatccagattgctgacctgatggaggagaagtttcctggagatgctggcctgggcaagctgattgagttcttcaaggagatccccaccctgggggacctggccgagaccctgaagcgggagaagctgaaggtggccaacaagattgagagcatccctgtgaagggcatcatccccagcaagaagaccaagcagaaggaggtgtacccagccaccccagcctgcacccccagcaaccggctgacagccaagggagctgaggagaccctgggcccccagaagaggaagaagcccagcgaggaggagaccggcaccaagtag

SEQ ID NO: 166734 - DNA, 399 bp, Artificial Sequence
  Description of Artificial Sequence: Synthetic coding sequence
atggccaccaccgtgaccctggagaagtgtggccacaacaagggctacaagggcctggacaactgccgcttctgccccggcagccagtgctgcgtggaggatggccctgagagcattgacagcatcatcgacatggatgctgtgtgcaagagggtgaccaccctgggcctggatgtgtctgtgaccatcagccaggatgctggccgctacctgtgtgacttcacctactacaccagcctgtaccagagccacggccgcagcgcctttgtgcacgtgccccccctgggcaagccctacaatgctgaccagctgggccgggccctgcgggccatcatcgaggagatgctggacctgctggagcagagcgagggcaagatcaactactgccacaagcactag

SEQ ID NO: 166735 - DNA, 630 bp, Artificial Sequence
  Description of Artificial Sequence: Synthetic coding sequence
atggagcagcccaggaaggctgtggtggtgactggatttggcccctttggagagcacacagtgaatgcctcctggattgctgtgcaggagctggagaagctgggcctgggggacagcgtggacctgcacgtgtatgagatccctgtggagtaccagacagtgcagaggctcatcccagccctgtgggagaagcacagcccccagctggtggtgcacgtgggcgtgtctggcatggccaccaccgtgaccctggagaagtgtggccacaacaagggctacaagggcctggacaactgccgcttctgccccggcagccagtgctgcgtggaggatggccctgagagcattgacagcatcatcgacatggatgctgtgtgcaagagggtgaccaccctgggcctggatgtgtctgtgaccatcagccaggatgctggccgctacctgtgtgacttcacctactacaccagcctgtaccagagccacggccgcagcgcctttgtgcacgtgccccccctgggcaagccctacaatgctgaccagctgggccgggccctgcgggccatcatcgaggagatgctggacctgctggagcagagcgagggcaagatcaactactgccacaagcactag

SEQ ID NO: 166736 - DNA, 609 bp, Artificial Sequence
  Description of Artificial Sequence: Synthetic coding sequence
atgaagaaggccagaaatgatgaatatgagaacctcttcaacatgattgtggagatcccccgctggaccaatgccaagatggagatcgccaccaaggagcccatgaaccccatcaagcagtatgtgaaggatggcaagctgcgctacgtggccaacatcttcccctacaagggctacatctggaactacggcaccctgccccagacctgggaggacccccatgagaaggacaagagcaccaactgctttggagacaatgaccccattgatgtgtgtgagatcggcagcaagatcctgagctgtggggaggtgatccacgtgaagatcctgggcatcctggccctgattgatgaaggagaaacagactggaagctgattgccatcaatgccaatgaccctgaggccagcaagttccacggcctgaggaacatccctgtgtacaccatcaaccgcatcgtcatcctgcccagcctggacaggagccagaccagcagcctgagctacctgcctgcccaccaggacagctgtgtgcccctggatgctgccctgcacgtggtgctgtacttctgcagcctgctgggcctgcagagctacctgagctgcttctag

SEQ ID NO: 166737 - DNA, 1005 bp, Artificial Sequence
  Description of Artificial Sequence: Synthetic coding sequence
atgtctgccctgctgcggctgctgaggactggagccccagctgctgcctgcctgcggctgggcaccagcgctggcaccggcagcagaagagccatggccctgtaccacacagaggagcggggccagccctgcagccagaactaccgcctcttcttcaagaatgtgacaggccactacatcagccccttccatgacatccccctgaaggtgaacagcaaggaggagaatggcatccccatgaagaaggccagaaatgatgaatatgaaaatctcttcaacatgattgtggagatcccccgctggaccaatgccaagatggagatcgccaccaaggagcccatgaaccccatcaagcagtatgtgaaggatggcaagctgcgctacgtggccaacatcttcccctacaagggctacatctggaactacggcaccctgccccagacctgggaggacccccatgagaaggacaagagcaccaactgcttcggggacaatgaccccattgatgtgtgtgaaattggcagcaagatcctgagctgtggggaggtgattcatgtgaagatcctgggcatcctggccctgattgatgaaggagaaacagactggaagctgattgccatcaatgccaatgaccctgaggccagcaagttccatgacattgatgatgtgaagaagttcaagccaggctacctggaggccaccctgaactggttccggctgtacaaggtgcctgatggcaagccagagaaccagtttgccttcaatggagagttcaagaacaaggcctttgccctggaggtgatcaagagcacccaccagtgctggaaggccctgctgatgaagaagtgcaatggaggagccatcaactgcaccaacgtgcagatcagtgacagccccttccgctgcacccaggaggaggcccggagcctggtggagagcgtgagcagcagccccaacaaggagagcaatgaggaggagcaggtgtggcacttcctgggcaagtag

SEQ ID NO: 166738 - DNA, 918 bp, Artificial Sequence
  Description of Artificial Sequence: Synthetic coding sequence
atgtctgccctgctgcggctgctgaggactggagccccagctgctgcctgcctgcggctgggcaccagcgctggcaccggcagcagaagagccatggccctgtaccacacagaggagcggggccagccctgcagccagaactaccgcctcttcttcaagaatgtgacaggccactacatcagccccttccatgacatccccctgaaggtgaacagcaaggaggagaatggcatccccatgaagaaggccagaaatgatgaatatgaaaatctcttcaacatgattgtggagatcccccgctggaccaatgccaagatggagatcgccaccaaggagcccatgaaccccatcaagcagtatgtgaaggatggcaagctgcgctacgtggccaacatcttcccctacaagggctacatctggaactacggcaccctgccccagatcctgagctgtggggaggtgatccacgtgaagatcctgggcatcctggccctgattgatgaaggagaaacagactggaagctgattgccatcaatgccaatgaccctgaggccagcaagttccatgacattgatgatgtgaagaagttcaagccaggctacctggaggccaccctgaactggttccggctgtacaaggtgcctgatggcaagccagagaaccagtttgccttcaacggggagttcaagaacaaggcctttgccctggaggtgatcaagagcacccaccagtgctggaaggccctgctgatgaagaagtgcaatggaggagccatcaactgcaccaacgtgcagatcagtgacagccccttccgctgcacccaggaggaggcccggagcctggtggagagcgtgagcagcagccccaacaaggagagcaatgaggaggagcaggtgtggcacttcctgggcaagtag

SEQ ID NO: 166739 - DNA, 507 bp, Artificial Sequence
  Description of Artificial Sequence: Synthetic coding sequence
atgtctgccctgctgcggctgctgaggactggagccccagctgctgcctgcctgcggctgggcaccagcgctggcaccggcagcagaagagccatggccctgtaccacacagaggagcggggccagccctgcagccagaactaccgcctcttcttcaacattgatgatgtgaagaagttcaagccaggctacctggaggccaccctgaactggttccggctgtacaaggtgcctgatggcaagccagagaaccagtttgccttcaatggagagttcaagaacaaggcctttgccctggaggtgatcaagagcacccaccagtgctggaaggccctgctgatgaagaagtgcaatggaggagccatcaactgcaccaacgtgcagatcagtgacagccccttccgctgcacccaggaggaggcccggagcctggtggagagcgtgagcagcagccccaacaaggagagcaatgaggaggagcaggtgtggcacttcctgggcaagtag

SEQ ID NO: 166740 - DNA, 1050 bp, Artificial Sequence
  Description of Artificial Sequence: Synthetic coding sequence
atgtctgccctgctgcggctgctgaggactggagccccagctgctgcctgcctgcggctgggcaccagcgctggcaccggcagcagaagagccatggccctgtaccacacagaggagcggggccagccctgcagccagaactaccgcctcttcttcaagaatgtgacaggccactacatcagccccttccatgacatccccctgaaggtgaacagcaaggaggacacagaggcccagggcatcttcatcgacctgagcaagatctgggagaatggcatccccatgaagaaggccagaaatgatgaatatgagaacctcttcaacatgattgtggagatcccccgctggaccaatgccaagatggagatcgccaccaaggagcccatgaaccccatcaagcagtatgtgaaggatggcaagctgcgctacgtggccaacatcttcccctacaagggctacatctggaactacggcaccctgccccagacctgggaggacccccatgagaaggacaagagcaccaactgctttggagacaatgaccccattgatgtgtgtgagatcggcagcaagatcctgagctgtggggaggtgatccacgtgaagatcctgggcatcctggccctgattgatgaaggagaaacagactggaagctgattgccatcaatgccaatgaccctgaggccagcaagttccatgacattgatgatgtgaagaagttcaagccaggctacctggaggccaccctgaactggttccggctgtacaaggtgcctgatggcaagccagagaaccagtttgccttcaacggggagttcaagaacaaggcctttgccctggaggtgatcaagagcacccaccagtgctggaaggccctgctgatgaagaagtgcaatggaggagccatcaactgcaccaacgtgcagatcagtgacagccccttccgctgcacccaggaggaggcccggagcctggtggagagcgtgagcagcagccccaacaaggagagcaatgaggaggagcaggtgtggcacttcctgggcaagtag

SEQ ID NO: 166741 - DNA, 951 bp, Artificial Sequence
  Description of Artificial Sequence: Synthetic coding sequence
atgtctgccctgctgcggctgctgaggactggagccccagctgctgcctgcctgcggctgggcaccagcgctggcaccggcagcagaagagccatggccctgtaccacacagaggagcggggccagccctgcagccagaactaccgcctcttcttcaagaatgtgacaggccactacatcagccccttccatgacatccccctgaaggtgaacagcaaggaggagaatggcatccccatgaagaaggccagaaatgatgaatatgagatcgccaccaaggagcccatgaaccccatcaagcagtatgtgaaggatggcaagctgcgctacgtggccaacatcttcccctacaagggctacatctggaactacggcaccctgccccagacctgggaggacccccatgagaaggacaagagcaccaactgcttcggggacaatgaccccattgatgtgtgtgaaattggcagcaagatcctgagctgtggggaggtgattcatgtgaagatcctgggcatcctggccctgattgatgaaggagaaacagactggaagctgattgccatcaatgccaatgaccctgaggccagcaagttccatgacattgatgatgtgaagaagttcaagccaggctacctggaggccaccctgaactggttccggctgtacaaggtgcctgatggcaagccagagaaccagtttgccttcaatggagagttcaagaacaaggcctttgccctggaggtgatcaagagcacccaccagtgctggaaggccctgctgatgaagaagtgcaatggaggagccatcaactgcaccaacgtgcagatcagtgacagccccttccgctgcacccaggaggaggcccggagcctggtggagagcgtgagcagcagccccaacaaggagagcaatgaggaggagcaggtgtggcacttcctgggcaagtag

SEQ ID NO: 166742 - DNA, 699 bp, Artificial Sequence
  Description of Artificial Sequence: Synthetic coding sequence
atgtctgccctgctgcggctgctgaggactggagccccagctgctgcctgcctgcggctgggcaccagcgctggcaccggcagcagaagagccatggccctgtaccacacagaggagcggggccagccctgcagccagaactaccgcctcttcttcaagaatgtgacaggccactacatcagccccttccatgacatccccctgaaggtgaacagcaaggagatcctgagctgtggggaggtgattcatgtgaagatcctgggcatcctggccctgattgatgaaggagaaacagactggaagctgattgccatcaatgccaatgaccctgaggccagcaagttccatgacattgatgatgtgaagaagttcaagccaggctacctggaggccaccctgaactggttccggctgtacaaggtgcctgatggcaagccagagaaccagtttgccttcaatggagagttcaagaacaaggcctttgccctggaggtgatcaagagcacccaccagtgctggaaggccctgctgatgaagaagtgcaatggaggagccatcaactgcaccaacgtgcagatcagtgacagccccttccgctgcacccaggaggaggcccggagcctggtggagagcgtgagcagcagccccaacaaggagagcaatgaggaggagcaggtgtggcacttcctgggcaagtag

SEQ ID NO: 166743 - DNA, 960 bp, Artificial Sequence
  Description of Artificial Sequence: Synthetic coding sequence
atgtctgtgggcttcatcggggccggccagctggcctttgccctggccaagggcttcaccgctgctggggtgctggccgcccacaagatcatggccagcagcccagacatggacctggccaccgtgtctgccctgaggaagatgggcgtgaagctgaccccccacaacaaggagaccgtgcagcacagtgatgtgctcttcctggccgtgaagccccacatcatccccttcatcctggatgagatcggggctgacattgaagatagacacatcgtggtgtcctgtgccgccggcgtgaccatcagcagcattgagaagaagctgagcgccttccggcctgcccccagggtcatccgctgcatgaccaacacccctgtggtggtgcgggagggcgccaccgtgtatgccaccggcacccacgcccaggtggaggatggccgcctgatggagcagctgctgagctctgtgggcttctgcacagaggtggaggaggacctgattgatgctgtgacaggcctgagcggcagcggccctgcctatgccttcaccgccctggatgccctggctgatggcggcgtgaagatgggcctgccccggcggctggccgtgcggctgggcgcccaggccctgctgggcgccgccaagatgctgctgcacagcgagcagcaccctggccagctgaaggacaacgtgagcagccctgggggcgccaccatccacgccctgcacgtgctggagagcggcggcttccgcagcctgctgatcaatgctgtggaggccagctgcatccgcacccgggagctgcagagcatggctgaccaggagcaggtgtccccagctgccatcaagaagaccatcctggacaaggtgaagctggacagccctgctggaacagccctgagccccagcggccacaccaagctgctgcccaggagcctggccccagctgggaaggactag

SEQ ID NO: 166744 - DNA, 951 bp, Artificial Sequence
  Description of Artificial Sequence: Synthetic coding sequence
atgtctgtgggcttcatcggggccggccagctggcctttgccctggccaagggcttcaccgctgctggggtgctggccgcccacaagatcatggccagcagcccagacatggacctggccaccgtgtctgccctgaggaagatgggcgtgaagctgaccccccacaacaaggagaccgtgcagcacagtgatgtgctcttcctggccgtgaagccccacatcatccccttcatcctggatgagatcggggctgacattgaagatagacacatcgtggtgtcctgtgccgccggcgtgaccatcagcagcattgagaagaagctgagcgccttccggcctgcccccagggtcatccgctgcatgaccaacacccctgtggtggtgcgggagggcgccaccgtgtatgccaccggcacccacgcccaggtggaggatggccgcctgatggagcagctgctgagctctgtgggcttctgcacagaggtggaggaggacctgattgatgctgtgacaggcctgagcggcagcggccctgcctatgccttcaccgccctggatgccctggctgatggcggcgtgaagatgggcctgccccggcggctggccgtgcggctgggcgcccaggccctgctgggcgccgccaagatgctgctgcacagcgagcagcaccctggccagctgaaggacaacgtgagcagccctgggggcgccaccatccacgccctgcacgtgctggagagcggcggcttccgcagcctgctgatcaatgctgtggaggccagctgcatccgcacccgggagctgcagagcatggctgaccaggagcaggtgtccccagctgccatcaagaagaccatcctggacaaggaccacctgcccctggagctgggcagccctgagggcctgcaccccctgctgctgcagtaccagctggcccgggcccccagctag

SEQ ID NO: 166745 - DNA, 1041 bp, Artificial Sequence
  Description of Artificial Sequence: Synthetic coding sequence
atggtgggcggcggccggcgggtgggcagagatgagcctgtgcccagcgtgggcgccctgggccagggcagcccagacagcatgtctgtgggcttcatcggggccggccagctggcctttgccctggccaagggcttcaccgctgctggggtgctggccgcccacaagatcatggccagcagcccagacatggacctggccaccgtgtctgccctgaggaagatgggcgtgaagctgaccccccacaacaaggagaccgtgcagcacagtgatgtgctcttcctggccgtgaagccccacatcatccccttcatcctggatgaaattggagctgacatcgaggacagacacatcgtggtgtcctgtgccgccggcgtgaccatcagcagcattgagaagaagctgagcgccttccggcctgcccccagggtcatccgctgcatgaccaacacccctgtggtggtgcgggagggcgccaccgtgtatgccaccggcacccacgcccaggtggaggatggccgcctgatggagcagctgctgagctctgtgggcttctgcacagaggtggaggaggacctgattgatgctgtgacaggcctgagcggcagcggccctgcctatgccttcaccgccctggatgccctggctgatggaggagtgaagatgggcctgccccggcggctggccgtgcggctgggcgcccaggccctgctgggcgccgccaagatgctgctgcacagcgagcagcaccctggccagctgaaggacaacgtgagcagccctggaggagccaccatccacgccctgcacgtgctggagagcggcggcttccgcagcctgctgatcaatgctgtggaggccagctgcatccgcacccgggagctgcagagcatggctgaccaggagcaggtgtccccagctgccatcaagaagaccatcctggacaaggtgaagctggacagccctgctggaacagccctgagccccagcggccacaccaagctgctgcccaggagcctggccccagctgggaaggactag

SEQ ID NO: 166746 - DNA, 819 bp, Artificial Sequence
  Description of Artificial Sequence: Synthetic coding sequence
atgtctgtgggcttcatcggggccggccagctggcctttgccctggccaagggcttcaccgctgctggggtgctggccgcccacaagatcatggccagcagcccagacatggacctggccaccgtgtctgccctgaggaagatgggcgtgaagctgaccccccacaacaaggagaccgtgcagcacagtgatgtgctcttcctggccgtgaagccccacatcatccccttcatcctggatgagatcggggctgacattgaagatagacacatcgtggtgtcctgtgccgccggcgtgaccatcagcagcattgagaagaagctgagcgccttccggcctgcccccagggtcatccgctgcatgaccaacacccctgtggtggtgcgggagggcgccaccgtgtatgccaccggcacccacgcccaggtggaggatggccgcctgatggagcagctgctgagctctgtgggcttctgcacagaggtggaggaggacctgattgatgctgtgacaggcctgagcggcagcggccctgcctatgccttcaccgccctggatgccctggctgatggcggcgtgaagatgggcctgccccggcggctggccgtgcggctgggcgcccaggccctgctgggcggctgccaggatgctgctgccctgaggacagcccccaggcctgcccagggccagaggcagctgtcctggtggggccaccacccctgcctggcctgtgccggggagtggggcctgcccctgcctgcccaccagagatgtggcggcctgctgcacccccacactggagctgctgtgcatggatag

SEQ ID NO: 166747 - DNA, 723 bp, Artificial Sequence
  Description of Artificial Sequence: Synthetic coding sequence
atgtctgtgggcttcatcggggccggccagctggcctttgccctggccaagggcttcaccgctgctggggtgctggccgcccacaagatcatggccagcagcccagacatggacctggccaccgtgtctgccctgaggaagatgggcgtgaagctgaccccccacaacaaggagaccgtgcagcacagtgatgtgctcttcctggccgtgaagccccacatcatcagcattgagaagctgagcgccttccggcctgcccccagggtcatccgctgcatgaccaacacccctgtggtggtgcgggagggcgccaccgtgtatgccaccggcacccacgcccaggtggaggatggccgcctgatggagcagctgctgagctctgtgggcttctgcacagaggtggaggaggacctgattgatgctgtgacaggcctgagcggcagcggccctgcctacggggccgccaagatgctgctgcacagcgagcagcaccctggccagctgaaggacaacgtgagcagccctggaggagccaccatccacgccctgcacgtgctggagagcggcggcttccgcagcctgctgatcaatgctgtggaggccagctgcatccgcacccgctgggccccagccctgcctgccagcctggtgagcagcccctgcatggccgaggccagcctgacccacatctgcagcttcacccacagcgctgacacctactag

SEQ ID NO: 166748 - DNA, 1590 bp, Artificial Sequence
  Description of Artificial Sequence: Synthetic coding sequence
atgctgaagttcagaacagtgcacggcggcctgcggctgctgggcatccggaggaccagcacagccccagctgccagccccaacgtgcggcggctggagtacaagcccatcaagaaggtgatggtggccaacagaggagagatcgccatccgggtcttccgggcctgcacagagctgggcatcagaacagtggccatctacagcgagcaggacaccggccagatgcaccggcagaaggcagatgaggcctacctgattggccggggcctggcccctgtgcaggcctacctgcacatcccagacatcatcaaggtggccaaggagaacaacgtggatgctgtgcaccctggctacggcttcctgtctgaaagagctgactttgcccaggcctgccaggatgctggggtgcgcttcatcggccccagccctgaggtggtgaggaagatgggagacaaggtggaggcccgggccatcgccatcgccgccggcgtgcctgtggtgcccggcacagatgcccccatcaccagcctgcacgaggcccacgagttcagcaacacctacggcttccccatcatcttcaaggccgcctatggaggcggcggccggggcatgagggtggtgcacagctatgaggagctggaggagaactacacccgggcctacagcgaggccctggccgcctttggaaatggagccctgtttgtggagaagttcatcgagaagcccaggcacatcgaggtgcagatcctgggggaccagtatggcaacatcctgcacctgtatgagcgggactgcagcatccagaggaggcaccagaaggtggtggagatcgccccagctgcccacctggacccccagctgcggacccggctgaccagtgacagcgtgaagctggccaagcaggtgggctatgaaaatgccggcaccgtggagttcctggtggacagacatggcaagcactacttcatcgaggtgaacagccggctgcaggtggagcacacagtgacagaggagatcacagatgtggacctggtgcacgcccagatccacgtggccgagggccgcagcctgcctgacctgggcctgcggcaggagaacatccgcatcaatggctgtgccatccagtgccgggtgaccacagaagatcctgcccggagcttccagcctgacaccggccgcatcgaggtgttccgctctggagagggcatgggcatccggctggacaatgccagcgccttccagggcgccgtcatcagcccccactatgacagcctgctggtgaaggtgattgcccacggcaaggaccaccccacagctgccaccaagatgagccgggccctggccgagttccgggtgcggggcgtgaaggtgcggcggcaccaggcccagcccctggccgccgccctgggccggccctgtggccaggaggcccggcggccccaggccgctgtgacagcccccaccggccctggcagccccaccctggtgcgggtgcccccagctgcccgggtgctgagcagccggctgggcggccccagccagaccaccccagagaccagcacagaggtgagccccaccatcctgctgtag

SEQ ID NO: 166749 - DNA, 3537 bp, Artificial Sequence
  Description of Artificial Sequence: Synthetic coding sequence
atgctgaagttcagaacagtgcacggcggcctgcggctgctgggcatccggaggaccagcacagccccagctgccagccccaacgtgcggcggctggagtacaagcccatcaagaaggtgatggtggccaacagaggagagatcgccatccgggtcttccgggcctgcacagagctgggcatcagaacagtggccatctacagcgagcaggacaccggccagatgcaccggcagaaggcagatgaggcctacctgattggccggggcctggcccctgtgcaggcctacctgcacatcccagacatcatcaaggtggccaaggagaacaacgtggatgctgtgcaccctggctacggcttcctgtctgaaagagctgactttgcccaggcctgccaggatgctggggtgcgcttcatcggccccagccctgaggtggtgaggaagatgggagacaaggtggaggcccgggccatcgccatcgccgccggcgtgcctgtggtgcccggcacagatgcccccatcaccagcctgcacgaggcccacgagttcagcaacacctacggcttccccatcatcttcaaggccgcctatggaggcggcggccggggcatgagggtggtgcacagctatgaggagctggaggagaactacacccgggcctacagcgaggccctggccgcctttggaaatggagccctgtttgtggagaagttcatcgagaagcccaggcacatcgaggtgcagatcctgggggaccagtatggcaacatcctgcacctgtatgagcgggactgcagcatccagaggaggcaccagaaggtggtggagatcgccccagctgcccacctggacccccagctgcggacccggctgaccagtgacagcgtgaagctggccaagcaggtgggctatgaaaatgccggcaccgtggagttcctggtggacagacatggcaagcactacttcatcgaggtgaacagccggctgcaggtggagcacacagtgacagaggagatcacagatgtggacctggtgcacgcccagatccacgtggccgagggccgcagcctgcctgacctgggcctgcggcaggagaacatccgcatcaatggctgtgccatccagtgccgggtgaccacagaagatcctgcccggagcttccagcctgacaccggccgcatcgaggtgttccgctctggagagggcatgggcatccggctggacaatgccagcgccttccagggcgccgtcatcagcccccactatgacagcctgctggtgaaggtgattgcccacggcaaggaccaccccacagctgccaccaagatgagccgggccctggccgagttccgggtgcggggcgtgaagaccaacatcgccttcctgcagaatgtgctgaacaaccagcagttcctggccggcaccgtggacacccagttcattgatgaaaatcctgagctgttccagctgcggcctgcccagaacagagcccagaagctgctgcactacctgggccacgtgatggtgaatggccccaccacccccatccctgtgaaggccagccccagccccacagatcctgtggtgcctgctgtgcccatcggccccccacctgctggcttccgggacatcctgctgcgggagggccctgagggctttgcccgggctgtgaggaaccaccctggcctgctgctgatggacaccaccttcagagatgcccaccagagcctgctggccaccagggtgaggacccatgacctgaagaagatcgccccctacgtggcccacaacttcagcaagctgttctccatggagaactggggcggggccacctttgatgtggccatgaggttcctgtatgaatgtccctggaggcggctgcaggagctgcgggagctgatccccaacatccccttccagatgctgctgcggggggccaatgctgtgggctacaccaactacccagacaacgtggtgttcaagttctgtgaggtggccaaggaaaatggcatggatgtgttccgggtgtttgacagcctgaactacctgcccaacatgctgctgggcatggaggccgccggcagcgctgggggcgtggtggaggccgccatctcctacacaggagatgtggccgaccccagcaggaccaagtacagcctgcagtactacatgggcctggccgaggagctggtgcgggccggcacccacatcctgtgcatcaaggacatggccggcctgctgaagcccacagcctgcaccatgctggtgagcagcctgcgggaccgcttcccagacctgcccctgcacatccacacccatgacaccagcggggccggcgtggccgccatgctggcctgtgcccaggccggggctgatgtggtggatgtggccgctgacagcatgagcggcatgaccagccagcccagcatgggcgccctggtggcctgcacccggggcacccccctggacacagaggtgcccatggagcgggtgtttgactacagcgagtactgggagggcgcccggggcctgtatgctgcctttgactgcacagccaccatgaagagcggcaacagtgatgtgtatgaaaatgagatccctgggggccagtacaccaacctgcacttccaggcccacagcatgggcctgggcagcaagttcaaggaggtgaagaaggcctacgtggaggccaaccagatgctgggggacctgatcaaggtgacccccagcagcaagatcgtgggggacctggcccagttcatggtgcagaatggcctgagcagagctgaggccgaggcccaggccgaggagctgtccttccccaggtctgtggtggagttcctgcagggctacatcggcgtgccccacggcggcttccctgagcccttccgcagcaaggtgctgaaggacctgccccgggtggagggccggcctggggccagcctgccccccctggacctgcaggccctggagaaggagctggtggacagacatggagaggaggtgaccccagaagatgtgctgtctgctgccatgtacccagatgtgtttgcccacttcaaggacttcaccgccaccttcggccccctggacagcctgaacaccaggctcttcctgcagggccccaagattgctgaggagtttgaggtggagctggagcggggcaagaccctgcacatcaaggccctggccgtgtctgacctgaacagagctggccagaggcaggtgttctttgagctgaatggccagctgcggagcatcctggtgaaggacacccaggccatgaaggagatgcacttccaccccaaggccctgaaggatgtgaagggccagatcggggcccccatgcctgggaaggtgattgacatcaaggtggtggccggggccaaggtggccaagggccagcccctgtgtgtgctgagcgccatgaagatggagaccgtggtgaccagccccatggagggcaccgtgaggaaggtgcacgtgaccaaggacatgaccctggagggagatgacctgatcctggagattgaatag

SEQ ID NO: 166750 - DNA, 3537 bp, Artificial Sequence; identical to SEQ ID NO: 166749
  Description of Artificial Sequence: Synthetic coding sequence

SEQ ID NO: 166751 - DNA, 3537 bp, Artificial Sequence; identical to SEQ ID NO: 166749
  Description of Artificial Sequence: Synthetic coding sequence

SEQ ID NO: 166752 - DNA, 615 bp, Artificial Sequence
  Description of Artificial Sequence: Synthetic coding sequence
atgaggaagatgctggccgctgtgtcccgggtgctgagcggggccagccagaagccagccagccgggtgctggtggccagcaggaactttgccaatgatgccacctttgagatcaagaagtgtgacctgcaccggctggaggagggcccccctgtgaccaccgtgctgaccagagaagatggcctgaagtactacaggatgatgcagacagtgcggaggatggagctgaaggctgaccagctgtacaagcagaagatcatccggggcttctgccacctgtgtgatggccagttcctgctgcccctgacccaggaggcctgctgcgtgggcctggaggccggcatcaaccccacagaccacctgatcacagcctaccgggcccacggcttcaccttcacccggggcctgtctgtgcgggagatcctggccgagctgaccggcaggaaaggaggctgtgccaagggcaagggcggctccatgcacatgtatgccaagaacttctacggcggcaatggaattgtgggcgcccaggtgcccctgggcgccggcatcgccctggcctgcaagtacaacgggaaggatgaggtgtgcctgaccctgtatggagatggatag

SEQ ID NO: 166753 - DNA, 330 bp, Artificial Sequence
  Description of Artificial Sequence: Synthetic coding sequence
atggagctgcagacctaccgctaccacggccacagcatgtctgaccccggggtgtcctaccgcacccgggaggagatccaggaggtgcgcagcaagagtgaccccatcatgctgctgaaggacaggatggtgaacagcaacctggcctctgtggaggagctgaaggagattgatgtggaggtgaggaaggagattgaagatgctgcccagtttgccacagctgaccctgagccccccctggaggagctgggctaccacatctacagcagtgaccccccatttgaggtgcggggggccaaccagtggatcaagttcaagtctgtgtcctag

SEQ ID NO: 166754 - DNA, 543 bp, Artificial Sequence
  Description of Artificial Sequence: Synthetic coding sequence
atgaggaagatgctggccgctgtgtcccgggtgctgagcggggccagccagaagccagccagccgggtgctggtggccagcaggaactttgccaatgatgccacctttgagatcaagaagtgtgacctgcaccggctggaggagggcccccctgtgaccaccgtgctgaccagagaagatggcctgaagtactacaggatgatgcagacagtgcggaggatggagctgaaggctgaccagctgtacaagcagaagatcatccggggcttctgccacctgtgtgatggccaggaggcctgctgcgtgggcctggaggccggcatcaaccccacagaccacctgatcacagcctaccgggcccacggcttcaccttcacccggggcctgtctgtgcgggagatcctggccgagctgactggaaggaagggcggctgtgccaagggcaaaggaggctccatgcacatgtatgccaagaacttctatggaggaaatggcatcgtgggcgcccaggtggtgaaggatgaggactgtgtgctgctgtag

SEQ ID NO: 166755 - DNA, 1287 bp, Artificial Sequence
  Description of Artificial Sequence: Synthetic coding sequence
atgaggaagatgctggccgctgtgtcccgggtgctgagcggggccagccagaagcccaggcatggcctggccaccctgcccagcctggtgtccatcagccggctgaagcagagcagccacctgggcctgcccaagtgctgggactacagccacagcctgaagacccggcaggccagccgggtgctggtggccagcaggaactttgccaatgatgccacctttgagatcaagaagtgtgacctgcaccggctggaggagggcccccctgtgaccaccgtgctgaccagagaagatggcctgaagtactacaggatgatgcagacagtgcggaggatggagctgaaggctgaccagctgtacaagcagaagatcatccggggcttctgccacctgtgtgatggccaggaggcctgctgcgtgggcctggaggccggcatcaaccccacagaccacctgatcacagcctaccgggcccacggcttcaccttcacccggggcctgtctgtgcgggagatcctggccgagctgactggaaggaagggcggctgtgccaagggcaaaggaggctccatgcacatgtatgccaagaacttctatggaggaaatggcatcgtgggcgcccaggtgcccctgggcgccggcatcgccctggcctgcaagtacaacgggaaggatgaggtgtgcctgaccctgtatggagatggagctgccaaccagggccagatctttgaggcctacaacatggccgccctgtggaagctgccctgcatcttcatctgtgagaacaacagatatggcatgggcacctctgtggagagagctgctgccagcacagactactacaagagaggagacttcatccctggcctgcgggtggatggcatggacatcctgtgtgtgcgggaggccaccaggtttgctgctgcctactgccgcagcggcaagggccccatcctgatggagctgcagacctaccgctaccacggccacagcatgtctgaccccggggtgtcctaccgcacccgggaggagatccaggaggtgcgcagcaagagtgaccccatcatgctgctgaaggacaggatggtgaacagcaacctggcctctgtggaggagctgaaggagattgatgtggaggtgaggaaggagattgaagatgctgcccagtttgccacagctgaccctgagccccccctggaggagctgggctaccacatctacagcagtgaccccccatttgaggtgcggggggccaaccagtggatcaagttcaagtctgtgtcctag

SEQ ID NO: 166756 - DNA, 366 bp, Artificial Sequence
  Description of Artificial Sequence: Synthetic coding sequence
atgaggaagatgctggccgctgtgtcccgggtgctgagcggggccagccagaagccctttgctggcagccccccacccaggcacctgactgtgggcaggaagctgagcagccgctatgaggtgacctttgaaagtgcccaggccagccgggtgctggtggccagcaggaactttgccaatgatgccacctttgagatcaagaagtgtgacctgcaccggctggaggagggcccccctgtgaccaccgtgctgaccagagaagatggcctgaagtactacaggatgatgcagacagtgcggaggatggagctgaaggctgaccagctgtacaagcagaagatcatccggggcttctgccacctgtag

SEQ ID NO: 166757 - DNA, 366 bp, Artificial Sequence; identical to SEQ ID NO: 166756
  Description of Artificial Sequence: Synthetic coding sequence

SEQ ID NO: 166758 - DNA, 1173 bp, Artificial Sequence
  Description of Artificial Sequence: Synthetic coding sequence
atgaggaagatgctggccgctgtgtcccgggtgctgagcggggccagccagaagccagccagccgggtgctggtggccagcaggaactttgccaatgatgccacctttgagatcaagaagtgtgacctgcaccggctggaggagggcccccctgtgaccaccgtgctgaccagagaagatggcctgaagtactacaggatgatgcagacagtgcggaggatggagctgaaggctgaccagctgtacaagcagaagatcatccggggcttctgccacctgtgtgatggccaggaggcctgctgcgtgggcctggaggccggcatcaaccccacagaccacctgatcacagcctaccgggcccacggcttcaccttcacccggggcctgtctgtgcgggagatcctggccgagctgactggaaggaagggcggctgtgccaagggcaaaggaggctccatgcacatgtatgccaagaacttctatggaggaaatggcatcgtgggcgcccaggtgcccctgggcgccggcatcgccctggcctgcaagtacaacgggaaggatgaggtgtgcctgaccctgtatggagatggagctgccaaccagggccagatctttgaggcctacaacatggccgccctgtggaagctgccctgcatcttcatctgtgagaacaacagatatggcatgggcacctctgtggagagagctgctgccagcacagactactacaagagaggagacttcatccctggcctgcgggtggatggcatggacatcctgtgtgtgcgggaggccaccaggtttgctgctgcctactgccgcagcggcaagggccccatcctgatggagctgcagacctaccgctaccacggccacagcatgtctgaccccggggtgtcctaccgcacccgggaggagatccaggaggtgcgcagcaagagtgaccccatcatgctgctgaaggacaggatggtgaacagcaacctggcctctgtggaggagctgaaggagattgatgtggaggtgaggaaggagattgaagatgctgcccagtttgccacagctgaccctgagccccccctggaggagctgggctaccacatctacagcagtgaccccccatttgaggtgcggggggccaaccagtggatcaagttcaagtctgtgtcctag

SEQ ID NO: 166759 - DNA, 618 bp, Artificial Sequence
  Description of Artificial Sequence: Synthetic coding sequence
atgaggaagatgctggccgctgtgtcccgggtgctgagcggggccagccagaagcccaggcatggcctggccaccctgcccagcctggtgtccatcagccggctgaagcagagcagccacctgggcctgcccaagtgctgggactacagccacagcctgaagacccggcaggccagccgggtgctggtggccagcaggaactttgccaatgatgccacctttgagatcaagaagtgtgacctgcaccggctggaggagggcccccctgtgaccaccgtgctgaccagagaagatggcctgaagtactacaggatgatgcagacagtgcggaggatggagctgaaggctgaccagctgtacaagcagaagatcatccggggcttctgccacctgtgtgatggccaggaggcctgctgcgtgggcctggaggccggcatcaaccccacagaccacctgatcacagcctaccgggcccacggcttcaccttcacccggggcctgtctgtgcgggagatcctggccgagctgactggaaggaagggcggctgtgccaagggcaaaggaggctccatgcacatgtatgccaagaacttctatggaggaaatggcatcgtgtag

SEQ ID NO: 166760 - DNA, 1080 bp, Artificial Sequence
  Description of Artificial Sequence: Synthetic coding sequence
atgaggaagatgctggccgctgtgtcccgggtgctgagcggggccagccagaagccagccagccgggtgctggtggccagcaggaactttgccaatgatgccacctttgagatcaagaagtgtgacctgcaccggctggaggagggcccccctgtgaccaccgtgctgaccagagaagatggcctgaagtactacaggatgatgcagacagtgcggaggatggagctgaaggctgaccagctgtacaagcagaagatcatccggggcttctgccacctgtgtgatggccaggaggcctgctgcgtgggcctggaggccggcatcaaccccacagaccacctgatcacagcctaccgggcccacggcttcaccttcacccggggcctgtctgtgcgggagatcctggccgagctgactggaaggaagggcggctgtgccaagggcaaaggaggctccatgcacatgtatgccaagaacttctatggaggaaatggcatcgtgggcgcccagggccagatctttgaggcctacaacatggccgccctgtggaagctgccctgcatcttcatctgtgagaacaacagatatggcatgggcacctctgtggagagagctgctgccagcacagactactacaagagaggagacttcatccctggcctgcgggtggatggcatggacatcctgtgtgtgcgggaggccaccaggtttgctgctgcctactgccgcagcggcaagggccccatcctgatggagctgcagacctaccgctaccacggccacagcatgtctgaccccggggtgtcctaccgcacccgggaggagatccaggaggtgcgcagcaagagtgaccccatcatgctgctgaaggacaggatggtgaacagcaacctggcctctgtggaggagctgaaggagattgatgtggaggtgaggaaggagattgaagatgctgcccagtttgccacagctgaccctgagccccccctggaggagctgggctaccacatctacagcagtgaccccccatttgaggtgcggggggccaaccagtggatcaagttcaagtctgtgtcctag

SEQ ID NO: 166761 - DNA, 129 bp, Artificial Sequence
  Description of Artificial Sequence: Synthetic coding sequence
gccaaccagtggatcaagttcaagtctgtgaagggcagaagaagaagaggctacaccttccggggcctgcctgacagcgtgctgaacctggtgaaggaggaggagaaccctgtgaatgagatccagtag

SEQ ID NO: 166762 - DNA, 1194 bp, Artificial Sequence
  Description of Artificial Sequence: Synthetic coding sequence
atgaggaagatgctggccgctgtgtcccgggtgctgagcggggccagccagaagccagccagccgggtgctggtggccagcaggaactttgccaatgatgccacctttgagatcaagaagtgtgacctgcaccggctggaggagggcccccctgtgaccaccgtgctgaccagagaagatggcctgaagtactacaggatgatgcagacagtgcggaggatggagctgaaggctgaccagctgtacaagcagaagatcatccggggcttctgccacctgtgtgatggccagttcctgctgcccctgacccaggaggcctgctgcgtgggcctggaggccggcatcaaccccacagaccacctgatcacagcctaccgggcccacggcttcaccttcacccggggcctgtctgtgcgggagatcctggccgagctgaccggcaggaaaggaggctgtgccaagggcaagggcggctccatgcacatgtatgccaagaacttctacggcggcaatggaattgtgggcgcccaggtgcccctgggcgccggcatcgccctggcctgcaagtacaacgggaaggatgaggtgtgcctgaccctgtatggagatggagctgccaaccagggccagatctttgaggcctacaacatggccgccctgtggaagctgccctgcatcttcatctgtgagaacaacagatatggcatgggcacctctgtggagagagctgctgccagcacagactactacaagagaggagacttcatccctggcctgcgggtggatggcatggacatcctgtgtgtgcgggaggccaccaggtttgctgctgcctactgccgcagcggcaagggccccatcctgatggagctgcagacctaccgctaccacggccacagcatgtctgaccccggggtgtcctaccgcacccgggaggagatccaggaggtgcgcagcaagagtgaccccatcatgctgctgaaggacaggatggtgaacagcaacctggcctctgtggaggagctgaaggagattgatgtggaggtgaggaaggagattgaagatgctgcccagtttgccacagctgaccctgagccccccctggaggagctgggctaccacatctacagcagtgaccccccatttgaggtgcggggggccaaccagtggatcaagttcaagtctgtgtcctag

SEQ ID NO: 166763 - DNA, 1167 bp, Artificial Sequence
  Description of Artificial Sequence: Synthetic coding sequence
atgctggccgccttcatcagccgggtgctgcggcgggtggcccagaagagcgccaggagagtgctggtggccagcaggaacagcagcaatgatgccacctttgagatcaagaagtgtgacctgtacctgctggaggagggcccccctgtgaccaccgtgctgaccagggctgagggcctgaagtactacaggatgatgctgactgtgcggaggatggagctgaaggctgaccagctgtacaagcagaagttcatccggggcttctgccacctgtgtgatggccaggaggcctgctgcgtgggcctggaggccggcatcaaccccagcgaccacgtgatcaccagctaccgggcccatggagtgtgctacacccggggcctgtctgtgcgcagcatcctggccgagctgactggaagaagaggaggctgtgccaagggcaaaggaggctccatgcacatgtacaccaagaacttctatggaggaaatggcatcgtgggcgcccagggccccctgggcgccggcatcgccctggcctgcaagtacaagggaaatgatgagatctgcctgaccctgtatggagatggagctgccaaccagggccagattgctgaggccttcaacatggccgccctgtggaagctgccctgtgtgttcatctgtgagaacaacctgtatggcatgggcaccagcacagaaagagctgctgccagcccagactactacaagaggggcaacttcatccctggcctgaaggtggatggcatggatgtgctgtgtgtgcgggaggccaccaagtttgctgccaactactgccgcagcggcaagggccccatcctgatggagctgcagacctaccgctaccacggccacagcatgtctgaccccggggtgtcctaccgcacccgggaggagatccaggaggtgcgcagcaagagggaccccatcatcatcctgcaggacaggatggtgaacagcaagctggccaccgtggaggagctgaaggagatcggggctgaggtgaggaaggagattgatgatgctgcccagtttgccaccacagatcctgagccccacctggaggagctgggccaccacatctacagcagtgacagcagctttgaggtgcggggggccaacccctggatcaagttcaagtctgtgtcctag

SEQ ID NO: 166764 - DNA, 1080 bp, Artificial Sequence
  Description of Artificial Sequence: Synthetic coding sequence
atggctgctgtgtctggcctggtgagaagacccctgcgggaggtgtctggcctgctgaagaggcgcttccactggacagccccagctgccctgcaggtgacagtgagagatgccatcaaccagggcatggatgaggagctggagagagatgagaaggtgttcctgctgggggaggaggtggcccagtatgatggagcctacaaggtgtcccggggcctgtggaagaagtatggagacaagaggatcatcgacacccccatcagcgagatgggctttgctggcattgctgtgggcgccgccatggccggcctgcggcccatctgtgagttcatgaccttcaacttctccatgcaggccatcgaccaggtgatcaacagcgctgccaagacctactacatgtctgggggcctgcagcctgtgcccatcgtgttccggggccccaacggggccagcgctggggtggccgcccagcacagccagtgctttgctgcctggtacggccactgccccggcctgaaggtggtgagcccctggaacagtgaagatgccaagggcctcatcaagagcgccatccgggacaacaaccctgtggtggtgctggagaatgagctgatgtatggagtgccctttgagttccccccagaggcccagagcaaggacttcctgatccccatcggcaaggccaagattgaaaggcagggcacccacatcaccgtggtgagccacagcaggcctgtgggccactgcctggaggccgctgctgtgctgagcaaggagggcgtggagtgtgaggtgatcaacatgaggaccatccggcccatggacatggagaccatcgaggcctctgtgatgaagaccaaccacctggtgacagtggagggcggctggccccagtttggagtgggcgctgagatctgtgcccgcatcatggagggccctgccttcaacttcctggatgccccagctgtgcgggtgactggagcagatgtgcccatgccctatgccaagatcctggaggacaacagcatcccccaggtgaaggacatcatctttgccatcaagaagaccctgaacatctag

SEQ ID NO: 166765 - DNA, 1026 bp, Artificial Sequence
  Description of Artificial Sequence: Synthetic coding sequence
atggctgctgtgtctggcctggtgagaagacccctgcgggaggtgacagtgagagatgccatcaaccagggcatggatgaggagctggagagagatgagaaggtgttcctgctgggggaggaggtggcccagtatgatggagcctacaaggtgtcccggggcctgtggaagaagtatggagacaagaggatcatcgacacccccatcagcgagatgggctttgctggcattgctgtgggcgccgccatggccggcctgcggcccatctgtgagttcatgaccttcaacttctccatgcaggccatcgaccaggtgatcaacagcgctgccaagacctactacatgtctgggggcctgcagcctgtgcccatcgtgttccggggccccaacggggccagcgctggggtggccgcccagcacagccagtgctttgctgcctggtacggccactgccccggcctgaaggtggtgagcccctggaacagtgaagatgccaagggcctcatcaagagcgccatccgggacaacaaccctgtggtggtgctggagaatgagctgatgtatggagtgccctttgagttccccccagaggcccagagcaaggacttcctgatccccatcggcaaggccaagattgaaaggcagggcacccacatcaccgtggtgagccacagcaggcctgtgggccactgcctggaggccgctgctgtgctgagcaaggagggcgtggagtgtgaggtgatcaacatgaggaccatccggcccatggacatggagaccatcgaggcctctgtgatgaagaccaaccacctggtgacagtggagggcggctggccccagtttggagtgggcgctgagatctgtgcccgcatcatggagggccctgccttcaacttcctggatgccccagctgtgcgggtgactggagcagatgtgcccatgccctatgccaagatcctggaggacaacagcatcccccaggtgaaggacatcatctttgccatcaagaagaccctgaacatctag

SEQ ID NO: 166766 - DNA, 1026 bp, Artificial Sequence
  Description of Artificial Sequence: Synthetic coding sequence
atggctgctgtgtctggcctggtgagaagacccctgcgggaggtgtctggcctgctgaagaggcgcttccactggacagccccagctgccctgcaggtgacagtgagagatgccatcaaccagggcatggatgaggagctggagagagatgagaaggtgttcctgctgggggaggaggtggcccagtatgatggagcctacaaggtgtcccggggcctgtggaagaagtatggagacaagaggatcatcgacacccccatcagcgagatgggctttgctggcattgctgtgggcgccgccatggccggcctgcggcccatctgtgagttcatgaccttcaacttctccatgcaggccatcgaccaggtgatcaacagcgctgccaagacctactacatgtctggagtggccgcccagcacagccagtgctttgctgcctggtacggccactgccccggcctgaaggtggtgagcccctggaacagtgaagatgccaagggcctcatcaagagcgccatccgggacaacaaccctgtggtggtgctggagaatgagctgatgtatggagtgccctttgagttccccccagaggcccagagcaaggacttcctgatccccatcggcaaggccaagattgaaaggcagggcacccacatcaccgtggtgagccacagcaggcctgtgggccactgcctggaggccgctgctgtgctgagcaaggagggcgtggagtgtgaggtgatcaacatgaggaccatccggcccatggacatggagaccatcgaggcctctgtgatgaagaccaaccacctggtgacagtggagggcggctggccccagtttggagtgggcgctgagatctgtgcccgcatcatggagggccctgccttcaacttcctggatgccccagctgtgcgggtgactggagcagatgtgcccatgccctatgccaagatcctggaggacaacagcatcccccaggtgaaggacatcatctttgccatcaagaagaccctgaacatctag

SEQ ID NO: 166767 - DNA, 1236 bp, Artificial Sequence
  Description of Artificial Sequence: Synthetic coding sequence
atgaaggccgccaggtttgtgctgcggtctgctggcagcctgaatggagctggcctggtgccccgggaggtggagcacttcagccgctacagccccagccccctgtccatgaagcagctgctggactttggaagtgaaaatgcctgtgagaggaccagctttgccttcctgcggcaggagctgcctgtgcggctggccaacatcctgaaggagattgacatcctgcccacccagctggtgaacaccagctctgtgcagctggtgaagtcctggtacatccagagcctgatggacctggtggagttccacgagaagagcccagatgaccagaaggccctgagtgactttgtggacaccctcatcaaggtgaggaacagacaccacaacgtggtgcccaccatggcccagggcatcatcgagtacaaggatgcctgcaccgtggaccctgtgaccaaccagaacctgcagtacttcctggaccgcttctacatgaaccgcatcagcaccaggatgctgatgaaccagcacatcctgatcttcagtgacagccagacaggcaaccccagccacatcggcagcattgaccccaactgtgatgtggtggccgtggtgcaggatgcctttgaatgttccaggatgctgtgtgaccagtactacctgagcagccctgagctgaagctgacccaggtgaatggcaagttcccagaccagcccatccacatcgtgtatgtgcccagccacctgcaccacatgctgtttgagctgttcaagaatgccatgagggccaccgtggagcaccaggagaaccagcccagcctgacccccatcgaggtgattgtggtgctgggcaaggaggacctgaccatcaagatcagtgacagaggaggaggagtgcccctgcgcatcatcgacaggctcttctcctacacctacagcacagcccccacccctgtgatggacaacagcagaaatgcccccctggccggcttcggctacggcctgcccatcagccggctgtatgccaagtacttccagggcgacctgaacctgtacagcctgagcggctacggcacagatgccatcatctacctgaaggccctgagcagcgagagcattgagaagctgcccgtcttcaacaagagcgccttcaagcactaccagatgagcagcgaggctgatgactggtgcatccccagccgggagcccaagaacctggccaaggaggtggccatgtag

SEQ ID NO: 166768 - DNA, 1128 bp, Artificial Sequence
  Description of Artificial Sequence: Synthetic coding sequence
atgaagcagctgctggactttggaagtgaaaatgcctgtgagaggaccagctttgccttcctgcggcaggagctgcctgtgcggctggccaacatcctgaaggagattgacatcctgcccacccagctggtgaacaccagctctgtgcagctggtgaagtcctggtacatccagagcctgatggacctggtggagttccacgagaagagcccagatgaccagaaggccctgagtgactttgtggacaccctcatcaaggtgaggaacagacaccacaacgtggtgcccaccatggcccagggcatcatcgagtacaaggatgcctgcaccgtggaccctgtgaccaaccagaacctgcagtacttcctggaccgcttctacatgaaccgcatcagcaccaggatgctgatgaaccagcacatcctgatcttcagtgacagccagacaggcaaccccagccacatcggcagcattgaccccaactgtgatgtggtggccgtggtgcaggatgcctttgaatgttccaggatgctgtgtgaccagtactacctgagcagccctgagctgaagctgacccaggtgaatggcaagttcccagaccagcccatccacatcgtgtatgtgcccagccacctgcaccacatgctgtttgagctgttcaagaatgccatgagggccaccgtggagcaccaggagaaccagcccagcctgacccccatcgaggtgattgtggtgctgggcaaggaggacctgaccatcaagatcagtgacagaggaggaggagtgcccctgcgcatcatcgacaggctcttctcctacacctacagcacagcccccacccctgtgatggacaacagcagaaatgcccccctggccggcttcggctacggcctgcccatcagccggctgtatgccaagtacttccagggcgacctgaacctgtacagcctgagcggctacggcacagatgccatcatctacctgaaggccctgagcagcgagagcattgagaagctgcccgtcttcaacaagagcgccttcaagcactaccagatgagcagcgaggctgatgactggtgcatccccagccgggagcccaagaacctggccaaggaggtggccatgtag

SEQ ID NO: 166769 - DNA, 1614 bp, Artificial Sequence
  Description of Artificial Sequence: Synthetic coding sequence
atgcctgcccccacccagctgttcttccccctcatccggaactgtgagctgagccgcatctatggaacagcctgctactgccaccacaagcacctgtgctgcagcagcagctacatcccccagagccggctgcgctacaccccccacccagcctatgccaccttctgccggcccaaggagaactggtggcagtacacccagggcagaagatatgccagcaccccccagaagttctacctgaccccaccccaggtgaacagcatcctgaaggccaatgagtacagcttcaaggtgcctgagtttgatggcaagaatgtgagcagcatcctgggctttgacagcaaccagctgcctgccaatgcccccatcgaggaccggcgctctgctgccacctgcctgcagacccggggcatgctgctgggcgtgtttgatggccatgctggctgtgcctgcagccaggccgtgtctgagcggctcttctactacatcgctgtgtccctgctgccccatgagaccctgctggagattgaaaatgctgtggagagcggccgggccctgctgcccatcctgcagtggcacaagcaccccaatgactacttcagcaaggaggccagcaagctgtacttcaacagcctgcggacctactggcaggagctgattgacctgaacacaggagagagcacagacattgatgtgaaggaggccctgatcaatgccttcaagaggctggacaatgacatcagcctggaggcccaggtgggggaccccaacagcttcctgaactacctggtgctgcgggtggccttcagcggggccacagcctgtgtggcccacgtggatggagtggacctgcacgtggccaacacaggagacagccgggccatgctgggcgtgcaggaggaggatggctcctggagcgctgtgaccctgagcaatgaccacaatgcccagaatgaaagagagctggagcggctgaagctggagcaccccaagtctgaggccaagtctgtggtgaagcaggaccggctgctgggcctgctgatgcccttccgggcctttggagatgtgaagttcaagtggagcattgacctgcagaagagggtgattgaaagtggccctgaccagctgaatgacaatgagtacaccaagttcatcccccccaactaccacaccccaccctacctgacagctgagcctgaggtgacctaccaccggctgcggccccaggacaagttcctggtgctggccacagatggcctgtgggagaccatgcaccggcaggatgtggtgcgcatcgtgggggagtacctgaccggcatgcaccaccagcagcccatcgctgtgggcggctacaaggtgaccctgggccagatgcacggcctgctgacagaaagaaggaccaagatgagctctgtgtttgaggaccagaatgctgccacccacctgatcagacatgctgtgggcaacaatgaatttggcaccgtggaccacgagcggctgagcaagatgctgagcctgcctgaggagctggccaggatgtacagagatgacatcaccatcatcgtggtgcagttcaacagccacgtggtgggcgcctaccagaaccaggagtag

SEQ ID NO: 166770 - DNA, 1689 bp, Artificial Sequence
  Description of Artificial Sequence: Synthetic coding sequence
atgtgtgtgtgccccggcccccggcgcatcggcatccctgtgcgcagcagcagcctgcccctcttcagtgatgccatgcctgcccccacccagctgttcttccccctcatccggaactgtgagctgagccgcatctacggcacagcctgctactgccaccacaagcacctgtgctgcagcagcagctacatcccccagagccggctgcgctacaccccccacccagcctatgccaccttctgccggcccaaggagaactggtggcagtacacccagggccgccgctatgccagcaccccccagaagttctacctgaccccaccccaggtgaacagcatcctgaaggccaatgagtacagcttcaaggtgcctgagtttgatggcaagaatgtgagcagcatcctgggctttgacagcaaccagctgcctgccaatgcccccattgaagatagaagatctgctgccacctgcctgcagacccggggcatgctgctgggcgtgtttgatggccacgccggctgtgcctgcagccaggccgtgtctgagcggctcttctactacatcgctgtgtccctgctgccccatgagaccctgctggagattgaaaatgctgtggagagcggccgggccctgctgcccatcctgcagtggcacaagcaccccaatgactacttcagcaaggaggccagcaagctgtacttcaacagcctgcggacctactggcaggagctgattgacctgaacacaggagagagcacagacattgatgtgaaggaggccctgatcaatgccttcaagaggctggacaatgacatcagcctggaggcccaggtgggggaccccaacagcttcctgaactacctggtgctgcgggtggccttcagcggggccacagcctgtgtggcccacgtggatggagtggacctgcacgtggccaacacaggagacagccgggccatgctgggcgtgcaggaggaggatggctcctggagcgctgtgaccctgagcaatgaccacaatgcccagaatgaaagagagctggagcggctgaagctggagcaccccaagtctgaggccaagtctgtggtgaagcaggaccggctgctgggcctgctgatgcccttccgggcctttggagatgtgaagttcaagtggagcattgacctgcagaagagggtcatcgagagcggccctgaccagctgaatgacaatgagtacaccaagttcatcccccccaactaccacaccccaccctacctgacagctgagcctgaggtgacctaccaccggctgcggccccaggacaagttcctggtgctggccacagatggcctgtgggagaccatgcaccggcaggatgtggtgagaattgtgggggagtacctgaccggcatgcaccaccagcagcccatcgctgtgggcggctacaaggtgaccctgggccagatgcacggcctgctgacagagaggaggaccaagatgagctctgtgtttgaggaccagaatgctgccacccacctgatcagacatgctgtgggcaacaatgaatttggaacagtggaccacgagcggctgagcaagatgctgagcctgcctgaggagctggccaggatgtacagagatgacatcaccatcatcgtggtgcagttcaacagccacgtggtgggcgcctaccagaaccaggagtag

SEQ ID NO: 166771 - DNA, 1614 bp, Artificial Sequence; identical to SEQ ID NO: 166769
  Description of Artificial Sequence: Synthetic coding sequence

SEQ ID NO: 166772 - DNA, 231 bp, Artificial Sequence
  Description of Artificial Sequence: Synthetic coding sequence
atgcctgcccccacccagctgttcttccccctcatccggaactgtgagctgagccgcatctatggaacagcctgctactgccaccacaagcacctgtgctgcagcagcagctacatcccccagagccggctgcgctacaccccccacccagcctatgccaccttctgccggcccaaggagaactggtggcagtacacccagggcagaagatatgccagcaccccccagtag

SEQ ID NO: 166773 - DNA, 387 bp, Artificial Sequence
  Description of Artificial Sequence: Synthetic coding sequence
atgcctgcccccacccagctgttcttccccctcatccggaactgtgagctgagccgcatctatggaacagcctgctactgccaccacaagcacctgtgctgcagcagcagctacatcccccagagccggctgcgctacaccccccacccagcctatgccaccttctgccggcccaaggagaactggtggcagtacacccagggcagaagatatgccagcaccccccagaagttctacctgaccccaccccaggtgaacagcatcctgaaggccaatgagtacagcttcaaggtgcctgagtttgatggcaagaatgtgagcagcatcctgggctttgacagcaaccagctgcctgccaatgcccccatcgaggaccggcgctcctag

SEQ ID NO: 166774 - DNA, 699 bp, Artificial Sequence
  Description of Artificial Sequence: Synthetic coding sequence
atgcctgcccccacccagctgttcttccccctcatccggaactgtgagctgagccgcatctatggaacagcctgctactgccaccacaagcacctgtgctgcagcagcagctacatcccccagagccggctgcgctacaccccccacccagcctatgccaccttctgccggcccaaggagaactggtggcagtacacccagggcagaagatatgccagcaccccccagaagttctacctgaccccaccccaggtgaacagcatcctgaaggccaatgagtacagcttcaaggtgcctgagtttgatggcaagaatgtgagcagcatcctgggctttgacagcaaccagctgcctgccaatgcccccatcgaggaccggcgctctgctgccacctgcctgcagacccggggcatgctgctgggcgtgtttgatggccatgctggctgtgcctgcagccaggccgtgtctgagcggctcttctactacatcgctgtgtccctgctgccccatgagaccctgctggagattgaaaatgctgtggagagcggccgggccctgctgcccatcctgcagtggcacaagcaccccaatgactacttcagcaaggaggccagcaagctgtacttcaacagcctgcggacctactggcaggagctgattgacctgaacacaggagagagcacagacattgatgtgtag

SEQ ID NO: 166775 - DNA, 219 bp, Artificial Sequence
  Description of Artificial Sequence: Synthetic coding sequence
atgcctgcccccacccagctgttcttccccctcatccggaactgtgagctgagccgcatctatggaacagcctgctactgccaccacaagcacctgtgctgcagcagcagctacatcccccagagccggctgcgctacaccccccacccagcctatgccaccttctgccggcccaaggagaactggtggcagtacacccagggcagaagatatgcctag

SEQ ID NO: 166776 - DNA, 1614 bp, Artificial Sequence; identical to SEQ ID NO: 166769
  Description of Artificial Sequence: Synthetic coding sequence

SEQ ID NO: 166777 - DNA, 444 bp, Artificial Sequence
  Description of Artificial Sequence: Synthetic coding sequence
atgcctgcccccacccagctgttcttccccctcatccggaactgtgagctgagccgcatctatggaacagcctgctactgccaccacaagcacctgtgctgcagcagcagctacatcccccagagccggctgcgctacaccccccacccagcctatgccaccttctgccggcccaaggagaactggtggcagtacacccagggcagaagatatgccagcaccccccagaagttctacctgaccccaccccaggtgaacagcatcctgaaggccaatgagtacagcttcaaggtgcctgagtttgatggcaagaatgtgagcagcatcctgggctttgacagcaaccagctgcctgccaatgcccccatcgaggaccggcgctctgctgccacctgcctgcagacccggggcatgctgctgggcgtgtttgatggccacgcctag

SEQ ID NO: 166778 - DNA, 1467 bp, Artificial Sequence
  Description of Artificial Sequence: Synthetic coding sequence
atggctgacaccttcctggagcacctgtgcctgctggacatcgacagcgagcctgtggccgcccggagcaccagcatcatcgccaccatcggccctgccagccgctctgtggagcggctgaaggagatgatcaaggccggcatgaacatcgcccggctgaacttcagccacggcagccatgagtaccacgccgagagcatcgccctggacaccaagggccctgagatcagaacaggcatcctgcagggcggccctgagagcgaggtggagctggtgaagggcagccaggtgctggtgacagtggaccctgccttccgcaccagaggaaatgccaacacagtgtgggtggactaccccaacatcgtgcgggtggtgcctgtgggcggccgcatctacattgatgatggcctcatcagcctggtggtgcagaagattggccctgagggcctggtgacccaggtggagaatggaggagtgctgggcagcaggaagggcgtgaacctgcccggggcccaggtggacctgcccggcctgtctgagcaggatgtgcgggacctgcgcttcggcgtggagcacggcgtggacatcgtgtttgccagctttgtgaggaaggccagtgatgtggccgctgtgcgggccgccctgggccctgagggccacggcatcaagatcatcagcaagattgaaaatcatgaaggagtgaagagatttgatgagatcctggaggtgtctgatggcatcatggtggcccggggggacctgggcatcgagatcccagctgagaaggtgttcctggcccagaagatgatgattggccgctgcaacctggccggcaagcctgtggtgtgtgccacccagatgctggagagcatgatcaccaagccccggcccaccagggctgagaccagtgatgtggccaatgctgtgctggatggagctgactgcatcatgctgtctggagaaacagccaagggcaacttccctgtggaggccgtgaagatgcagcacgccatcgcccgggaggccgaggccgctgtgtaccaccggcagctgtttgaggagctgcggcgggccgcccccctgagccgggaccccacagaggtgacagccatcggggctgtggaggccgccttcaagtgctgtgccgccgccatcatcgtgctgaccaccaccggccgcagcgcccagctgctgagccgctaccggcccagggctgctgtgattgctgtgaccaggtctgcccaggccgcccggcaggtgcacctgtgccggggcgtcttccccctgctgtaccgggagcccccagaggccatctgggcagatgatgtggacagaagagtgcagtttggaattgaaagtggcaagctgcggggcttcctgcgggtgggggacctggtgattgtggtgacaggctggaggcctggcagcggctacaccaacatcatgagggtgctgagcatctcctag

SEQ ID NO: 166779 - DNA, 1725 bp, Artificial Sequence
  Description of Artificial Sequence: Synthetic coding sequence
atgagcatccaggagaacatcagcagcctgcagctgcgctcctgggtgtccaagagccagagggacctggccaagagcatcctgattggagcccctgggggccctgctggctacctgcggcgggcctctgtggcccagctgacccaggagctgggcacagccttcttccagcagcagcagctgcctgctgccatggctgacaccttcctggagcacctgtgcctgctggacatcgacagcgagcctgtggccgcccggagcaccagcatcatcgccaccatcggccctgccagccgctctgtggagcggctgaaggagatgatcaaggccggcatgaacatcgcccggctgaacttcagccacggcagccatgagtaccacgccgagagcatcgccaacgtgcgggaggccgtggagagctttgctggcagccccctgagctacagacctgtggccatcgccctggacaccaagggccctgagatcagaacaggcatcctgcagggcggccctgagagcgaggtggagctggtgaagggcagccaggtgctggtgacagtggaccctgccttccgcaccagaggaaatgccaacacagtgtgggtggactaccccaacatcgtgcgggtggtgcctgtgggcggccgcatctacattgatgatggcctcatcagcctggtggtgcagaagattggccctgagggcctggtgacccaggtggagaatggaggagtgctgggcagcaggaagggcgtgaacctgcccggggcccaggtggacctgcccggcctgtctgagcaggatgtgcgggacctgcgcttcggcgtggagcacggcgtggacatcgtgtttgccagctttgtgaggaaggccagtgatgtggccgctgtgcgggccgccctgggccctgagggccacggcatcaagatcatcagcaagattgaaaatcatgaaggagtgaagagatttgatgagatcctggaggtgtctgatggcatcatggtggcccggggggacctgggcatcgagatcccagctgagaaggtgttcctggcccagaagatgatgattggccgctgcaacctggccggcaagcctgtggtgtgtgccacccagatgctggagagcatgatcaccaagccccggcccaccagggctgagaccagtgatgtggccaatgctgtgctggatggagctgactgcatcatgctgtctggagaaacagccaagggcaacttccctgtggaggccgtgaagatgcagcacgccatcgcccgggaggccgaggccgctgtgtaccaccggcagctgtttgaggagctgcggcgggccgcccccctgagccgggaccccacagaggtgacagccatcggggctgtggaggccgccttcaagtgctgtgccgccgccatcatcgtgctgaccaccaccggccgcagcgcccagctgctgagccgctaccggcccagggctgctgtgattgctgtgaccaggtctgcccaggccgcccggcaggtgcacctgtgccggggcgtcttccccctgctgtaccgggagcccccagaggccatctgggcagatgatgtggacagaagagtgcagtttggaattgaaagtggcaagctgcggggcttcctgcgggtgggggacctggtgattgtggtgacaggctggaggcctggcagcggctacaccaacatcatgagggtgctgagcatctcctag

SEQ ID NO: 166780 - DNA, 1632 bp, Artificial Sequence
  Description of Artificial Sequence: Synthetic coding sequence
atggagggccctgctggctacctgcggcgggcctctgtggcccagctgacccaggagctgggcacagccttcttccagcagcagcagctgcctgctgccatggctgacaccttcctggagcacctgtgcctgctggacattgattctgagcctgtggccgcccggagcaccagcatcatcgccaccatcggccctgccagccgctctgtggagcggctgaaggagatgatcaaggccggcatgaacatcgcccggctgaacttcagccacggcagccatgagtaccacgccgagagcatcgccaacgtgcgggaggccgtggagagctttgctggcagccccctgagctacagacctgtggccatcgccctggacaccaagggccctgagatcagaacaggcatcctgcagggcggccctgagagcgaggtggagctggtgaagggcagccaggtgctggtgacagtggaccctgccttccgcaccagaggaaatgccaacacagtgtgggtggactaccccaacatcgtgcgggtggtgcctgtgggcggccgcatctacattgatgatggcctcatcagcctggtggtgcagaagattggccctgagggcctggtgacccaggtggagaatggaggagtgctgggcagcaggaaaggagtgaacctgcccggggcccaggtggacctgcccggcctgtctgagcaggatgtgcgggacctgcgctttggagtggagcacggcgtggacatcgtgtttgccagctttgtgaggaaggccagtgatgtggccgctgtgcgggccgccctgggccctgagggccacggcatcaagatcatcagcaagattgagaaccacgagggcgtgaagagatttgatgagatcctggaggtgtctgatggcatcatggtggcccggggggacctgggcatcgagatcccagctgagaaggtgttcctggcccagaagatgatgattggccgctgcaacctggccggcaagcctgtggtgtgtgccacccagatgctggagagcatgatcaccaagccccggcccaccagggctgagaccagtgatgtggccaatgctgtgctggatggagctgactgcatcatgctgagcggggagacagccaagggcaacttccctgtggaggccgtgaagatgcagcacgccatcgcccgggaggccgaggccgctgtgtaccaccggcagctgtttgaggagctgcggcgggccgcccccctgagccgggaccccacagaggtgacagccatcggggctgtggaggccgccttcaagtgctgtgccgccgccatcatcgtgctgaccaccaccggccgcagcgcccagctgctgagccgctaccggcccagggctgctgtgattgctgtgaccaggtctgcccaggccgcccggcaggtgcacctgtgccggggcgtcttccccctgctgtaccgggagcccccagaggccatctgggcagatgatgtggaccggcgggtgcagtttggcatcgagagcggcaagctgcggggcttcctgcgggtgggggacctggtgattgtggtgacaggctggaggcctggcagcggctacaccaacatcatgagggtgctgagcatctcctag

SEQ ID NO: 166781 - DNA, 1800 bp, Artificial Sequence
  Description of Artificial Sequence: Synthetic coding sequence
atgagcatccaggagaacatcagcagcctgcagctgcgctcctgggtgtccaagagccagagggacctggccaagagcatcctgattggagcccctggggtgcccctgaccacccagcagtgtggggctgacccccagaggggccggccccgggaggtgtgcagcggcatggagggccctgctggctacctgcggcgggcctctgtggcccagctgacccaggagctgggcacagccttcttccagcagcagcagctgcctgctgccatggctgacaccttcctggagcacctgtgcctgctggacattgattctgagcctgtggccgcccggagcaccagcatcatcgccaccatcggccctgccagccgctctgtggagcggctgaaggagatgatcaaggccggcatgaacatcgcccggctgaacttcagccacggcagccatgagtaccacgccgagagcatcgccaacgtgcgggaggccgtggagagctttgctggcagccccctgagctacagacctgtggccatcgccctggacaccaagggccctgagatcagaacaggcatcctgcagggcggccctgagagcgaggtggagctggtgaagggcagccaggtgctggtgacagtggaccctgccttccgcaccagaggaaatgccaacacagtgtgggtggactaccccaacatcgtgcgggtggtgcctgtgggcggccgcatctacattgatgatggcctcatcagcctggtggtgcagaagattggccctgagggcctggtgacccaggtggagaatggaggagtgctgggcagcaggaaaggagtgaacctgcccggggcccaggtggacctgcccggcctgtctgagcaggatgtgcgggacctgcgctttggagtggagcacggcgtggacatcgtgtttgccagctttgtgaggaaggccagtgatgtggccgctgtgcgggccgccctgggccctgagggccacggcatcaagatcatcagcaagattgagaaccacgagggcgtgaagagatttgatgagatcctggaggtgtctgatggcatcatggtggcccggggggacctgggcatcgagatcccagctgagaaggtgttcctggcccagaagatgatgattggccgctgcaacctggccggcaagcctgtggtgtgtgccacccagatgctggagagcatgatcaccaagccccggcccaccagggctgagaccagtgatgtggccaatgctgtgctggatggagctgactgcatcatgctgagcggggagacagccaagggcaacttccctgtggaggccgtgaagatgcagcacgccatcgcccgggaggccgaggccgctgtgtaccaccggcagctgtttgaggagctgcggcgggccgcccccctgagccgggaccccacagaggtgacagccatcggggctgtggaggccgccttcaagtgctgtgccgccgccatcatcgtgctgaccaccaccggccgcagcgcccagctgctgagccgctaccggcccagggctgctgtgattgctgtgaccaggtctgcccaggccgcccggcaggtgcacctgtgccggggcgtcttccccctgctgtaccgggagcccccagaggccatctgggcagatgatgtggaccggcgggtgcagtttggcatcgagagcggcaagctgcggggcttcctgcgggtgggggacctggtgattgtggtgacaggctggaggcctggcagcggctacaccaacatcatgagggtgctgagcatctcctag

SEQ ID NO: 166782 - DNA, 1596 bp, Artificial Sequence
  Description of Artificial Sequence: Synthetic coding sequence
atgagcaagccccacagcgaggccggcacagccttcatccagacccagcagctgcacgccgccatggctgacaccttcctggagcacatgtgccgcctggacatcgacagcccccccatcacagccaggaacacaggcatcatctgcaccatcggccctgccagccgctctgtggagaccctgaaggagatgatcaagagcggcatgaatgtggcccggctgaacttcagccacggcacccatgagtaccacgccgagaccatcaagaatgtgaggacagccacagagagctttgccagtgaccccatcctgtacagacctgtggccgtggccctggacaccaagggccctgagatcagaacaggcctcatcaagggcagcggcacagctgaggtggagctgaagaagggggccaccctgaagatcaccctggacaatgcctacatggagaagtgtgatgagaacatcctgtggctggactacaagaacatctgcaaggtggtggaggtgggcagcaagatctacgtggatgatggcctcatcagcctgcaggtgaagcagaagggagctgacttcctggtgacagaggtggagaatggaggcagcctgggcagcaagaagggcgtgaacctgcccggggctgctgtggacctgcctgctgtgtctgagaaggacatccaggacctgaagtttggagtggagcaggatgtggacatggtgtttgccagcttcatcaggaaggccagtgatgtgcatgaggtgaggaaggtgctgggggagaagggcaagaacatcaagatcatcagcaagattgagaaccacgagggcgtgagaagatttgatgagatcctggaggccagtgatggcatcatggtggcccggggggacctgggcatcgagatcccagctgagaaggtgttcctggcccagaagatgatgattggccgctgcaacagagctgggaagcctgtgatctgtgccacccagatgctggagagcatgatcaagaagccccggcccaccagggctgagggcagtgatgtggccaatgctgtgctggatggagctgactgcatcatgctgagcggggagacagccaagggggactaccccctggaggccgtgaggatgcagcacctgattgcccgggaggccgaggccgccatgttccacaggaagctgtttgaggagctggtgcgggccagcagccacagcacagacctgatggaggccatggccatgggctctgtggaggccagctacaagtgcctggccgccgccctgattgtgctgacagagagcggccgcagcgcccaccaggtggcccgctaccggccccgggcccccatcatcgctgtgaccaggaacccccagacagcccggcaggcccacctgtaccggggcatcttccctgtgctgtgcaaggaccctgtgcaggaggcctgggccgaggatgtggacctgcgggtgaactttgccatgaatgtgggcaaggcccggggcttcttcaagaagggagatgtggtgattgtgctgaccggctggaggcctggcagcggcttcaccaacaccatgagggtggtgcctgtgccctag

SEQ ID NO: 166783 - DNA, 1101 bp, Artificial Sequence
  Description of Artificial Sequence: Synthetic coding sequence
atgagcaagccccacagcgaggccggcacagccttcatccagacccagcagctgcacgccgccatggctgacaccttcctggagcacatgtgccgcctggacatcgacagcccccccatcaagaagggcgtgaacctgcctggagctgctgtggacctgcctgctgtgtctgagaaggacatccaggacctgaagtttggagtggagcaggatgtggacatggtgtttgccagcttcatcaggaaggccagtgatgtgcatgaggtgaggaaggtgctgggggagaagggcaagaacatcaagatcatcagcaagattgaaaatcatgaaggagtgagaagatttgatgagatcctggaggccagtgatggcatcatggtggcccggggggacctgggcatcgagatcccagctgagaaggtgttcctggcccagaagatgatgattggccgctgcaacagagctgggaagcctgtgatctgtgccacccagatgctggagagcatgatcaagaagccccggcccaccagggctgagggcagtgatgtggccaatgctgtgctggatggagctgactgcatcatgctgtctggagaaacagccaagggggactaccccctggaggccgtgaggatgcagcacctgattgcccgggaggccgaggccgccatgttccacaggaagctgtttgaggagctggtgcgggccagcagccacagcacagacctgatggaggccatggccatgggctctgtggaggccagctacaagtgcctggccgccgccctgattgtgctgacagaaagtggccgcagcgcccaccaggtggcccgctaccggccccgggcccccatcatcgctgtgaccaggaacccccagacagcccggcaggcccacctgtaccggggcatcttccctgtgctgtgcaaggaccctgtgcaggaggcctgggccgaggatgtggacctgcgggtgaactttgccatgaatgtgggcaaggcccggggcttcttcaagaagggagatgtggtgattgtgctgaccggctggaggcctggcagcggcttcaccaacaccatgagggtggtgcctgtgccctag

SEQ ID NO: 166784 - DNA, 1596 bp, Artificial Sequence
  Description of Artificial Sequence: Synthetic coding sequence
atgagcaagccccacagcgaggccggcacagccttcatccagacccagcagctgcacgccgccatggctgacaccttcctggagcacatgtgccgcctggacatcgacagcccccccatcacagccaggaacacaggcatcatctgcaccatcggccctgccagccgctctgtggagaccctgaaggagatgatcaagagcggcatgaatgtggcccggctgaacttcagccacggcacccatgagtaccacgccgagaccatcaagaatgtgaggacagccacagagagctttgccagtgaccccatcctgtacagacctgtggccgtggccctggacaccaagggccctgagatcagaacaggcctcatcaagggcagcggcacagctgaggtggagctgaagaagggggccaccctgaagatcaccctggacaatgcctacatggagaagtgtgatgagaacatcctgtggctggactacaagaacatctgcaaggtggtggaggtgggcagcaagatctacgtggatgatggcctcatcagcctgcaggtgaagcagaagggagctgacttcctggtgacagaggtggagaatggaggcagcctgggcagcaagaagggcgtgaacctgcccggggctgctgtggacctgcctgctgtgtctgagaaggacatccaggacctgaagtttggagtggagcaggatgtggacatggtgtttgccagcttcatcaggaaggccagtgatgtgcatgaggtgaggaaggtgctgggggagaagggcaagaacatcaagatcatcagcaagattgagaaccacgagggcgtgagaagatttgatgagatcctggaggccagtgatggcatcatggtggcccggggggacctgggcatcgagatcccagctgagaaggtgttcctggcccagaagatgatgattggccgctgcaacagagctgggaagcctgtgatctgtgccacccagatgctggagagcatgatcaagaagccccggcccaccagggctgagggcagtgatgtggccaatgctgtgctggatggagctgactgcatcatgctgagcggggagacagccaagggggactaccccctggaggccgtgaggatgcagcacctgattgcccgggaggccgaggccgccatctaccacctgcagctgtttgaggagctgcggcggctggcccccatcaccagtgaccccacagaggccacagctgtgggcgctgtggaggccagcttcaagtgctgcagcggggccatcatcgtgctgaccaagagcggccgcagcgcccaccaggtggcccgctaccggccccgggcccccatcatcgctgtgaccaggaacccccagacagcccggcaggcccacctgtaccggggcatcttccctgtgctgtgcaaggaccctgtgcaggaggcctgggccgaggatgtggacctgcgggtgaactttgccatgaatgtgggcaaggcccggggcttcttcaagaagggagatgtggtgattgtgctgaccggctggaggcctggcagcggcttcaccaacaccatgagggtggtgcctgtgccctag

SEQ ID NO: 166785 - DNA, 1596 bp, Artificial Sequence; identical to SEQ ID NO: 166782
  Description of Artificial Sequence: Synthetic coding sequence

SEQ ID NO: 166786 - DNA, 1377 bp, Artificial Sequence
  Description of Artificial Sequence: Synthetic coding sequence
atgagcaagccccacagcgaggccggcacagccttcatccagacccagcagctgcacgccgccatggctgacaccttcctggagcacatgtgccgcctggacatcgacagcccccccatcacagccaggaacacaggcatcatctgcaccatcggccctgccagccgctctgaggtggagctgaagaagggggccaccctgaagatcaccctggacaatgcctacatggagaagtgtgatgagaacatcctgtggctggactacaagaacatctgcaaggtggtggaggtgggcagcaagatctacgtggatgatggcctcatcagcctgcaggtgaagcagaagggagctgacttcctggtgacagaggtggagaatggaggcagcctgggcagcaagaagggcgtgaacctgcctggagctgctgtggacctgcctgctgtgtctgagaaggacatccaggacctgaagtttggagtggagcaggatgtggacatggtgtttgccagcttcatcaggaaggccagtgatgtgcatgaggtgaggaaggtgctgggggagaagggcaagaacatcaagatcatcagcaagattgaaaatcatgaaggagtgagaagatttgatgagatcctggaggccagtgatggcatcatggtggcccggggggacctgggcatcgagatcccagctgagaaggtgttcctggcccagaagatgatgattggccgctgcaacagagctgggaagcctgtgatctgtgccacccagatgctggagagcatgatcaagaagccccggcccaccagggctgagggcagtgatgtggccaatgctgtgctggatggagctgactgcatcatgctgtctggagaaacagccaagggggactaccccctggaggccgtgaggatgcagcacctgattgcccgggaggccgaggccgccatctaccacctgcagctgtttgaggagctgcggcggctggcccccatcaccagtgaccccacagaggccacagctgtgggcgctgtggaggccagcttcaagtgctgcagcggggccatcatcgtgctgaccaagagcggccgcagcgcccaccaggtggcccgctaccggccccgggcccccatcatcgctgtgaccaggaacccccagacagcccggcaggcccacctgtaccggggcatcttccctgtgctgtgcaaggaccctgtgcaggaggcctgggccgaggatgtggacctgcgggtgaactttgccatgaatgtgggcaaggcccggggcttcttcaagaagggagatgtggtgattgtgctgaccggctggaggcctggcagcggcttcaccaacaccatgagggtggtgcctgtgccctag

SEQ ID NO: 166787 - DNA, 1551 bp, Artificial Sequence
  Description of Artificial Sequence: Synthetic coding sequence
atgagccctgaggcccagccccagaggaccaagggcccccagcagccctgccgcagccccatcgtgaagccaggcctgcccagcttccggcccagcagctgcacccagccctggctgacccacagctggagcacctgtgccgcctggaccctcatccaccaccccagccagcccggcaccctggccagctctgtgcccctgtaccacgccgagaccatcaagaatgtgaggacagccacagagagctttgccagtgaccccatcctgtacagacctgtggccgtggccctggacaccaagggccctgagatcagaacaggcctcatcaagggcagcggcacagctgaggtggagctgaagaagggggccaccctgaagatcaccctggacaatgcctacatggagaagtgtgatgagaacatcctgtggctggactacaagaacatctgcaaggtggtggaggtgggcagcaagatctacgtggatgatggcctcatcagcctgcaggtgaagcagaagggagctgacttcctggtgacagaggtggagaatggaggcagcctgggcagcaagaagggcgtgaacctgcctggagctgctgtggacctgcctgctgtgtctgagaaggacatccaggacctgaagtttggagtggagcaggatgtggacatggtgtttgccagcttcatcaggaaggccagtgatgtgcatgaggtgaggaaggtgctgggggagaagggcaagaacatcaagatcatcagcaagattgaaaatcatgaaggagtgagaagatttgatgagatcctggaggccagtgatggcatcatggtggcccggggggacctgggcatcgagatcccagctgagaaggtgttcctggcccagaagatgatgattggccgctgcaacagagctgggaagcctgtgatctgtgccacccagatgctggagagcatgatcaagaagccccggcccaccagggctgagggcagtgatgtggccaatgctgtgctggatggagctgactgcatcatgctgtctggagaaacagccaagggggactaccccctggaggccgtgaggatgcagcacctgattgcccgggaggccgaggccgccatctaccacctgcagctgtttgaggagctgcggcggctggcccccatcaccagtgaccccacagaggccacagctgtgggcgctgtggaggccagcttcaagtgctgcagcggggccatcatcgtgctgaccaagagcggccgcagcgcccaccaggtggcccgctaccggccccgggcccccatcatcgctgtgaccaggaacccccagacagcccggcaggcccacctgtaccggggcatcttccctgtgctgtgcaaggaccctgtgcaggaggcctgggccgaggatgtggacctgcgggtgaactttgccatgaatgtgggcaaggcccggggcttcttcaagaagggagatgtggtgattgtgctgaccggctggaggcctggcagcggcttcaccaacaccatgagggtggtgcctgtgccctag

SEQ ID NO: 166788 - DNA, 1212 bp, Artificial Sequence
  Description of Artificial Sequence: Synthetic coding sequence
atggccggggccgccacccaggccagcctggagagcgccccccgcatcatgaggctggtggccgagtgcagccgcagccgggcccgggccggggagctgtggctgccccatggaacagtggccacccctgtgttcatgcctgtgggcacccaggccaccatgaagggcatcaccacagagcagctggatgccctgggctgccgcatctgcctgggcaacacctaccacctgggcctgcggcccggccctgagctgatccagaaggccaacggcctgcacggcttcatgaactggccccacaacctgctgacagacagcggcggcttccagatggtgtccctggtgtccctgtctgaggtgacagaggagggcgtgcgcttccgcagcccctatgatggaaatgagaccctgctgagccctgagaagtctgtgcagatccagaatgccctgggcagtgacatcatcatgcagctggatgatgtggtgagcagcacagtgacaggcccccgggtggaggaggccatgtaccgcagcatccgctggctggaccgctgcatcgccgcccaccagaggccagacaagcagaacctgtttgccatcatccagggcggcctggatgctgacctgcgggccacctgcctggaggagatgaccaagagagatgtgcccggctttgccatcggcggcctgtctggaggagagagcaagagccagttctggaggatggtggccctgagcaccagccggctgcccaaggacaagccccgctacctgatgggcgtgggctacgccacagacctggtggtgtgtgtggccctgggctgtgacatgtttgactgtgtgttccccaccaggacagccaggtttggaagtgccctggtgcccaccggcaacctgcagctgaggaagaaggtgtttgagaaggactttggccccattgatcctgagtgcacctgccccacctgccagaagcacagccgggccttcctgcacgccctgctgcacagcgacaacacagctgccctgcaccacctgactgtgcacaacatcgcctaccagctgcagctgatgtctgctgtgaggaccagcatcgtggagaagcgcttcccagactttgtgcgggacttcatgggcgccatgtatggagaccccaccctgtgccccacctgggccacagatgccctggcctctgtgggcatcaccctgggctag

SEQ ID NO: 166789 - DNA, 678 bp, Artificial Sequence
  Description of Artificial Sequence: Synthetic coding sequence
atggccggggccgccacccaggccagcctggagagcgccccccgcatcatgaggctggtggccgagtgcagccgcagccgggcccgggccggggagctgtggctgccccatggaacagtggccacccctgtgttcatgcctgtgggcacccaggccaccatgaagggcatcaccacagagcagctggatgccctgggctgccgcatctgcctgggcaacacctaccacctgggcctgcggcccggccctgagctgatccagaaggccaacggcctgcacggcttcatgaactggccccacaacctgctgacagacagcggcggcttccagatggtgtccctggtgtccctgtctgaggtgacagaggagggcgtgcgcttccgcagcccctatgatggaaatgagaccctgctgagccctgagaagtctgtgcagatccagaatgccctgggcagtgacatcatcatgcagctggatgatgtggtgagcagcacagtgacaggcccccgggtggaggaggccatgtaccggcccctgggcctggtgactggagccctgctgcaggtgaaccccctggccggccctgtgcactgcagccccagcgctgctggccaggccgagcccctgcggcactacccaggctgggccggccgccgcagccctggccacctgccctag

SEQ ID NO: 166790 - DNA, 2097 bp, Artificial Sequence
  Description of Artificial Sequence: Synthetic coding sequence
atggctgctgctggagctgctgtggcccggagccctggcatcggggccggccctgccctgcgggcccggcgcagccccccaccccgggccgcccggctgccccggctgctggtgctgctggccgctgctgctgtgggccctggagctggaggagctgcccggctgtaccgggccggggaggatgctgtgtgggtgctggacagcggctctgtgcggggggccacagccaacagcagcgctgcctggctggtgcagttctacagctcctggtgtggccactgcatcggctacgcccccacctggagggccctggccggagatgtgcgggactgggccagcgccatccgggtggccgccctggactgcatggaggagaagaaccaggccgtgtgccacgactatgacatccacttctaccccaccttccgctacttcaaggccttcaccaaggagttcaccaccggggagaacttcaagggccctgaccgggagctgaggacagtgcggcagaccatgattgacttcctgcagaaccacacagagggcagccggcccccagcctgcccccggctggaccccatccagcccagtgatgtgctgagcctgctggacaacagaggcagccactacgtggccatcgtgtttgagagcaacagcagctacctgggccgggaggtgatcctggacctgatcccctatgagagcatcgtggtgacccgggccctggatggagacaaggccttcctggagaagctgggcgtgtcctctgtgcccagctgctacctgatctaccccaacggcagccacggcctcatcaacgtggtgaagcccctgcgggccttcttcagcagctacctgaagagcctgcctgatgtgaggaagaagagcctgcccctgcctgagaagccccacaaggaggagaacagcgagatcgtggtgtggagggagtttgacaagagcaagctgtacacagtggacctggagagcggcctgcactacctgctgcgggtggagctggccgcccacaagagcctggccggggctgagctgaagaccctgaaggactttgtgacagtgctggccaagctgtttcctggccggccccctgtgaagaagctgctggagatgctgcaggagtggctggccagcctgcccctggaccgcatcccctacaatgctgtgctggacctggtgaacaacaagatgaggatcagcggcatcttcctgaccaaccacatcaagtgggtgggctgccagggcagccgctctgagctgcggggctacccctgcagcctgtggaagctgttccacaccctgactgtggaggccagcacccacccagatgccctggtgggcactggatttgaagatgacccccaggccgtgctgcagaccatgagaagatatgtgcacaccttcttcggctgcaaggaatgtggggagcactttgaggagatggccaaggagagcatggattctgtgaagaccccagaccaggccatcctgtggctgtggaagaagcacaacatggtgaatggccgcctggccggccacctgtctgaggacccccgcttccccaagctgcagtggcccaccccagacctgtgcccagcctgccacgaggagatcaagggcctggcctcctgggatgagggccacgtgctgaccttcctgaagcagcactacggccgggacaacctgctggacacctacagcgctgaccagggcgacagcagcgagggcggcaccctggcccggggggaggaggaggagaagaggctgaccccacctgaggtgtcccatggagaccgggacacccagagcgtgcggcccccaggggccctgggccccaggcctgccctgcctgagagcctgcaccacagcctggatggcaagctgcagagcctggatggccctggggcccacaaggaggtgggcggggccgcccccttcctgggcgtggacttcagcagcctggacatgagcctgtgtgtggtgctgtatgtggccagcagcctcttcctgatggtgatgtacttcttcttccgggtgcgcagccgccgctggaaggtgaagcaccaccaccctgctgtgtag

SEQ ID NO: 166791 - DNA, 948 bp, Artificial Sequence
  Description of Artificial Sequence: Synthetic coding sequence
atggaggagaagaaccaggccgtgtgccacgactatgacatccacttctaccccaccttccgctacttcaaggccttcaccaaggagttcaccaccggggagaacttcaagggccctgaccgggagctgaggacagtgcggcagaccatgattgacttcctgcagaaccacacagagggcagccggcccccagcctgcccccggctggaccccatccacgtgaagcccctgcgggccttcttcagcagctacctgaagagcctgcctgatgtgaggaagaagagcctgcccctgcctgagaagccccacaaggaggagaacagcgagatcgtggtgtggagggagtttgacaagagcaagctgtacacagtggacctggagagcggcctgcactacctgctgcgggtggagctggccgcccacaagagcctggccggggctgagctgaagaccctgaaggactttgtgacagtgctggccaagctgtttcctggccggccccctgtgaagaagctgctggagatgctgcaggagtggctggccagcctgcccctggaccgcatcccctacaatgctgtgctggacctggtgaacaacaagatgaggatcagcggcatcttcctgaccaaccacatcaagtgggtgggctgccagggcagccgctctgagctgcggggctacccctgcagcctgtggaagctgttccacaccctgactgtggaggccagcacccacccagatgccctggtgggcaccggctttgaagatgacccccaggccgtgctgcagaccatgaggcgctacgtgcacaccttcttcggctgcaaggaatgtggggagcactttgaggagatggccaaggagagcatggacagcgtgaagaccccagaccaggccatcctgtggctgtggaagaagcacaacatggtgaatggccgcctggcctag

SEQ ID NO: 166792 - DNA, 735 bp, Artificial Sequence
  Description of Artificial Sequence: Synthetic coding sequence
atggctgctgctgctgctgctggggaggccaggagagtgctggtgtatggaggccgcggggccctgggcagccgctgtgtgcaggccttccgggccaggaactggtgggtggcctctgtggatgtggtggagaatgaggaggccagcgccagcatcatcgtgaagatgacagacagcttcacagagcaggccgaccaggtgacagctgaggtgggcaagctgctgggggaggagaaggtggatgccatcctgtgtgtggccggcggctgggccggcggcaatgccaagagcaagagcctcttcaagaactgtgacctgatgtggaagcagagcatctggaccagcaccatcagcagccacctggccaccaagcacctgaaggagggcggcctgctgaccctggccggggccaaggccgccctggatggcaccccaggcatgattggctacggcatggccaagggagctgtgcaccagctgtgccagagcctggccggcaagaacagcggcatgcctcctggagctgctgccatcgctgtgctgcctgtgaccctggacacccccatgaacaggaagtccatgcctgaggccgacttcagctcctggacccccctggagttcctggtggagaccttccatgactggatcaccgggaagaaccggcccagcagcggcagcctcatccaggtggtgaccacagagggccgcacagagctgaccccagcctacttctag

SEQ ID NO: 166793 - DNA, 681 bp, Artificial Sequence
  Description of Artificial Sequence: Synthetic coding sequence
atggccgcccccctgctgcacacccggctgcctggagatgctgctgccagccccagcgctgtgaagatgctgggcgccagcaggacaggcatcagcaacatgagggccctggagaatgacttcttcaacagcccccccaggaagacagtgcagtttggaggcaccgtgacagaggtgctgctgaagtacaagacaggagagaccaatgactttgagctgctgaagaaccagctgctggaccctgacatcaaggatgaccagatcatcaactggctgctggagttccgcagcagcatcatgtacctgaccaaggactttgagcagctgatcagcatcatcctgcggctgccctggctgaacagaagccagacagtggtggaggagtacctggccttcctgggcaacctggtgtctgcccagacagtgttcctgcggccctgcctgtccatgattgccagccactttgtgccccccagggtcatcatcaaggagggagatgtggatgtgtctgacagtgatgatgaagatgacaacctgcctgccaactttgacaccagccagagcctggccaacaacagcaagatctgcaccatcgacacagtggtgagccacgccaacacaggaggcaagatcagcatctgcagcaagatcagagaaaatacaggcatgctgcggagctag

SEQ ID NO: 166794 - DNA, 894 bp, Artificial Sequence
  Description of Artificial Sequence: Synthetic coding sequence
atggatgctgagggcctggccctgctgctgccccctgtgaccctggccgccctggtggacagctggctgcgggaggactgccccggcctgaactatgctgccctggtgtctggagctggccccagccaggccgccctgtgggccaagagccctggggtgctggccggccagcccttctttgatgccatcttcacccagctgaactgccaggtgtcctggttcctgcctgagggcagcaagctggtgcctgtggcccgggtggccgaggtgcggggccctgcccactgcctgctgctgggggagcgggtggccctgaacaccctggcccgctgcagcggcatcgccagcgctgctgctgctgctgtggaggccgcccggggggccggctggacaggccacgtggccggcaccaggaagaccaccccaggcttccggctggtggagaagtatggcctgctggtgggcggggccgccagccacagatatgacctgggcggcctggtgatggtgaaggacaaccacgtggtggccgccggcggcgtggagaaggctgtgcgggccgcccggcaggccgctgacttcaccctgaaggtggaggtggagtgcagcagcctgcaggaggccgtgcaggccgctgaggccggggctgacctggtgctgctggacaacttcaagccagaggagctgcaccccacagccaccgtgctgaaggcccagttccccagcgtggccgtggaggccagcggcggcatcaccctggacaacctgccccagttctgtggcccccacattgatgtgatctccatgggcatgctgacccaggccgccccagccctggacttcagcctgaagctgtttgccaaggaggtggcccctgtgcccaagatccactag

SEQ ID NO: 166795 - DNA, 498 bp, Artificial Sequence
  Description of Artificial Sequence: Synthetic coding sequence
atggatgctgagggcctggccctgctgctgccccctgtgaccctggccgccctggtggacagctggctgcgggaggactgccccggcctgaactatgctgccctggtgtctggagctggccccagccaggccgccctgtgggccaagagccctggggtgctggccggccagcccttctttgatgccatcttcacccagctgaactgccaggtgtcctggttcctgcctgagggcagcaagctggtgcctgtggcccgggtggccgaggtgcggggccctgcccactgcctgctgctgggggagcgggtggccctgaacaccctggcccgctgcagcggcatcgccagcgctgctgctgctgctgtggaggccgcccggggggccggctggacaggccacgtggccggcaccaggaagaccaccccaggcttccggctggtggagaagtatggcctgctggtgggcggggccgccagccacagatatgacctgggctag

SEQ ID NO: 166796 - DNA, 2154 bp, Artificial Sequence
  Description of Artificial Sequence: Synthetic coding sequence
atggctgtggccgtgaggaccctgcaggagcagctggagaaggccaaggagagcctgaagaatgtggatgagaacatcaggaagctgaccggccgggaccccaatgatgtgcggcccatccaggcccggctgctggccctgagcggccctgggggcggccggggccggggcagcctgctgctgcggcggggcttcagtgacagcggcggcggccccccagccaagcagagggacctggagggcgctgtgtcccggctgggcggggagaggaggacccggcgggagagccggcaggagagtgaccctgaagatgatgatgtgaagaagccagccctgcagagctctgtggtggccaccagcaaggagaggacccggcgggacctgatccaggaccagaacatggatgagaagggcaagcagaggaacagacgcatcttcggcctgctgatgggcaccctgcagaagttcaagcaggagagcacagtggccacagagcggcagaagaggcggcaggagattgagcagaagctggaggtgcaggccgaggaggagaggaagcaggtggagaatgaaagaagagagctgtttgaggagcggcgggccaagcagacagagctgcggctgctggagcagaaggtggagctggcccagctgcaggaggagtggaatgagcacaatgccaagatcatcaagtacatccgcaccaagaccaagccccacctgttctacatccctggccgcatgtgcccagccacccagaagctgattgaggagagccagaggaagatgaatgccctgtttgagggccgccgcatcgagtttgctgagcagatcaacaagatggaggcccggccccggcggcagagcatgaaggagaaggagcaccaggtggtgagaaatgaggagcagaaggccgagcaggaggagggcaaggtggcccagcgggaggaggagctggaggagaccggcaaccagcacaatgatgtggagattgaggaggccggggaggaggaggagaaggagatcgccatcgtgcacagtgatgctgagaaggagcaggaggaggaggagcagaagcaggagatggaggtgaagatggaggaggagacagaggtgcgggagagcgagaagcagcaggacagccagcctgaggaggtgatggatgtgctggagatggtggagaatgtgaagcacgtgattgctgaccaggaggtgatggagaccaacagagtggagagcgtggagcccagtgaaaatgaggccagcaaggagctggagcctgagatggagtttgaaattgaaccagacaaggagtgcaagaccctgagccctgggaaggaaaatgtgtctgccctggacatggagaaggagagcgaggagaaggaggagaaggagagcgagccccagcctgagcctgtggcccagccccagccccagagccagccccagctgcagctgcagagccagagccagcctgtgctgcagagccagccccccagccagcctgaggacctgagcctggccgtgctgcagcccaccccccaggtgacccaggagcagggccacctgctgcctgagaggaaggacttccctgtggagagcgtgaagctgacagaggtgcctgtggagcctgtgctgactgtgcaccctgagagcaagagcaagaccaagaccaggagccgcagccggggccgggccaggaacaagaccagcaagagccgcagccgcagcagcagcagcagcagcagcagcagcagcagcaccagcagcagcagcggcagcagcagcagcagcggcagcagcagcagccgcagcagcagcagcagcagcagcagcaccagcggcagcagcagccgggacagcagcagcagcaccagcagcagcagcgagagccgcagccgcagccggggccggggccacaacagagacaggaagcacagaagatctgtggacaggaagaggcgggacaccagcggcctggagaggagccacaagagcagcaagggcggcagcagccgggacaccaagggcagcaaggacaagaacagcagaagtgacaggaagaggagcatcagcgagagcagccgcagcggcaagaggagcagccgctctgagcgggacaggaagagtgacaggaaggacaagagaagatag

SEQ ID NO: 166797 - DNA, 1704 bp, Artificial Sequence; identical to SEQ ID NO: 149095
  Description of Artificial Sequence: Synthetic coding sequence

SEQ ID NO: 166798 - DNA, 996 bp, Artificial Sequence
  Description of Artificial Sequence: Synthetic coding sequence
atgggcaccccccagaaggatgtgatcatcaagagtgatgccccagacaccctgctgctggagaagcacgccgactacatcgccagctatggcagcaagaaggatgattatgagtactgcatgtctgagtacctgaggatgagcggcatctactggggcctgactgtgatggacctgatgggccagctgcacaggatgaaccgggaggagatcctggccttcatcaagagctgccagcatgaatgtggcggcatcagcgccagcattggacatgacccccacctgctgtacaccctgtctgctgtgcagatcctgaccctgtatgacagcatcaacgtgattgatgtgaacaaggtggtggagtatgtgaagggcctgcagaaggaggatggcagctttgctggggacatctggggcgagattgacacccgcttctccttctgtgctgtggccaccctggccctgctgggcaagctggatgccatcaacgtggagaaggccatcgagtttgtgctgagctgcatgaactttgatggcggcttcggctgcaggcctggcagcgagagccatgctggccagatctactgctgcaccggcttcctggccatcaccagccagctgcaccaggtgaacagcgacctgctgggctggtggctgtgtgagcggcagctgcccagcggcggcctgaatggccggcctgagaagctgcctgatgtgtgctacagctggtgggtgctggccagcctgaagatcatcggccgcctgcactggattgaccgggagaagctgaggaacttcatcctggcctgccaggatgaggagactggaggctttgctgacaggcctggggacatggtggaccccttccacaccctgtttggaattgctggcctgagcctgctgggggaggagcagatcaagcctgtgaaccctgtgttctgcatgcctgaggaggtgctgcagagggtgaatgtgcagcctgagctggtgtcctag

SEQ ID NO: 166799 - DNA, 963 bp, Artificial Sequence
  Description of Artificial Sequence: Synthetic coding sequence
atgggcaccccccagaaggatgtgatcatcaagagtgatgccccagacaccctgctgctggagaagcacgccgactacatcgccagctatggcagcaagaaggatgattatgagtactgcatgtctgagtacctgaggatgagcggcatctactggggcctgactgtgatggacctgatgggccagctgcacaggatgaaccgggaggagatcctggccttcatcaagagctgccagcatgaatgtggcggcatcagcgccagcattggacatgacccccacctgctgtacaccctgtctgctgtgcagatcctgaccctgtatgacagcatcaacgtgattgatgtgaacaaggtggtggagtatgtgaagggcctgcagaaggaggatggcagctttgctggggacatctggggcgagattgacacccgcttctccttctgtgctgtggccaccctggccctgctgggcaagctggatgccatcaacgtggagaaggccatcgagtttgtgctgagctgcatgaactttgatggcggcttcggctgcaggcctggcagcgagagccatgctggccagatctactgctgcaccggcttcctggccatcaccagccagctgcaccaggtgaacagcgacctgctgggctggtggctgtgtgagcggcagctgcccagcggcggcctgaatggccggcctgagaagctgcctgatgtgtgctacagctggtgggtgctggccagcctgaagatcatcggccgcctgcactggattgaccgggagaagctgaggaacttcatcctggcctgccaggatgaggagactggaggctttgctgacaggcctggggacatgcacttcatctaccagaactaccccaagaaggagctgagcagcaacaaggagaccctgacagagagcctgctgccccggctggagaggagcagcaccatcagcgcctag

SEQ ID NO: 166800 - DNA, 459 bp, Artificial Sequence
  Description of Artificial Sequence: Synthetic coding sequence
atgggcaccccccagaaggatgtgatcatcaagagtgatgccccagacaccctgctgctggagaagcacgccgactacatcgccagctatggcagcaagaaggatgattatgagtactgcatgtctgagtacctgaggatgagcggcatctactggggcctgactgtgatggacctgatgggccagctgcacaggatgaaccgggaggagatcctggccttcatcaagagctgccagcatgaatgtggcggcatcagcgccagcattggacatgacccccacctgctgtacaccctgtctgctgtgcagatcctgaccctgtatgacagcatcaacgtgattgatgtgaacaaggtggtggagtatgtgaagggcctgcagaaggaggatggcagctttgctggggacatctggggcaatgtgcgcttcagccccttctaccccaagtaccagtactag

SEQ ID NO: 166801 - DNA, 474 bp, Artificial Sequence
  Description of Artificial Sequence: Synthetic coding sequence
atgaactttgatggcggcttcggctgcaggcctggcagcgagagccatgctggccagatctactgctgcaccggcttcctggccatcaccagccagctgcaccaggtgaacagcgacctgctgggctggtggctgtgtgagcggcagctgcccagcggcggcctgaatggccggcctgagaagctgcctgatgtgtgctacagctggtgggtgctggccagcctgaagatcatcggccgcctgcactggattgaccgggagaagctgaggaacttcatcctggcctgccaggatgaggagactggaggctttgctgacaggcctggggacatggtggaccccttccacaccctgtttggaattgctggcctgagcctgctgggggaggagcagatcaagcctgtgaaccctgtgttctgcatgcctgaggaggtgctgcagagggtgaatgtgcagcctgagctggtgtcctag

SEQ ID NO: 166802 - DNA, 1476 bp, Artificial Sequence; identical to SEQ ID NO: 164759
  Description of Artificial Sequence: Synthetic coding sequence

SEQ ID NO: 166803 - DNA, 1518 bp, Artificial Sequence
  Description of Artificial Sequence: Synthetic coding sequence
atgatggccagcagctaccacgaggtggtgtccaggaagaagatgagcctgaagtcagaaagaagaggcatccacgtggaccagagcgacctgctgtgcaagaagggctgcggctactacggcaacccagcctggcagggcttctgcagcaagtgctggagggaggagtaccacaaggcccggcagaagcagatccaggaggactgggagctggccgagcggctgcagcgggaggaggaggaggcctttgccagcagccagagcagccagggcgcccagagcctgaccttcagcaagtttgaggagaagaagaccaatgagaagaccaggaaggtgaccaccgtgaagaagttcttcagcgccagcagccgggtgggcagcaagaaggagatccaggaggccaaggcccccagccccagcatcaaccggcagaccagcattgaaacagacagagtgtccaaggagttcatcgagttcctgaagaccttccacaagacaggccaggagatctacaagcagaccaagctgttcctggagggcatgcactacaagagggacctgagcattgaggagcagagtgaatgtgcccaggacttctaccacaacgtggccgagaggatgcagacccggggcaaggtgcccccagagcgggtggagaagatcatggaccagatcgagaagtacatcatgacccggctgtacaagtatgtgttctgcccagagaccacagatgatgagaagaaggacctggccatccagaagaggatccgggccctgcgctgggtgaccccccagatgctgtgtgtgcctgtgaatgaagacatccctgaggtgtctgacatggtggtgaaggccatcacagacatcatcgagatggacagcaagagggtgccccgggacaagctggcctgcatcaccaagtgcagcaagcacatcttcaatgccatcaagatcaccaagaatgaaccagccagcgcagatgacttcctgcccaccctcatctacatcgtgctgaagggcaaccccccccggctgcagagcaacatccagtacatcacccgcttctgcaaccccagccggctgatgactggagaagatggctactacttcaccaacctgtgctgtgctgtggccttcatcgagaagctggatgcccagagcctgaacctgagccaggaggactttgaccgctacatgagcggccagaccagccccaggaagcaggaggccgagagctggagcccagatgcctgcctgggcgtgaagcagatgtacaagaacctggacctgctgagccagctgaatgaaaggcaggagcgcatcatgaatgaggccaagaagctggagaaggacctgattgactggacagatggcatcgcccgggaggtgcaggacatcgtggagaagtaccccctggagatcaagccacccaaccagcccctggccgccatcgacagtgaaaatgtggagaatgacaagctgcccccacccctgcagccccaggtgtatgccggctag

SEQ ID NO: 166804 - DNA, 138 bp, Artificial Sequence
  Description of Artificial Sequence: Synthetic coding sequence
atgagcctgaagtcagaaagaagaggcatccacgtggaccagagcgacctgctgtgcaagaagggctgcggctactacggcaacccagcctggcagggcttctgcagcaagtgctggagggaggagtaccacaagtag

SEQ ID NO: 166805 - DNA, 1476 bp, Artificial Sequence; identical to SEQ ID NO: 164759
  Description of Artificial Sequence: Synthetic coding sequence

SEQ ID NO: 166806 - DNA, 372 bp, Artificial Sequence
  Description of Artificial Sequence: Synthetic coding sequence
atggagcctgctgagcagcccagcgagctggtgtctgctgagggcaggaacaggaaggctgtgctgtgccagagatgtggcagccgggtgctgcagcctggaacagccctcttcagccggcggcagctgttcctgcccagcatgaggaagaagccagccctgagtgatggcagcaacccagatggagacctgctgcaggagcactggctggtggaggacatgttcatctttgaaaatgtgggcttcaccaaggatgtgggcaacatcaagttcctggtgtgtgccgactgtgaaattggccccatcggctggcactgcctggatgacaagaacagcttctacgtggccctggagcgggtgtcccatgaatag

SEQ ID NO: 166807 - DNA, 1206 bp, Artificial Sequence
  Description of Artificial Sequence: Synthetic coding sequence
atggagccccggcgggccgcccctggggtgcccggctggggcagccgggaggccgccggcagcgccagcgctgctgagctggtgtaccacctggccggggccctgggcacagagctgcaggacctggcccggcgcttcggccctgaggccgccgccggcctggtgcccctggtggtgcgggccctggagctgctggagcaggccgctgtgggccctgccccagacagcctgcaggtgtctgcccagcctgctgagcaggagctgcggcggctgcgggaggagaatgaaaggctgcggcgggagctgcgggccggcccccaggaggagcgggccctgctgcggcagctgaaggaggtgacagaccggcagagagatgagctgcgggcccacaacagagacctgcggcagaggggccaggagacagaggccctgcaggagcagctgcagaggctgctgctggtgaatgctgagctgcggcacaagctggccgccatgcagacccagctgcgggccgcccaggaccgggagcgggagcggcagcagcccggggaggccgccaccccccaggccaaggagcgggcccggggccaggccggccggcccggccaccagcacggccaggagcctgagtgggccacagctggggccggggcccctggcaacccagaagatcctgctgaggccgcccagcagctgggccggcccagcgaggccggccagtgccgcttcagccgggaggagtttgagcagatcctgcaggagagaaatgagctgaaggccaaggtgttcctgctgaaggaggagctggcctacttccagcgggagctgctgacagaccaccgggtgcccggcctgctgctggaggccatgaaggtggccgtgaggaagcagaggaagaagatcaaggccaagatgctgggcaccccagaggaggccgagagcagtgaagatgaagctggcccctggatcctgctgagtgatgacaagggggaccaccccccacctcctgagagcaagatccagagcttcttcggcctgtggtaccggggcaaggccgagagcagtgaagatgagaccagcagccctgcccccagcaagctgggcggggaggaggaggcccagccccagagccctgccccagaccccccctgcagcgccctgcacgagcacctgtgcctgggcgccagcgctgcccctgaggcctag

SEQ ID NO: 166808 - DNA, 1212 bp, Artificial Sequence
  Description of Artificial Sequence: Synthetic coding sequence
atggaggaggagcggggcagcgccctggccgctgagagcgccctggagaagaatgtggccgagctgactgtgatggatgtgtatgacatcgccagcctggtgggccacgagtttgagagggtcatcgaccagcacggctgtgaggccatcgcccggctgatgcccaaggtggtgcgggtgctggagatcctggaggtgctggtgagccgccaccacgtggcccctgagctggatgagctgcggctggagctggaccggctgcggctggagaggatggacagaattgagaaggagaggaagcaccagaaggagctggagctggtggaggatgtgtggagaggagaggcccaggacctgctgagccagatcgcccagctgcaggaggagaacaagcagctgatgaccaacctgagccacaaggatgtgaacttcagcgaggaggagttccagaagcatgagggcatgtctgagcgggagcggcaggtgatgaagaagctgaaggaggtggtggacaagcagagagatgagatccgggccaaggaccgggagctgggcctgaagaatgaagatgtggaggccctgcagcagcagcagacccggctgatgaagatcaaccacgacctgcggcaccgggtgacagtggtggaggcccagggcaaggccctgattgagcagaaggtggagctggaggccgacctgcagaccaaggagcaggagatgggcagcctgcgggcagagctgggcaagctgcgggagcggctgcagggcgagcacagccagaatggagaggaggagcctgagacagagcctgtgggggaggagagcatcagtgatgctgagaaggtggccatggacctgaaggaccccaaccggccccgcttcaccctgcaggagctgagagatgtgctgcacgagagaaatgagctgaagagcaaggtgttcctgctgcaggaggagctggcctactacaagtctgaggagatggaggaggagaaccgcatcccccagcccccacccatcgcccaccccaggaccagcccccagcctgagagcggcatcaagaggctcttctccttcttcagccgggacaagaagaggctggccaacacccagagaaatgtgcacatccaggagagctttggccagtgggccaacacccacagagatgatggctacacagagcagggccaggaggccctgcagcacctgtag

SEQ ID NO: 166809 - DNA, 636 bp, Artificial Sequence
  Description of Artificial Sequence: Synthetic coding sequence
atggaggagccccctgtgcgggaggaggaggaggaggagggggaggaggatgaggagagagatgaggtgggccctgagggcgccctgggcaagagccccttccagctgacagcagaagatgtgtatgacatctcctacctgctgggccgggagctgatggccctgggcagtgacccccgggtgacccagctgcagttcaaggtggtgcgggtgctggagatgctggaggccctggtgaatgaaggcagcctggccctggaggagctgaagatggagcgggaccacctgaggaaggaggtggagggcctgcggcggcagagccccccagccagcggggaggtgaacctgggccccaacaagatggtggtggacctgacagaccccaaccggccccgcttcaccctgcaggagctgagagatgtgctgcaggagaggaacaagctgaagagccagctgctggtggtgcaggaggagctgcagtgctacaagagcggcctcatccccccccgggagggccctgggggccggcgggagaaggatgctgtggtgaccagcgccaagaatgccggcaggaacaaggaggagaagaccatcatcaagaagctgttcttcttccgcagcggcaagcagacctag

SEQ ID NO: 166810 - DNA, 717 bp, Artificial Sequence
  Description of Artificial Sequence: Synthetic coding sequence
atggccgaggacaagaccaagcccagcgagctggaccagggcaagtatgatgctgatgacaacgtgaagatcatctgcctgggggacagcgctgtgggcaagagcaagctgatggagcgcttcctgatggatggcttccagccccagcagctgagcacctacgccctgaccctgtacaagcacacagccaccgtggatggccgcaccatcctggtggacttctgggacacagctggccaggagcgcttccagagcatgcacgccagctactaccacaaggcccacgcctgcatcatggtgtttgatgtgcagaggaaggtgacctacagaaacctgagcacctggtacacagagctgcgggagttccggcctgagatcccctgcatcgtggtggccaacaagattgatgacatcaacgtgacccagaagagcttcaactttgccaagaagttcagcctgcccctgtactttgtgtctgctgctgatggcaccaacgtggtgaaggtgtggctgacagctgaggtggccagcaagctgttcaatgatgccatccggctggccgtgtcctacaagcagaacagccaggacttcatggatgagatcttccaggagctggagaacttcagcctggagcaggaggaggaggatgtgcctgaccaggagcagagcagcagcattgagacccccagcgaggaggccgccagcccccacagctag

SEQ ID NO: 166811 - DNA, 498 bp, Artificial Sequence
  Description of Artificial Sequence: Synthetic coding sequence
atggccgaggacaagaccaagcccagcgagctggaccagggcaagtatgatgctgatgacaacgtgaagatcatctgcctgggggacagcgctgtgggcaagagcaagctgatggagcgcttcctgatggatggcttccagccccagcagctgagcacctacgccctgaccctgtacaagcacacagccaccgtggatggcaagaccatcctggtggccgacatcaacgtgacccagaagagcttcaactttgccaagaagttcagcctgcccctgtactttgtgtctgctgctgatggcaccaacgtggtgaagctgttcaatgatgccatccggctggccgtgtcctacaagcagaacagccaggacttcatggatgagatcttccaggagctggagaacttcagcctggagcaggaggaggaggatgtgcctgaccaggagcagagcagcagcattgagaccccatctgaggaggtggccagcccccacagctag

SEQ ID NO: 166812 - DNA, 690 bp, Artificial Sequence
  Description of Artificial Sequence: Synthetic coding sequence
atggccgaggacaagaccaagcccagcgagctggaccagggcaagtatgatgctgatgacaacgtgaagatcatctgcctgggggacagcgctgtgggcaagagcaagctgatggagcgcttcctgatggatggcttccagccccagcagctgagcacctacgccctgaccctgtacaagcacacagccaccgtggatggcaagaccatcctggtggacttctgggacacagctggccaggagcgcttccagagcatgcacgccagctactaccacaaggcccacgcctgcatcatggtgtttgacatccagaggaaggtgacctacagaaacctgagcacctggtacacagagctgcgggagttccggcctgagatcccctgcatcgtggtggccaacaagattgatgctgacatcaacgtgacccagaagagcttcaactttgccaagaagttcagcctgcccctgtactttgtgtctgctgctgatggcaccaacgtggtgaagctgttcaatgatgccatccggctggccgtgtcctacaagcagaacagccaggacttcatggatgagatcttccaggagctggagaacttcagcctggagcaggaggaggaggatgtgcctgaccaggagcagagcagcagcattgagaccccatctgaggaggtggccagcccccacagctag

SEQ ID NO: 166813 - DNA, 687 bp, Artificial Sequence
  Description of Artificial Sequence: Synthetic coding sequence
atggccgaggacaagaccaagcccagcgagctggaccagggcaagtatgatgctgatgacaacgtgaagatcatctgcctgggggacagcgctgtgggcaagagcaagctgatggagcgcttcctgatggatggcttccagccccagcagctgagcacctacgccctgaccctgtacaagcacacagccaccgtggatggcaagaccatcctggtggacttctgggacacagctggccaggagcgcttccagagcatgcacgccagctactaccacaaggcccacgcctgcatcatggtgtttgacatccagaggaaggtgacctacagaaacctgagcacctggtacacagagctgcgggagttccggcctgagatcccctgcatcgtggtggccaacaagattgatgacatcaacgtgacccagaagagcttcaactttgccaagaagttcagcctgcccctgtactttgtgtctgctgctgatggcaccaacgtggtgaagctgttcaatgatgccatccggctggccgtgtcctacaagcagaacagccaggacttcatggatgagatcttccaggagctggagaacttcagcctggagcaggaggaggaggatgtgcctgaccaggagcagagcagcagcattgagacccccagcgaggaggtggccagcccccacagctag

SEQ ID NO: 166814 - DNA, 687 bp, Artificial Sequence; identical to SEQ ID NO: 166813
  Description of Artificial Sequence: Synthetic coding sequence

SEQ ID NO: 166815 - DNA, 717 bp, Artificial Sequence
  Description of Artificial Sequence: Synthetic coding sequence
atggccgaggacaagaccaagcccagcgagctggaccagggcaagtatgatgctgatgacaacgtgaagatcatctgcctgggggacagcgctgtgggcaagagcaagctgatggagcgcttcctgatggatggcttccagccccagcagctgagcacctacgccctgaccctgtacaagcacacagccaccgtggatggcaagaccatcctggtggacttctgggacacagctggccaggagcgcttccagagcatgcacgccagctactaccacaaggcccacgcctgcatcatggtgtttgacatccagaggaaggtgacctacagaaacctgagcacctggtacacagagctgcgggagttccggcctgagatcccctgcatcgtggtggccaacaagattgatgacatcaacgtgacccagaagagcttcaactttgccaagaagttcagcctgcccctgtactttgtgtctgctgctgatggcaccaacgtggtgaaggtgtggctgacagctgaggtggccagcaagctgttcaatgatgccatccggctggccgtgtcctacaagcagaacagccaggacttcatggatgagatcttccaggagctggagaacttcagcctggagcaggaggaggaggatgtgcctgaccaggagcagagcagcagcattgagacccccagcgaggaggtggccagcccccacagctag

SEQ ID NO: 166816 - DNA, 345 bp, Artificial Sequence
  Description of Artificial Sequence: Synthetic coding sequence
atggccgaggacaagaccaagcccagcgagctggaccagggcaagtatgatgctgatgacaacgtgaagatcatctgcctgggggacagcgctgtgggcaagagcaagctgatggagcgcttcctgatggatggcttccagccccagcagctgagcacctacgccctgaccctgtacaagcacacagccaccgtggatggcaagaccatcctggtggacttctgggacacagctggccaggagcgcttccagagcatgcacgccagctactaccacaaggcccacgcctgcatcatggtgtttgacatccagaggaaggtgacctacagaaacctgagcacctag

SEQ ID NO: 166817 - DNA, 306 bp, Artificial Sequence
  Description of Artificial Sequence: Synthetic coding sequence
atggccgaggacaagaccaagcccagcgagctggaccagggcaagtatgatgctgatgacaacgtgaagatcatctgcctgggggacagcgctgtgggcaagagcaagctgatggagcgcttcctgatggatggcttccagccccagcagctgagcacctacgccctgaccctgtacaagcacacagccaccgtggatggcaagaccatcctggtggacttctgggacacagctggccaggagcgcttccagagcatgcacgccagctactaccacaaggcccacgcctgcatcatgcagacctag

SEQ ID NO: 166818 - DNA, 690 bp, Artificial Sequence
  Description of Artificial Sequence: Synthetic coding sequence
atggccgaggacaagaccaagcccagcgagctggaccagggcaagtatgatgctgatgacaacgtgaagatcatctgcctgggggacagcgctgtgggcaagagcaagctgatggagcgcttcctgatggatggcttccagccccagcagctgagcacctacgccctgaccctgtacaagcacacagccaccgtggatggccgcaccatcctggtggacttctgggacacagctggccaggagcgcttccagagcatgcacgccagctactaccacaaggcccacgcctgcatcatggtgtttgatgtgcagaggaaggtgacctacagaaacctgagcacctggtacacagagctgcgggagttccggcctgagatcccctgcatcgtggtggccaacaagattgatgctgacatcaacgtgacccagaagagcttcaactttgccaagaagttcagcctgcccctgtactttgtgtctgctgctgatggcaccaacgtggtgaagctgttcaatgatgccatccggctggccgtgtcctacaagcagaacagccaggacttcatggatgagatcttccaggagctggagaacttcagcctggagcaggaggaggaggatgtgcctgaccaggagcagagcagcagcattgagaccccatctgaggaggccgccagcccccacagctag

SEQ ID NO: 166819 - DNA, 690 bp, Artificial Sequence; identical to SEQ ID NO: 166818
  Description of Artificial Sequence: Synthetic coding sequence

SEQ ID NO: 166820 - DNA, 687 bp, Artificial Sequence
  Description of Artificial Sequence: Synthetic coding sequence
atggccgaggacaagaccaagcccagcgagctggaccagggcaagtatgatgctgatgacaacgtgaagatcatctgcctgggggacagcgctgtgggcaagagcaagctgatggagcgcttcctgatggatggcttccagccccagcagctgagcacctacgccctgaccctgtacaagcacacagccaccgtggatggccgcaccatcctggtggacttctgggacacagctggccaggagcgcttccagagcatgcacgccagctactaccacaaggcccacgcctgcatcatggtgtttgatgtgcagaggaaggtgacctacagaaacctgagcacctggtacacagagctgcgggagttccggcctgagatcccctgcatcgtggtggccaacaagattgatgacatcaacgtgacccagaagagcttcaactttgccaagaagttcagcctgcccctgtactttgtgtctgctgctgatggcaccaacgtggtgaagctgttcaatgatgccatccggctggccgtgtcctacaagcagaacagccaggacttcatggatgagatcttccaggagctggagaacttcagcctggagcaggaggaggaggatgtgcctgaccaggagcagagcagcagcattgagacccccagcgaggaggccgccagcccccacagctag

SEQ ID NO: 166821 - DNA, 63 bp, Artificial Sequence
  Description of Artificial Sequence: Synthetic coding sequence
atggccgaggacaagaccaagcccagcgagctggaccagggcaagtatgatgctgatgactag

SEQ ID NO: 166822 - DNA, 687 bp, Artificial Sequence; identical to SEQ ID NO: 166820
  Description of Artificial Sequence: Synthetic coding sequence

SEQ ID NO: 166823 - DNA, 603 bp, Artificial Sequence
  Description of Artificial Sequence: Synthetic coding sequence
atggccaagaagacctatgacctgctcttcaagctgctgctgattggagacagcggcgtgggcaagacctgtgtgctcttccgcttcagtgatgatgccttcaacaccaccttcatcagcaccatcggcatcgacttcaagatcaagacagtggagctgcagggcaagaagatcaagctgcagatctgggacacagctggccaggagcgcttccacaccatcaccaccagctactacagaggagccatgggcatcatgctggtgtatgacatcaccaacgggaagagctttgagaacatcagcaagtggctgagaaatattgatgagcacgccaatgaagatgtggagaggatgctgctgggcaacaagtgtgacatggatgacaagagggtggtgcccaagggcaagggggagcagatcgcccgggagcacggcatccgcttctttgagaccagcgccaaggccaacatcaacatcgagaaggccttcctgaccctggccgaggacatcctgaggaagacccctgtgaaggagcccaacagtgaaaatgtggacatcagcagcggcggcggcgtgacaggctggaagagcaagtgctgctag

SEQ ID NO: 166824 - DNA, 1950 bp, Artificial Sequence
  Description of Artificial Sequence: Synthetic coding sequence
atgagcctgatggtgtctgctggccggggcctgggcgctgtgtggagccccacccacgtgcaggtgacagtgctgcaggcccggggcctgcgggccaagggccctgggggcaccagtgatgcctatgctgtgatccaggtgggcaaggagaagtatgccacctctgtgtctgagaggagcctgggcgcccctgtgtggagggaggaggccacctttgagctgcccagcctgctgagcagcggccctgctgctgctgccaccctgcagctgactgtgctgcaccgggccctgctgggcctggacaagttcctgggccgggcagaggtggacctgcgggacctgcaccgggaccagggccgcaggaagacccagtggtacaagctgaagagcaagccaggcaagaaggacaaggagcggggggagattgaggtggacatccagttcatgaggaacaacatgacagcctccatgtttgacctgtccatgaaggacaagagcaggaacccctttgggaagctgaaggacaagatcaagggcaagaacaaggacagcggcagtgacacagccagcgccatcatccccagcaccaccccatctgtggacagtgatgatgagagcgtggtgaaggacaagaagaagaagagcaagatcaagaccctgctgagcaagagcaacctgcagaagacccccctgagccagagcatgtctgtgctgcccaccagcaagccagagaaggtgctgctgcggcctggggacttccagagccagtgggatgaagatgacaatgaagatgagagcagcagcgccagtgatgtgatgagccacaagaggacagccagcacagacctgaagcagctgaaccaggtgaacttcaccctgcccaagaaggagggcctgtccttcctgggcggcctgcggagcaagaatgatgtgctgagccgcagcaatgtgtgcatcaatggaaatcatgtgtacctggagcagcctgaggccaagggggagatcaaggacagcagccccagcagcagccccagccccaagggcttcaggaagaagcacctgttcagcagcacagagaacctggccgccggctcctggaaggagcctgctgagggcggcggcctgagcagtgaccggcagctgtctgagagcagcaccaaggacagcctgaagtccatgaccctgcccagctacagacctgcccccctggtgtctggggacctgcgggagaacatggccccagccaacagcgaggccaccaaggaggccaaggagagcaagaagccagagagccgccgcagcagcctgctgagcctgatgaccgggaagaaggatgtggccaagggctctgaaggagagaaccccctgactgtgcccggccgggagaaggagggcatgctgatgggcgtgaagccaggagaagatgccagcggccctgctgaggacctggtgagaagaagtgagaaggacacagctgctgtggtgtcccggcagggcagcagcctgaacctgtttgaagatgtgcagatcacagagcctgaggccgagcctgagagcaagtctgagcccaggcctcccatcagcagcccccgggccccccagaccagggctgtgaagccccggctgcaccctgtgaagcccatgaatgccatggccaccaaggtggccaactgcagcctgggcacagccaccatcatcagcgagaacctgaacaatgaggtgatgatgaagaagtacagccccagcgaccctgcctttgcctatgcccagctgacccatgatgagctgatccagctggtgctgaagcagaaggagaccatcagcaagaaggagttccaggtgcgggagctggaggactacatcgacaacctgctggtgcgggtgatggaggagacccccaacatcctgcgcatccccacccaggtgggcaagaaggccggcaagatgtag

SEQ ID NO: 166825 - DNA, 3852 bp, Artificial Sequence
  Description of Artificial Sequence: Synthetic coding sequence
atgagcctgatggtgtctgctggccggggcctgggcgctgtgtggagccccacccacgtgcaggtgacagtgctgcaggcccggggcctgcgggccaagggccctgggggcaccagtgatgcctatgctgtgatccaggtgggcaaggagaagtatgccacctctgtgtctgagaggagcctgggcgcccctgtgtggagggaggaggccacctttgagctgcccagcctgctgagcagcggccctgctgctgctgccaccctgcagctgactgtgctgcaccgggccctgctgggcctggacaagttcctgggccgggcagaggtggacctgcgggacctgcaccgggaccagggccgcaggaagacccagtggtacaagctgaagagcaagccaggcaagaaggacaaggagcggggggagattgaggtggacatccagttcatgaggaacaacatgacagcctccatgtttgacctgtccatgaaggacaagagcaggaacccctttgggaagctgaaggacaagatcaagggcaagaacaaggacagcggcagtgacacagccagcgccatcatccccagcaccaccccatctgtggacagtgatgatgagagcgtggtgaaggacaagaagaagaagagcaagatcaagaccctgctgagcaagagcaacctgcagaagacccccctgagccagagcatgtctgtgctgcccaccagcaagccagagaaggtgctgctgcggcctggggacttccagagccagtgggatgaagatgacaatgaagatgagagcagcagcgccagtgatgtgatgagccacaagaggacagccagcacagacctgaagcagctgaaccaggtgaacttcaccctgcccaagaaggagggcctgtccttcctgggcggcctgcggagcaagaatgatgtgctgagccgcagcaatgtgtgcatcaatggaaatcatgtgtacctggagcagcctgaggccaagggggagatcaaggacagcagccccagcagcagccccagccccaagggcttcaggaagaagcacctgttcagcagcacagagaacctggccgccggctcctggaaggagcctgctgagggcggcggcctgagcagtgaccggcagctgtctgagagcagcaccaaggacagcctgaagtccatgaccctgcccagctacagacctgcccccctggtgtctggggacctgcgggagaacatggccccagccaacagcgaggccaccaaggaggccaaggagagcaagaagccagagagccgccgcagcagcctgctgagcctgatgaccgggaagaaggatgtggccaagggctctgaaggagagaaccccctgactgtgcccggccgggagaaggagggcatgctgatgggcgtgaagccaggagaagatgccagcggccctgctgaggacctggtgagaagaagtgagaaggacacagctgctgtggtgtcccggcagggcagcagcctgaacctgtttgaagatgtgcagatcacagagcctgaggccgagcctgagagcaagtctgagcccaggcctcccatcagcagcccccgggccccccagaccagggctgtgaagccccggctggaggtgtccccagaggcccagcccacagcccggctgcccagccccacagacagccccagcagcctgccccccctgcccagcagcagcggccaggcctctgtgcccagcgagctgggccacggggctgacacccagagcagcgagagccccagcgtcttcagcagcctgagcagccccatcgccgcccccatcagcaccagcacccccatcgagagctggcccctggtggaccggggccaggccaagtctgagggcccccccctgctgcccaaggccgagctgcagacagagagcctgacccctgtgcccaacagcggcagcagcgccctgggcagcctcttcaagcagcccagcttccctgccaacaagggcacagaggacagcctgatgggccgcacccgggagaccggcacagagaagaacaccagcagcctggagctggaggagagcctgcctgagcagcctgagaccggccggcaggaggaggagctgccccgcttcccctgcaagaagcaggactacagccccagcagcggggaggcccaggaggtgccctttgccctgagcctgagcagtgatggagctgtgtcccctgtgggggagctggccgccggcggggaccgggacctggagagccaggccggcagcctggtggagagcaaggccagagatgctgctgaggaggtggccccacccctgcccatgggcgcctctgtgcccagcattgacagcatgatgaggaagctggaggagatgggcctgaacctgaggaaggaccagaagaagaccaagaagagggtgtccttcagcgagcagctgttcacagaggaggccgtggccggggccgccctgctggtggagggccacagcagctgcccccaggagctgaacccagcctggagcgtggccggaaatgccagtgatggagagcccccagagagcccccatgctgaggacagcgagcgggagagcgtgaccaccccaggccctgccacctgtggggccccagccagccctgctgaccacctgctgctgcccagccaggaggagagcttcagcgaggtgcccatgtctgaggccagcagcgccaaggacacccccctcttcaggatggagggggaggatgccctggtgacccagtaccagagcaaggccagtgaccacgagggcctgctgagtgaccccctgagtgacctgcagctggtgtctgacttcaagagccccatcatggctgacctgaacctgagcctgcccagcatccctgaggtggccagtgatgatgaaagaattgaccaggtggaggatgatggagaccaggtggaggatgatggagaaacagccaagagcagcaccctggacatcggggccctgagcctgggcctggtggtgccctgcccagagcggggcaagggccccagcggggaggccgaccggctggtgctgggggagggcctgtgtgacttccggctgcaggccccccaggcctctgtgacagcccccagcgagcagaccacagaatttggcatccacaagccccacctgggcaagagcagcagcctggacaagcagctgcccggccccagcggcggggaggaggagaagcccatgggaaatggcagccccagccccccacctggcaccagcctggacaaccctgtgcccagccccagccccagcgagatcttccctgtgacccacagcttccccagcagcgcccacagcgacacccaccacaccagcacagctgagagccagaagaaggccacagctgagggcagcgctggccgggtggagaactttgggaagaggaagcccctgctgcaggcctgggtgagccccagcgagacccaccctgtgtctgcccagcctggagctggcactggaagtgccaagcaccggctgcaccctgtgaagcccatgaatgccatggccaccaaggtggccaactgcagcctgggcacagccaccatcatcagcgagaacctgaacaatgaggtgatgatgaagaagtacagccccagcgaccctgcctttgcctatgcccagctgacccatgatgagctgatccagctggtgctgaagcagaaggagaccatcagcaagaaggagttccaggtgcgggagctggaggactacatcgacaacctgctggtgcgggtgatggaggagacccccaacatcctgcgcatccccacccaggtgggcaagaaggccggcaagatgtag

SEQ ID NO: 166826 - DNA, 429 bp, Artificial Sequence
  Description of Artificial Sequence: Synthetic coding sequence
atgagcctgatggtgtctgctggccggggcctgggcgctgtgtggagccccacccacgtgcaggtgacagtgctgcaggcccggggcctgcgggccaagggccctgggggcaccagtgatgcctatgctgtgatccaggtgggcaaggagaagtatgccacctctgtgtctgagaggagcctgggcgcccctgtgtggagggaggaggccacctttgagctgcccagcctgctgagcagcggccctgctgctgctgccaccctgcagctgactgtgctgcaccgggccctgctgggcctggacaagttcctgggccgggcagaggtggacctgcgggacctgcaccgggacctgggcaagagcttcttcaagaccctgaagaagagggcctgggccatcttcctgcggctgtgcctgaagaagaactag

SEQ ID NO: 166827 - DNA, 1320 bp, Artificial Sequence
  Description of Artificial Sequence: Synthetic coding sequence
atgaggaacaacatgacagcctccatgtttgacctgtccatgaaggacaagagcaggaacccctttgggaagctgaaggacaagatcaagggcaagaacaaggacagcggcagtgacacagccagcgccatcatccccagcaccaccccatctgtggacagtgatgatgagagcgtggtgaaggacaagaagaagaagagcaagatcaagaccctgctgagcaagagcaacctgcagaagacccccctgagccagagcatgtctgtgctgcccaccagcaagccagagaaggtgctgctgcggcctggggacttccagagccagtgggatgaagatgacaatgaagatgagagcagcagcgccagtgatgtgatgagccacaagaggacagccagcacagacctgaagcagctgaaccaggtgaacttcaccctgcccaagaaggagggcctgtccttcctgggcggcctgcggagcaagaatgatgtgctgagccgcagcaatgtgtgcatcaatggaaatcatgtgtacctggagcagcctgaggccaagggggagatcaaggacagcagccccagcagcagccccagccccaagggcttcaggaagaagcacctgttcagcagcacagagaacctggccgccggctcctggaaggagcctgctgagggcggcggcctgagcagtgaccggcagctgtctgagagcagcaccaaggacagcctgaagtccatgaccctgcccagctacagacctgcccccctggtgtctggggacctgcgggagaacatggccccagccaacagcgaggccaccaaggaggccaaggagagcaagaagccagagagccgccgcagcagcctgctgagcctgatgaccgggaagaaggatgtggccaagggctctgaaggagagaaccccctgactgtgcccggccgggagaaggagggcatgctgatgggcgtgaagccaggagaagatgccagcggccctgctgaggacctggtgagaagaagtgagaaggacacagctgctgtggtgtcccggcagggcagcagcctgaacctgtttgaagatgtgcagatcacagagcctgaggccgagcctgagagcaagtctgagcccaggcctcccatcagcagcccccgggccccccagaccagggctgtgaagccccggctgcaccctgtgaagcccatgaatgccatggccaccaaggtggccaactgcagcctgggcacagccaccatcatcagcgagaacctgaacaatgaggtgatgatgaaggtgtgccccctgcgctcctggtgtgtgaggtag

SEQ ID NO: 166828 - DNA, 1539 bp, Artificial Sequence
  Description of Artificial Sequence: Synthetic coding sequence
atgatgctgtctgagcaggcccagaagtggttccccacccacgtgcaggtgacagtgctgcaggccaaggacctgaagcccaagggcaagagcggcaccaatgacacctacaccatcatccagctgggcaaggagaagtacagcacctctgtggccgagaagaccctggagcctgtgtggaaggaggaggccagctttgagctgcccggcctgctgatccagggcagccctgagaagtacatcctcttcctgattgtgatgcacaggagcctggtgggcctggacaagttcctgggccaggtggccatcaacctgaatgacatctttgaggacaagcagaggaggaagacagagtggttccggctggagagcaagcagggcaagaggatcaagaacagaggagagatcaaggtgaacatccagttcatgaggaacaacatgacagcctccatgtttgacctgtccatgaaggacaagaccaggagcccctttgccaagctgaaggacaagatgaagggcaggaagaatgatggcaccttcagtgacaccagcagcgccatcatccccagcacccacatgccagatgccaacagcgagttcagcagcggggagatccagatgaagagcaagcccaagaagcccttcctgctgggcccccagaggctgagcagcgcccacagcatgtctgacctgagcggcagccacatgagcagcgagaagctgaaggccggcaccatcggccagacccacctgctgggccaccagctggacagctttggaacagtgcctgagagcggcagcctgaagagcccccacaggaggaccctgagctttgacaccagcaagatgaaccagcctgacagcatcgtggatgaaggagagctgtgcttcggccggcagaatgaccccttcaccaacgtgacagccagcctgccccagaagtttgccaccctgcccaggaagaagaacccctttgaggagagcagcgagacctgggacagctccatgaacctcttcagcaagcccatcgagatcaggaaggagaacaagcgggagaagcgggagaaggtgtccctgtttgagcgggtgacaggcaagaaggacagccgccgcagtgacaagctgaacaatggaggcagtgacagcccctgtgacctgaagagccccaatgccttcagcgagaaccggcaggactactttgattatgagagcaccaaccccttcaccgccaagttccgggccagcaacatcatgcccagcagcagcttccacatgagccccaccagcaatgaagacctgaggaagatcccagacagcaacccctttgatgccacagctggctaccgcagcctgacctatgaggaggtgctgcaggagctggtgaagcacaaggagctgctgcggaggaaggacacccacatccgggagctggaggactacatcgacaacctgctggtgcgggtgatggaggagacccccagcatcctgcgggtgccctatgagcccagcaggaaggccggcaagttcagcaacagctag

SEQ ID NO: 166829 - DNA, 1599 bp, Artificial Sequence
  Description of Artificial Sequence: Synthetic coding sequence
atgatgctgtctgagcaggcccagaagtggttccccacccacgtgcaggtgacagtgctgcaggccaaggacctgaagcccaagggcaagagcggcaccaatgacacctacaccatcatccagctgggcaaggagaagtacagcacctctgtggccgagaagaccctggagcctgtgtggaaggaggaggccagctttgagctgcccggcctgctgatccagggcagccctgagaagtacatcctcttcctgattgtgatgcacaggagcctggtgggcctggacaagttcctgggccaggtggccatcaacctgaatgacatctttgaggacaagcagaggaggaagacagagtggttccggctggagagcaagcagggcaagaggatcaagaacagaggagagatcaaggtgaacatccagttcatgaggaacaacatgacagcctccatgtttgacctgtccatgaaggacaagaccaggagcccctttgccaagctgaaggacaagatgaagggcaggaagaatgatggcaccttcagtgacaccagcagcgccatcatccccagcacccacatgccagatgccaacagcgagttcagcagcggggagatccagatgaagagcaagcccaagaagcccttcctgctgggcccccagaggctgagcagcgcccacagcatgtctgacctgagcggcagccacatgagcagcgagaagctgaaggccggcaccatcggccagacccacctgctgggccaccagctggacagctttggaacagtgcctgagagcggcagcctgaagagcccccacaggaggaccctgagctttgacaccagcaagatgaaccagcctgacagcatcgtggatgaaggagagctgtgcttcggccggcagaatgaccccttcaccaacgtgacagccagcctgccccagaagtttgccaccctgcccaggaagaagaacccctttgaggagagcagcgagacctgggacagctccatgaacctcttcagcaagcccatcgagatcaggaaggagaacaagcgggagaagcgggagaaggtgtccctgtttgagcgggtgacaggcaagaaggacagccgccgcagtgacaagctgaacaatggaggcagtgacagcccctgtgacctgaagagccccaatgccttcagcgagaaccggcaggactactttgattatgagagcaccaaccccttcaccgccaagttccgggccagcaacatcatgcccagcagcaggaacaccctgctgaccccagctgtggccgagtggaggggcagcctgcgctgggccgagctgttccacatgagccccaccagcaatgaagacctgaggaagatcccagacagcaacccctttgatgccacagctggctaccgcagcctgacctatgaggaggtgctgcaggagctggtgaagcacaaggagctgctgcggaggaaggacacccacatccgggagctggaggactacatcgacaacctgctggtgcgggtgatggaggagacccccagcatcctgcgggtgccctatgagcccagcaggaaggccggcaagttcagcaacagctag

SEQ ID NO: 166830 - DNA, 2271 bp, Artificial Sequence
  Description of Artificial Sequence: Synthetic coding sequence
atggccagcgcccccccagccagccccccaggcagcgagcccccaggccctgaccctgagcccggcggcccagatggccctggagctgcccagctggcccctggccctgctgagctgcggctgggcgcccctgtgggcggccctgacccccagagccctggcctggatgagcccgcccctggagctgctgctgatggaggagcccgctggagcgctggccctgcccctggcctggagggcggcccccgggaccccggccccagcgcccccccacccaggagcggcccccggggccagctggccagcccagatgcccctggccctggccccaggtctgaggcccccctgcctgagctggaccccctcttctcctggacagaggagccagaagaatgtggccctgccagctgcccagagagcgcccccttccggctgcagggcagcagcagcagccaccgggcccggggggaggtggatgtgttcagccccttccctgcccccacagctggggagctggccctggagcagggccctggcagccccccccagcccagcgacctgagccagacccaccccctgcccagcgagcctgtgggcagccaggaggatggcccccggctgcgggctgtgtttgatgccctggatggagatggagatggctttgtgagaattgaggacttcatccagtttgccaccgtgtatggagctgagcaggtgaaggacctgaccaagtacctggaccccagcggcctgggcgtcatcagctttgaggacttctaccagggcatcacagccatcagaaatggagaccctgatggccagtgctacggcggcgtggccagcgcccaggatgaggagcccctggcctgcccagatgaatttgatgactttgtgacctatgaggccaatgaggtgacagacagcgcctacatgggcagcgagagcacctacagtgaatgtgagaccttcacagatgaggacaccagcaccctggtgcaccctgagctgcagccagaaggagatgctgacagcgctgggggcagcgctgtgcccagtgaatgtctggatgccatggaggagccagaccatggagccctgctgctgctgcccggccggccccacccccacggccagagcgtcatcaccgtcatcggcggggaggagcactttgaagattatggagagggcagcgaggccgagctgagccctgagaccctgtgcaatggccagctgggctgcagcgaccctgccttcctgacccccagccccaccaagaggctgagcagcaagaaggtggcccgctacctgcaccagagcggggccctgaccatggaggccctggaggaccccagccctgagctgatggagggccctgaggaggacattgctgacaaggtggtgttcctggagaggagagtgctggagctggagaaggacacagctgccactggagagcagcacagccggctgcggcaggagaacctgcagctggtgcaccgggccaatgccctggaggagcagctgaaggagcaggagctgcgggcctgtgagatggtgctggaggagacccggcggcagaaggagctgctgtgcaagatggagcgggagaagagcattgaaattgagaacctgcagacccggctgcagcagctggatgaggagaacagcgagctgcggagctgcaccccctgcctgaaggccaacatcgagcggctggaggaggagaagcagaagctgctggatgaaattgagagcctgaccctgcggctgtctgaggagcaggagaacaagaggaggatgggagaccggctgagccatgagcggcaccagttccagagggacaaggaggccacccaggagctgattgaggacctgaggaagcagctggagcacctgcagctgctgaagctggaggccgagcagaggcggggccgcagcagctccatgggcctgcaggagtaccacagccgggcccgggagagcgagctggagcaggaggtgcggcggctgaagcaggacaacagaaacctgaaggagcagaatgaggagctgaatggccagatcatcaccctgagcatccagggcgccaagagcctcttcagcacagccttcagcgagagcctggccgctgagatcagctctgtgtccagagatgagctgatggaggccatccagaagcaggaggagatcaacttccggctgcaggactacatcgaccgcatcatcgtggccatcatggagaccaaccccagcatcctggaggtgaagtag

SEQ ID NO: 166831 - DNA, 1383 bp, Artificial Sequence
  Description of Artificial Sequence: Synthetic coding sequence
atgagcctgctgcgggccaatgaggtgacagacagcgcctacatgggcagcgagagcacctacagtgaatgtgagaccttcacagatgaggacaccagcaccctggtgcaccctgagctgcagccagaaggagatgctgacagcgctgggggcagcgctgtgcccagtgaatgtctggatgccatggaggagccagaccatggagccctgctgctgctgcccggccggccccacccccacggccagagcgtcatcaccgtcatcggcggggaggagcactttgaagattatggagagggcagcgaggccgagctgagccctgagaccctgtgcaatggccagctgggctgcagcgaccctgccttcctgacccccagccccaccaagaggctgagcagcaagaaggtggcccgctacctgcaccagagcggggccctgaccatggaggccctggaggaccccagccctgagctgatggagggccctgaggaggacattgctgacaaggtggtgttcctggagaggagagtgctggagctggagaaggacacagctgccactggagagcagcacagccggctgcggcaggagaacctgcagctggtgcaccgggccaatgccctggaggagcagctgaaggagcaggagctgcgggcctgtgagatggtgctggaggagacccggcggcagaaggagctgctgtgcaagatggagcgggagaagagcattgaaattgagaacctgcagacccggctgcagcagctggatgaggagaacagcgagctgcggagctgcaccccctgcctgaaggccaacatcgagcggctggaggaggagaagcagaagctgctggatgaaattgagagcctgaccctgcggctgtctgaggagcaggagaacaagaggaggatgggagaccggctgagccatgagcggcaccagttccagagggacaaggaggccacccaggagctgattgaggacctgaggaagcagctggagcacctgcagctgctgaagctggaggccgagcagaggcggggccgcagcagctccatgggcctgcaggagtaccacagccgggcccgggagagcgagctggagcaggaggtgcggcggctgaagcaggacaacagaaacctgaaggagcagaatgaggagctgaatggccagatcatcaccctgagcatccagggcgccaagagcctcttcagcacagccttcagcgagagcctggccgctgagatcagctctgtgtccagagatgagctgatggaggccatccagaagcaggaggagatcaacttccggctgcaggactacatcgaccgcatcatcgtggccatcatggagaccaaccccagcatcctggaggtgaagtag

SEQ ID NO: 166832 - DNA, 1383 bp, Artificial Sequence
  Description of Artificial Sequence: Synthetic coding sequence
atgcccttcctgaaggccaatgaggtgacagacagcgcctacatgggcagcgagagcacctacagtgaatgtgagaccttcacagatgaggacaccagcaccctggtgcaccctgagctgcagccagaaggagatgctgacagcgctgggggcagcgctgtgcccagtgaatgtctggatgccatggaggagccagaccatggagccctgctgctgctgcccggccggccccacccccacggccagagcgtcatcaccgtcatcggcggggaggagcactttgaagattatggagagggcagcgaggccgagctgagccctgagaccctgtgcaatggccagctgggctgcagcgaccctgccttcctgacccccagccccaccaagaggctgagcagcaagaaggtggcccgctacctgcaccagagcggggccctgaccatggaggccctggaggaccccagccctgagctgatggagggccctgaggaggacattgctgacaaggtggtgttcctggagaggagagtgctggagctggagaaggacacagctgccactggagagcagcacagccggctgcggcaggagaacctgcagctggtgcaccgggccaatgccctggaggagcagctgaaggagcaggagctgcgggcctgtgagatggtgctggaggagacccggcggcagaaggagctgctgtgcaagatggagcgggagaagagcattgaaattgagaacctgcagacccggctgcagcagctggatgaggagaacagcgagctgcggagctgcaccccctgcctgaaggccaacatcgagcggctggaggaggagaagcagaagctgctggatgaaattgagagcctgaccctgcggctgtctgaggagcaggagaacaagaggaggatgggagaccggctgagccatgagcggcaccagttccagagggacaaggaggccacccaggagctgattgaggacctgaggaagcagctggagcacctgcagctgctgaagctggaggccgagcagaggcggggccgcagcagctccatgggcctgcaggagtaccacagccgggcccgggagagcgagctggagcaggaggtgcggcggctgaagcaggacaacagaaacctgaaggagcagaatgaggagctgaatggccagatcatcaccctgagcatccagggcgccaagagcctcttcagcacagccttcagcgagagcctggccgctgagatcagctctgtgtccagagatgagctgatggaggccatccagaagcaggaggagatcaacttccggctgcaggactacatcgaccgcatcatcgtggccatcatggagaccaaccccagcatcctggaggtgaagtag

SEQ ID NO: 166833 - DNA, 549 bp, Artificial Sequence
  Description of Artificial Sequence: Synthetic coding sequence
atgggcagcgagagcacctacagtgaatgtgagaccttcacagatgaggacaccagcaccctggtgcaccctgagctgcagccagaaggagatgctgacagcgctgggggcagcgctgtgcccagtgaatgtctggatgccatggaggagccagaccatggagccctgctgctgctgcccggccggccccacccccacggccagagcgtcatcaccgtcatcggcggggaggagcactttgaagattatggagagggcagcgaggccgagctgagccctgagaccctgtgcaatggccagctgggctgcagcgaccctgccttcctgacccccagccccaccaagaggctgagcagcaagaaggtggcccgctacctgcaccagagcggggccctgaccatggaggccctggaggaccccagccctgagctgatggagggccctgaggaggacattgctgacaaggtggtgttcctggagaggagagtgctggagctggagaaggacacagctgccactggagagcagcacagccggctgcggcagtag

SEQ ID NO: 166834 - DNA, 2406 bp, Artificial Sequence
  Description of Artificial Sequence: Synthetic coding sequence
atggccagcgcccccccagccagccccccaggcagcgagcccccaggccctgaccctgagcccggcggcccagatggccctggagctgcccagctggcccctggccctgctgagctgcggctgggcgcccctgtgggcggccctgacccccagagccctggcctggatgagcccgcccctggagctgctgctgatggaggagcccgctggagcgctggccctgcccctggcctggagggcggcccccgggaccccggccccagcgcccccccacccaggagcggcccccggggccagctggccagcccagatgcccctggccctggccccaggtctgaggcccccctgcctgagctggaccccctcttctcctggacagaggagccagaagaatgtggccctgccagctgcccagagagcgcccccttccggctgcagggcagcagcagcagccaccgggcccggggggaggtggatgtgttcagccccttccctgcccccacagctggggagctggccctggagcagggccctggcagccccccccagcccagcgacctgagccagacccaccccctgcccagcgagcctgtgggcagccaggaggatggcccccggctgcgggctgtgtttgatgccctggatggagatggagatggctttgtgagaattgaggacttcatccagtttgccaccgtgtatggagctgagcaggtgaaggacctgaccaagtacctggaccccagcggcctgggcgtcatcagctttgaggacttctaccagggcatcacagccatcagaaatggagaccctgatggccagtgctacggcggcgtggccagcgcccaggatgaggagcccctggcctgcccagatgaatttgatgactttgtgacctatgaggccaatgaggtgacagacagcgcctacatgggcagcgagagcacctacagtgaatgtgagaccttcacagatgaggacaccagcaccctggtgcaccctgagctgcagccagaaggagatgctgacagcgctgggggcagcgctgtgcccagtgaatgtctggatgccatggaggagccagaccatggagccctgctgctgctgcccggccggccccacccccacggccagagcgtcatcaccgtcatcggcggggaggagcactttgaagattatggagagggcagcgaggccgagctgagccctgagaccctgtgcaatggccagctgggctgcagcgaccctgccttcctgacccccagcacagaccccctggccgccaagctgcacagcatcctgacagatgaggcctttgagttctactgcagccagtgccacaagcagatcaaccggctggaggacctgagcgcccggctgagtgacctggagatgaacagccccaccaagaggctgagcagcaagaaggtggcccgctacctgcaccagagcggggccctgaccatggaggccctggaggaccccagccctgagctgatggagggcccagaagaagatattgctgacaaggtggtgttcctggagcggcgggtgctggagctggagaaggacacagctgccaccggggagcagcacagccggctgcggcaggagaacctgcagctggtgcaccgggccaatgccctggaggagcagctgaaggagcaggagctgcgggcctgtgagatggtgctggaggagacccggcggcagaaggagctgctgtgcaagatggagcgggagaagagcattgaaattgagaacctgcagacccggctgcagcagctggatgaagaaaattctgagctgcggagctgcaccccctgcctgaaggccaacatcgagcggctggaggaggagaagcagaagctgctggatgaaattgagagcctgaccctgcggctgtctgaggagcaggagaacaagaggaggatgggagaccggctgagccatgagcggcaccagttccagagggacaaggaggccacccaggagctgattgaggacctgaggaagcagctggagcacctgcagctgctgaagctggaggccgagcagaggcggggccgcagcagctccatgggcctgcaggagtaccacagccgggcccgggagagcgagctggagcaggaggtgcggcggctgaagcaggacaacagaaacctgaaggagcagaatgaggagctgaatggccagatcatcaccctgagcatccagggcgccaagagcctcttcagcacagccttcagcgagagcctggccgctgagatcagctctgtgtccagagatgagctgatggaggccatccagaagcaggaggagatcaacttccggctgcaggactacatcgaccgcatcatcgtggccatcatggagaccaaccccagcatcctggaggtgaagtag

SEQ ID NO: 166835 - DNA, 1914 bp, Artificial Sequence
  Description of Artificial Sequence: Synthetic coding sequence
atggccggcggggccggctggagcggggccccagctgccctgctgcggtctgtgcggcggctgcgggaggtgtttgaggtgtgtggccgggaccctgatggcttcctgcgggtggagcgggtggccgccctgggcctgcgcttcggccagggcgaggaggtggagaagctggtgaagtacctggaccccaatgacctgggccgcatcaacttcaaggacttctgccggggcgtgtttgccatgaagggctgtgaggagctgctgaaggatgtgctgtctgtggagagcgctggcaccctgccctgtgcccctgagatcccagactgtgtggagcagggcagcgaggtgacaggccccacctttgctgatggagagctgatcccccgggagcccggcttcttcccagaagatgaggaggaggccatgaccctggcccctcctgagggcccccaggagctgtacacagacagccccatggagagcacccagagcctggagggctctgtgggcagccctgctgagaaggatggcggcctgggcggcctcttcctgcctgaggacaagagcctggtgcacacccccagcatgaccaccagtgacctgagcacccacagcaccaccagcctcatcagcaatgaggagcagtttgaagattatggagaaggagatgatgtggactgtgcccccagcagcccctgcccagatgatgagaccaggaccaacgtgtacagcgacctgggcagctctgtgagcagcagcgctggccagacccccaggaagatgagacatgtgtacaacagcgagctgctggatgtgtactgcagccagtgctgcaagaagatcaacctgctgaatgacctggaggcccggctgaagaacctgaaggccaacagccccaacaggaagatcagcagcacagccttcggccggcagctgatgcacagcagcaacttcagcagcagcaatggcagcacagaggacctcttccgggacagcattgacagctgtgacaatgacatcacagagaaggtgtccttcctggagaagaaggtgacagagctggagaatgacagcctgaccaatggagacctgaagagcaagctgaagcaggagaacacccagctggtgcaccgggtgcatgagctggaggagatggtgaaggaccaggagaccacagctgagcaggccctggaggaggaggcccggcggcaccgggaggcctacggcaagctggagcgggagaaggccacagaggtggagctgctgaatgcccgggtgcagcagctggaggaggagaacacagagctgcggaccaccgtgacccggctgaagagccagacagagaagctggatgaggagcggcagaggatgtctgaccggctggaggacaccagcctgcggctgaaggatgagatggacctgtacaagaggatgatggacaagctgcggcagaaccggctggagttccagaaggagcgggaggccacccaggagctgattgaggacctgaggaaggagctggagcacctgcagatgtacaagctggactgtgagcggcccggccggggccgcagcgccagcagcggcctgggggagttcaatgcccgggcccgggaggtggagctggagcacgaggtgaagaggctgaagcaggagaactacaagctgcgggaccagaatgatgacctgaatggccagatcctgagcctgagcctgtatgaggccaagaacctgtttgctgcccagaccaaggcccagagcctggccgctgagattgacacagccagcagagatgagctgatggaggccctgaaggagcaggaggagatcaacttccggctgcggcagtacatggacaagatcatcctggccatcctggaccacaaccccagcatcctggagatcaagcactag

SEQ ID NO: 166836 - DNA, 1914 bp, Artificial Sequence; identical to SEQ ID NO: 166835
  Description of Artificial Sequence: Synthetic coding sequence

SEQ ID NO: 166837 - DNA, 651 bp, Artificial Sequence
  Description of Artificial Sequence: Synthetic coding sequence
atgggcaccagagatgatgaatatgactacctgttcaaggtggtgctgattggagacagcggcgtgggcaagagcaacctgctgagccgcttcaccagaaatgagttcaacctggagagcaagagcaccatcggcgtggagtttgccaccaggagcatccaggtggatggcaagaccatcaaggcccagatctgggacacagctggccaggagcgctaccgggccatcaccagcgcctactacagaggagctgtgggcgccctgctggtgtatgacatcgccaagcacctgacctatgaaaatgtggagcgctggctgaaggagctgcgggaccatgctgacagcaacatcgtcatcatgctggtgggcaacaagagtgacctgcggcacctgcgggctgtgcccacagatgaggcccgggcctttgctgagaagaatggcctgtccttcatcgagaccagcgccctggacagcaccaacgtggaggccgccttccagaccatcctgacagagatctacagaattgtgtcccagaagcagatgtctgaccggcgggagaatgacatgagccccagcaacaacgtggtgcccatccacgtgccccccaccacagagaacaagcccaaggtgcagtgctgccagaacatctag

SEQ ID NO: 166838 - DNA, 468 bp, Artificial Sequence
  Description of Artificial Sequence: Synthetic coding sequence
atgggcaccagagatgatgaatatgactacctgttcaaggtggtgctgattggagacagcggcgtgggcaagagcaacctgctgagccgcttcaccagaaatgagttcaacctggagagcaagagcaccatcggcgtggagtttgccaccaggagcatccaggtggatggcaagaccatcaaggcccagatctgggacacagctggccaggagcgctaccgggccatcaccagcgcctactacagaggagctgtgggcgccctgctggtgtatgacatcgccaagcacctgacctatgaaaatgtggagcgctggctgaaggagctgcgggaccatgctgacagcaacatcgtcatcatgctggtgggcaacaagagtgacctgcggcacctgcgggctgtgcccacagatgaggcccgggcctttgctggctacaacaaggccaacgtgcggcagaccaggaagtag

SEQ ID NO: 166839 - DNA, 612 bp, Artificial Sequence
  Description of Artificial Sequence: Synthetic coding sequence
atggccaaggcctatgaccacctgttcaagctgctgctgattggagacagcggcgtgggcaagacctgcctgatcatccgctttgctgaggacaacttcaacaacacctacatcagcaccatcggcatcgacttcaagatcagaacagtggacatcgagggcaagaagatcaagctgcaggtgtgggacacagctggccaggagcgcttcaagaccatcaccacagcctactacagaggagccatgggcatcatcctggtgtatgacatcacagatgagaagagctttgagaacatccagaactggatgaagagcatcaaggaaaatgccagcgctggggtggagcggctgctgctgggcaacaagtgtgacatggaggccaagaggaaggtgcagaaggagcaggccgacaagctggcccgggagcacggcatccgcttctttgagaccagcgccaagagctccatgaatgtggatgaggccttcagcagcctggcccgggacatcctgctgaagagcggcggccgccgctctggaaatggaaacaagccacccagcacagacctgaagacctgtgacaagaagaacaccaacaagtgcagcctgggctag

SEQ ID NO: 166840 - DNA, 648 bp, Artificial Sequence
  Description of Artificial Sequence: Synthetic coding sequence
atggccacagccccctacaactacagctacatcttcaagtacatcatcattggagacatgggcgtgggcaagagctgcctgctgcaccagttcacagagaagaagttcatggctgactgcccccacaccatcggcgtggagtttggcacccgcatcatcgaggtgtctggccagaagatcaagctgcagatctgggacacagctggccaggagcgcttccgggctgtgaccaggagctactacagaggagctgctggggccctgatggtgtatgacatcaccaggaggagcacctacaaccacctgagctcctggctgacagatgccaggaacctgaccaaccccaacacagtcatcatcctgattggcaacaaggctgacctggaggcccagagagatgtgacctatgaggaggccaagcagtttgctgaagaaaatggcctgctcttcctggaggccagcgccaagacaggagaaaatgtggaggatgccttcctggaggccgccaagaagatctaccagaacatccaggacggcagcctggacctgaatgctgctgagagcggcgtgcagcacaagcccagcgccccccagggcggccgcctgaccagcgagccccagccccagcgggagggctgcggctgctag

SEQ ID NO: 166841 - DNA, 546 bp, Artificial Sequence
  Description of Artificial Sequence: Synthetic coding sequence
atggccacagccccctacaactacagctacatcttcaagtacatcatcattggagacatgggcgtgggcaagagctgcctgctgcaccagttcacagagaagaagttcatggctgactgcccccacaccatcggcgtggagtttggcacccgcatcatcgaggtgtctggccagaagatcaagctgcagatctgggacacagctggccaggagcgcttccgggctgtgaccaggagctactacagaggagctgctggggccctgatggtgtatgacatcaccaggaggagcacctacaaccacctgagctcctggctgacagatgccaggaacctgaccaaccccaacacagtcatcatcctgattggcaacaaggctgacctggaggcccagagagatgtgacctatgaggaggccaagcagtttgctgaagaaaatggcctgctcttcctggaggccagcgccaagacaggagaaaatgtggaggatgccttcctggaggccgccaagaagatctaccagaacatccaggacggcagcctgtag

SEQ ID NO: 166842 - DNA, 711 bp, Artificial Sequence
  Description of Artificial Sequence: Synthetic coding sequence
atgggccagaaggccagccagcagctggccctgaaggacagcaaggaggtgcctgtggtgtgtgaggtggtgtctgaggccatcgtgcatgctgcccagaagctgaaggagtacctgggctttgagtacccacccagcaagctgtgcccagctgccaacaccctgaatgagatcttcctgatccacttcatcaccttctgccaggagaagggcgtggatgagtggctgaccaccaccaagatgaccaagcaccaggccttcctgtttggagctgactggatctggaccttctggggcagcaacaagcagatcaagctgcagctggccgtgcagaccctgcagatgagcagccccccacctgtggagagcaagccctgtgacctgagcaaccctgagagccgggtggaggagagctcctggaagaagagcagatttgacaagctggaggagttctgcaacctgattggagaggactgcctgggcctcttcatcatcttcggcatgcctgggaagcccaaggacatccggggcgtggtgctggacagcgtgaagagccagatggtgcgcagccacctgcccggcggcaaggctgtggcccagtttgtgctggagacagaggactgtgtgttcatcaaggagctgctgaggaactgcctgagcaagaaggatggcctgcgggaggtgggcaaggtgtacatcagcatcctgtag

SEQ ID NO: 166843 - DNA, 639 bp, Artificial Sequence
  Description of Artificial Sequence: Synthetic coding sequence
atggcccaggcccacaggaccccccagccccgggccgcccccagccagcccagggtcttcaagctggtgctgctgggcagcggctctgtgggcaagagcagcctggccctgcgctacgtgaagaatgacttcaagagcatcctgcccaccgtgggctgtgccttcttcaccaaggtggtggatgtgggcgccaccagcctgaagctggagatctgggacacagctggccaggagaagtaccacagcgtgtgccacctgtacttccggggggccaatgctgccctgctggtgtatgacatcaccaggaaggacagcttcctgaaggcccagcagtggctgaaggacctggaggaggagctgcaccctggagaggtgctggtgatgctggtgggcaacaagacagacctgagccaggagcgggaggtgaccttccaggagggcaaggagtttgctgacagccagaagctgctcttcatggagaccagcgccaagctgaaccaccaggtgtctgaggtgttcaacacagtggcccaggagctgctgcagaggagtgatgaggagggccaggccctgcggggagatgctgctgtggccctgaacaagggccctgcccggcaggccaagtgctgtgcccactag

SEQ ID NO: 166844 - DNA, 258 bp, Artificial Sequence
  Description of Artificial Sequence: Synthetic coding sequence
atgctggtgggcaacaagacagacctgagccaggagcgggaggtgaccttccaggagggcaaggagtttgctgacagccagaagctgctcttcatggagaccagcgccaagctgaaccaccaggtgtctgaggtgttcaacacagtggcccaggagctgctgcagaggagtgatgaggagggccaggccctgcggggagatgctgctgtggccctgaacaagggccctgcccggcaggccaagtgctgtgcccactag

SEQ ID NO: 166845 - DNA, 621 bp, Artificial Sequence
  Description of Artificial Sequence: Synthetic coding sequence
atggatgaagatgtgctgaccaccctgaagatcctgatcatcggggagagcggcgtgggcaagagcagcctgctgctgcgcttcacagatgacacctttgatcctgagctggccgccaccatcggcgtggacttcaaggtgaagaccatctctgtggatggcaacaaggccaagctggccatctgggacacagctggccaggagcgcttccgcaccctgacccccagctactacagaggagcccagggcgtcatcctggtgtatgatgtgacccggcgggacacctttgtgaagctggacaactggctgaatgagctggagacctactgcaccagaaatgacatcgtgaacatgctggtgggcaacaagattgacaaggaaaatcgggaggtggacagaaatgaaggcctgaagtttgccaggaagcacagcatgctgttcatcgaggccagcgccaagacctgtgatggagtgcagtgtgcctttgaggagctggtggagaagatcatccagaccccaggcctgtgggagagcgagaaccagaacaagggcgtgaagctgagccaccgggaggagggccagggcggcggggcctgtggcggctactgcagcgtgctgtag

SEQ ID NO: 166846 - DNA, 486 bp, Artificial Sequence
  Description of Artificial Sequence: Synthetic coding sequence
atggatgaagatgtgctgaccaccctgaagatcctgatcatcggggagagcggcgtgggcaagagcagcctgctgctgcgcttcacagatgacacctttgatcctgagctggccgccaccatcgtgtatgatgtgacccggcgggacacctttgtgaagctggacaactggctgaatgagctggagacctactgcaccagaaatgacatcgtgaacatgctggtgggcaacaagattgacaaggagaaccgggaggtggacagaaatgaaggcctgaagtttgccaggaagcacagcatgctgttcatcgaggccagcgccaagacctgtgatggagtgcagtgtgcctttgaggagctggtggagaagatcatccagaccccaggcctgtgggagagcgagaaccagaacaagggcgtgaagctgagccaccgggaggagggccagggcggcggggcctgtggcggctactgcagcgtgctgtag

SEQ ID NO: 166847 - DNA, 876 bp, Artificial Sequence
  Description of Artificial Sequence: Synthetic coding sequence
tgaagactgcccggcagccggcccctgcccggccccagcagcctgggccgcagccccagctgcagcgctgagaagacccccttccggggcccccccctgggccggcagagcgctgtgaaggagctggacctggtgacagctgggaagttccgcttctctgtgcgctctgagtgcttcagccggggcccccccctgaagatcaagtgcaactgctacttctccttctgccacatcctgtggaggcagaagatctctgtggtgctgtccttcttcaccttcagcctgggcaagatcatcctgactgtggagctgagcatcagcctgctgctgcgcttcacagatgacacctttgatcctgagctggccgccaccatcggcgtggacttcaaggtgaagaccatctctgtggatggcaacaaggccaagctggccatctgggtgaccctgcaccagcagacagccaacttcttcctgaagagccagatcggcaacagccccatcctgaagtgggccatgtggcagtatgacacagctggccaggagcgcttccgcaccctgacccccagctactacagaggagcccagggcgtcatcctggtgtatgatgtgacccggcgggacacctttgtgaagctggacaactggctgaatgagctggagacctactgcaccagaaatgacatcgtgaacatgctggtgggcaacaagattgacaaggagaaccgggaggtggacagaaatgaaggcctgaagtttgccaggaagcacagcatgctgttcatcgaggccagcgccaagacctgtgatggagtgcagtgtgcctttgaggagctggtggagaagatcatccagaccccaggcctgtgggagagctag

SEQ ID NO: 166848 - DNA, 429 bp, Artificial Sequence
  Description of Artificial Sequence: Synthetic coding sequence
atggatgaagatgtgctgaccaccctgaagatcctgatcatcggggagagcggcgtgggcaagagcagcctgctgctgcgcttcacagatgacacctttgatcctgagctggccgccaccatcggcgtggacttcaaggtgaagaccatctctgtggatggcaacaaggccaagctggccatctgggagaaccgggaggtggacagaaatgaaggcctgaagtttgccaggaagcacagcatgctgttcatcgaggccagcgccaagacctgtgatggagtgcagtgtgcctttgaggagctggtggagaagatcatccagaccccaggcctgtgggagagcgagaaccagaacaagggcgtgaagctgagccaccgggaggagggccagggcggcggggcctgtggcggctactgcagcgtgctgtag

SEQ ID NO: 166849 - DNA, 555 bp, Artificial Sequence
  Description of Artificial Sequence: Synthetic coding sequence
atggatgaagatgtgctgaccaccctgaagatcctgatcatcggggagagcggcgtgggcaagagcagcctgctgctgcgcttcacagatgacacctttgatcctgagctggccgccacagacacagctggccaggagcgcttccgcaccctgacccccagctactacagaggagcccagggcgtcatcctggtgtatgatgtgacccggcgggacacctttgtgaagctggacaactggctgaatgagctggagacctactgcaccagaaatgacatcgtgaacatgctggtgggcaacaagattgacaaggaaaatcgggaggtggacagaaatgaaggcctgaagtttgccaggaagcacagcatgctgttcatcgaggccagcgccaagacctgtgatggagtgcagtgtgcctttgaggagctggtggagaagatcatccagaccccaggcctgtgggagagcgagaaccagaacaagggcgtgaagctgagccaccgggaggagggccagggcggcggggcctgtggcggctactgcagcgtgctgtag

SEQ ID NO: 166850 - DNA, 390 bp, Artificial Sequence
  Description of Artificial Sequence: Synthetic coding sequence
atgagctccatgaacccagaatatgactacctgttcaagctgctgctgattggagacagcggcgtgggcaagagctgcctgctgctgcgctttgctgatgacacctacacagagagctacatcagcaccatcggcgtggacttcaagatccgcaccatcgagctggatggcaagaccatcaagctgcagatcgagtttgctgacagcctgggcatccccttcctggagaccagcgccaagaatgccaccaacgtggagcagagcttcatgaccatggctgctgagatcaagaagaggatgggccctggggccacagctgggggcgctgagaagagcaatgtgaagatccagagcacccctgtgaagcagagcggcggcggctgctgctag

SEQ ID NO: 166851 - DNA, 390 bp, Artificial Sequence
  Description of Artificial Sequence: Synthetic coding sequence
atgagctgcctgcaccccaccagtgactacctgttcaagctgctgctgattggagacagcggcgtgggcaagagctgcctgctgctgcgctttgctgatgacacctacacagagagctacatcagcaccatcggcgtggacttcaagatccgcaccatcgagctggatggcaagaccatcaagctgcagatcgagtttgctgacagcctgggcatccccttcctggagaccagcgccaagaatgccaccaacgtggagcagagcttcatgaccatggctgctgagatcaagaagaggatgggccctggggccacagctgggggcgctgagaagagcaatgtgaagatccagagcacccctgtgaagcagagcggcggcggctgctgctag

SEQ ID NO: 166852 - DNA, 522 bp, Artificial Sequence
  Description of Artificial Sequence: Synthetic coding sequence
atgagctccatgaacccagaatatgactacctgttcaagctgctgctgattggagacagcggcgtgggcaagagctgcctgctgctgcgctttgctgatgacacctacacagagagctacatcagcaccatcggcgtggacttcaagatccgcaccatcgagctggatggcaagaccatcaagctgcagatcgagagcttcaacaacgtgaagcagtggctgcaggagattgacagatatgcctctgaaaatgtgaacaagctgctggtgggcaacaagtgtgacctgaccaccaagaaggtggtggactacaccacagccaaggagtttgctgacagcctgggcatccccttcctggagaccagcgccaagaatgccaccaacgtggagcagagcttcatgaccatggctgctgagatcaagaagaggatgggccctggggccacagctgggggcgctgagaagagcaatgtgaagatccagagcacccctgtgaagcagagcggcggcggctgctgctag

SEQ ID NO: 166853 - DNA, 522 bp, Artificial Sequence
  Description of Artificial Sequence: Synthetic coding sequence
atgagctccatgaacccagaatatgactacctgttcaagctgctgctgattggagacagcggcgtgggcaagagctgcctgctgctgcgctttgcctgggacacagctggccaggagcgcttccgcaccatcaccagcagctactacagaggagcccacggcatcatcgtggtgtatgatgtgacagaccaggagagcttcaacaacgtgaagcagtggctgcaggagattgacagatatgcctctgaaaatgtgaacaagctgctggtgggcaacaagtgtgacctgaccaccaagaaggtggtggactacaccacagccaaggagtttgctgacagcctgggcatccccttcctggagaccagcgccaagaatgccaccaacgtggagcagagcttcatgaccatggctgctgagatcaagaagaggatgggccctggggccacagctgggggcgctgagaagagcaatgtgaagatccagagcacccctgtgaagcagagcggcggcggctgctgctag

SEQ ID NO: 166854 - DNA, 618 bp, Artificial Sequence
  Description of Artificial Sequence: Synthetic coding sequence
atgagctccatgaacccagaatatgactacctgttcaagctgctgctgattggagacagcggcgtgggcaagagctgcctgctgctgcgctttgctgatgacacctacacagagagctacatcagcaccatcggcgtggacttcaagatccgcaccatcgagctggatggcaagaccatcaagctgcagatctgggacacagctggccaggagcgcttccgcaccatcaccagcagctactacagaggagcccacggcatcatcgtggtgtatgatgtgacagaccaggagagcttcaacaacgtgaagcagtggctgcaggagattgacagatatgcctctgaaaatgtgaacaagctgctggtgggcaacaagtgtgacctgaccaccaagaaggtggtggactacaccacagccaaggagtttgctgacagcctgggcatccccttcctggagaccagcgccaagaatgccaccaacgtggagcagagcttcatgaccatggctgctgagatcaagaagaggatgggccctggggccacagctgggggcgctgagaagagcaatgtgaagatccagagcacccctgtgaagcagagcggcggcggctgctgctag

SEQ ID NO: 166855 - DNA, 426 bp, Artificial Sequence
  Description of Artificial Sequence: Synthetic coding sequence
atgagctccatgaacccagaatatgactacctgttcaagctgctgctgattggagacagcggcgtgggcaagagctgcctgctgctgcgctttgctgagagcttcaacaacgtgaagcagtggctgcaggagattgacagatatgcctctgaaaatgtgaacaagctgctggtgggcaacaagtgtgacctgaccaccaagaaggtggtggactacaccacagccaaggagtttgctgacagcctgggcatccccttcctggagaccagcgccaagaatgccaccaacgtggagcagagcttcatgaccatggctgctgagatcaagaagaggatgggccctggggccacagctgggggcgctgagaagagcaatgtgaagatccagagcacccctgtgaagcagagcggcggcggctgctgctag

SEQ ID NO: 166856 - DNA, 606 bp, Artificial Sequence
  Description of Artificial Sequence: Synthetic coding sequence
atgaacccagaatatgactacctgttcaagctgctgctgattggagacagcggcgtgggcaagagctgcctgctgctgcgctttgctgatgacacctacacagagagctacatcagcaccatcggcgtggacttcaagatccgcaccatcgagctggatggcaagaccatcaagctgcagatctgggacacagctggccaggagcgcttccgcaccatcaccagcagctactacagaggagcccacggcatcatcgtggtgtatgatgtgacagaccaggagagctatgccaacgtgaagcagtggctgcaggagattgacagatatgcctctgaaaatgtgaacaagctgctggtgggcaacaagagtgacctgaccaccaagaaggtggtggacaacaccacagccaaggagtttgctgacagcctgggcatccccttcctggagaccagcgccaagaatgccaccaacgtggagcaggccttcatgaccatggctgctgagatcaagaagaggatgggccctggagctgccagcggcggggagcggcccaacctgaagattgacagcacccctgtgaagccagctgggggcggctgctgctag

SEQ ID NO: 166857 - DNA, 489 bp, Artificial Sequence
  Description of Artificial Sequence: Synthetic coding sequence
atgaacccagaatatgactacctgttcaagctgctgctgattggagacagcggcgtgggcaagagctgcctgctgctgcgctttgctgatgacacctacacagagagctacatcagcaccatcggcgtggacttcaagatccgcaccatcgagctggatggcaagaccatcaagctgcagatctgggacacagctggccaggagcgcttccgcaccatcaccagcagctactacagaggagcccacggcatcatcgtggtgtatgatgtgacagaccaggagagctatgccaacgtgaagcagggctgccggcggctgacagccatgcctgcccggaccagcatcagctcctggtgggccacccgggccaccagccccccccggcgctggtggaccaccccccagcccaggagcctgcagaccctgtgggccagccccagctggaggcgggcccccaggatgccacccatgagcagccgccgctcctag

SEQ ID NO: 166858 - DNA, 360 bp, Artificial Sequence
  Description of Artificial Sequence: Synthetic coding sequence
atgaacccagaatatgactacctgttcaagctgctgctgattggagacagcggcgtgggcaagagctgcctgctgctgcgctttgctgatgacacctacacagagagctacatcagcaccatcggcgtggacttcaagatccgcaccatcgagctggatggcaagaccatcaagctgcagatctgggacacagctggccaggagcgcttccgcaccatcaccagcagctactacagaggagcccacggcatcatcgtggtgtatgatgtgacagaccaggagagctatgccaacgtgaagcagtggctgcaggagattgacagatatgcctctgaaaatgtgaacaagctgctggtgtag

SEQ ID NO: 166859 - DNA, 678 bp, Artificial Sequence
  Description of Artificial Sequence: Synthetic coding sequence
atggctgctgctgggggcggcggcggcggcgctgctgctgctggccgggcctacagcttcaaggtggtgctgctgggggagggctgtgtgggcaagaccagcctggtgctgcgctactgtgagaacaagttcaatgacaagcacatcaccaccctgcaggccagcttcctgaccaagaagctgaacattggaggcaagagggtgaacctggccatctgggacacagctggccaggagcgcttccacgccctgggccccatctactacagagacagcaatggagccatcctggtgtatgacatcacagatgaggacagcttccagaaggtgaagaactgggtgaaggagctgaggaagatgctgggcaatgagatctgcctgtgcatcgtgggcaacaagattgacctggagaaggagagacatgtgtccatccaggaggccgagagctatgcagagagcgtgggcgccaagcactaccacaccagcgccaagcagaacaagggcatcgaggagctgttcctggacctgtgcaagaggatgattgaaacagcccaggtggatgagcgggccaagggaaatggcagcagccagcccggcacagcccggcggggcgtgcagatcattgatgatgagccccaggcccagaccagcggcggcggctgctgcagcagcggctag

SEQ ID NO: 166860 - DNA, 585 bp, Artificial Sequence
  Description of Artificial Sequence: Synthetic coding sequence
atggccctgcgggagctgaaggtgtgcctgctgggggacaccggggtgggcaagagcagcatcgtgtggaggtttgtggaggacagctttgaccccaacatcaaccccaccatcggggccagcttcatgaccaagacagtgcagtaccagaatgagctgcacaagttcctgatctgggacacagctggccaggagcgcttccgggccctggcccccatgtactaccggggcagcgctgctgccatcatcgtgtatgacatcaccaaggaggagaccttcagcaccctgaagaactgggtgaaggagctgcggcagcacggcccccccaacatcgtggtggccatcgccggcaacaagtgtgacctgattgatgtgcgggaggtgatggagagagatgccaaggactatgctgacagcatccacgccatctttgtggagaccagcgccaagaatgccatcaacatcaatgagctgttcatcgagatcagccgccgcatccccagcacagatgccaacctgcccagcggcggcaagggcttcaagctgcggcggcagcccagcgagcccaagaggagctgctgctag

SEQ ID NO: 166861 - DNA, 714 bp, Artificial Sequence
  Description of Artificial Sequence: Synthetic coding sequence
atgctggaggaggacatggaggtggccatcaagatggtggtggtgggcaatggagctgtgggcaagagctccatgatccagcgctactgcaagggcatcttcaccaaggactacaagaagaccatcggcgtggacttcctggagcggcagatccaggtgaatgatgaagatgtgcggctgatgctgtgggacacagctggccaggaggagtttgatgccatcaccaaggcctactacagaggagcccaggcctgtgtgctggtgttcagcaccacagaccgggagagctttgaagctgtgtcctcctggagggagaaggtggtggccgaggtgggggacatccccaccgtgctggtgcagaacaagattgacctgctggatgacagctgcatcaagaatgaggaggccgaggccctggccaagaggctgaagctgcgcttctaccgcacctctgtgaaggaggacctgaatgtgaatgaggtgttcaagtacctggccgagaagtacctgcagaagctgaagcagcagattgctgaagatcctgagctgacccacagcagcagcaacaagattggagtcttcaacaccagcggcggcagccacagcggccagaacagcggcaccctgaatggaggagatgtgatcaacctgcggcccaacaagcagaggaccaagaagaacagaaaccccttcagcagctgcagcatcccctag

SEQ ID NO: 166862 - DNA, 714 bp, Artificial Sequence; identical to SEQ ID NO: 166861
  Description of Artificial Sequence: Synthetic coding sequence

SEQ ID NO: 166863 - DNA, 612 bp, Artificial Sequence
  Description of Artificial Sequence: Synthetic coding sequence
atgagcggccagagggtggatgtgaaggtggtgatgctgggcaaggagtatgtgggcaagaccagcctggtggagagatatgtgcatgaccgcttcctggtgggcccctaccagaacaccatcggggccgcctttgtggccaaggtgatgtctgtgggggacagaacagtgaccctgggcatctgggacacagctggcagcgagagatatgaggccatgagccgcatctactacagaggagccaaggccgccatcgtgtgctatgacctgacagacagcagcagctttgagcgggccaagttctgggtgaaggagctgcggagcctggaggagggctgccagatctacctgtgtggcaccaagagtgacctgctggaggaggacagaagaagaagaagagtggacttccatgatgtgcaggactatgctgacaacatcaaggcccagctgtttgagaccagcagcaagacaggccagagcgtggatgagctgttccagaaggtggccgaggactatgtgtctgtggccgccttccaggtgatgacagaagataaaggagtggacctgggccagaagcccaacccctacttctacagctgctgccaccactag

SEQ ID NO: 166864 - DNA, 612 bp, Artificial Sequence; identical to SEQ ID NO: 166863
  Description of Artificial Sequence: Synthetic coding sequence

SEQ ID NO: 166865 - DNA, 201 bp, Artificial Sequence
  Description of Artificial Sequence: Synthetic coding sequence
atgagcggccagagggtggatgtgaaggtggtgatgctgggcaaggagtatgtgggcaagaccagcctggtggagagatatgtgcatgaccgcttcctggtgggcccctaccagaacaccatcggggccgcctttgtggccaaggtgatgtctgtgggggacagaacagtgaccctgggcatctgggacacagctggatag

SEQ ID NO: 166866 - DNA, 642 bp, Artificial Sequence
  Description of Artificial Sequence: Synthetic coding sequence
atgggaaatggaacagaggaggactacaactttgtgttcaaggtggtgctgattggagagagcggcgtgggcaagaccaacctgctgagccgcttcaccagaaatgagttcagccatgacagcaggaccaccatcggcgtggagttcagcaccaggacagtgatgctgggcacagctgctgtgaaggcccagatctgggacacagctggcctggagcgctaccgggccatcaccagcgcctactacagaggagctgtgggcgccctgctggtgtttgacctgaccaagcaccagacctatgctgtggtggagcgctggctgaaggagctgtatgaccacgccgaggccaccatcgtggtgatgctggtgggcaacaagagtgacctgagccaggcccgggaggtgcccacagaggaggccaggatgtttgctgaaaataatggcctgctcttcctggagaccagcgccctggacagcaccaacgtggagctggcctttgagaccgtgctgaaggagatctttgccaaggtgtccaagcagaggcagaacagcatccgcaccaatgccatcaccctgggcagcgcccaggccggccaggagcccggccctggagagaagagggcctgctgcatcagcctgtag

SEQ ID NO: 166867 - DNA, 1110 bp, Artificial Sequence
  Description of Artificial Sequence: Synthetic coding sequence
atggagggcagcctggagcgggaggccccagctggggccctggccgctgtgctgaagcacagcagcaccctgcccccagagagcacccaggtgcggggctatgacttcaacagaggagtgaactaccgggccctgctggaggccttcggcaccaccggcttccaggccaccaactttggccgggctgtgcagcaggtgaatgccatgattgagaagaagctggagcccctgagccaggatgaggaccagcacgccgacctgacccagagcagaagacccctgaccagctgcaccatcttcctgggctacaccagcaacctgatcagcagcggcatccgggagaccatccgctacctggtgcagcacaacatggtggatgtgctggtgaccacagctgggggcgtggaggaggacctgatcaagtgcctggcccccacctacctgggggagttcagcctgcggggcaaggagctgcgggagaatggcatcaaccgcatcggcaacctgctggtgcccaatgaaaactactgcaagtttgaggactggctgatgcccatcctggaccagatggtgatggagcagaacacagagggcgtgaagtggacccccagcaagatgattgcccggctgggcaaggagatcaacaaccctgagagcgtgtactactgggcccagaagaaccacatccctgtgttcagccctgccctgacagatggcagcctgggggacatgatcttcttccacagctacaagaaccctggcctggtgctggacatcgtggaggacctgcggctcatcaacacccaggccatctttgccaagtgcaccggcatgatcatcctgggcggcggcgtggtgaagcaccacatcgccaatgccaacctgatgagaaatggagctgactatgctgtgtacatcaacacagcccaggagtttgatggcagtgacagcggggcccggccagatgaggccgtgtcctggggcaagatccgggtggatgcccagcctgtgaaggtgtatgcagatgccagcctggtgttccccctgctggtggccgagacctttgcccagaagatggatgccttcatgcatgagaagaatgaagattag

SEQ ID NO: 166868 - DNA, 573 bp, Artificial Sequence
  Description of Artificial Sequence: Synthetic coding sequence
atgctggtgggggacagcggcgtgggcaagacctgcctgctggtgcgcttcaaggatggagccttcctggccggcaccttcatcagcacagtgggcatcgacttcaggaacaaggtgctggatgtggatggagtgaaggtgaagctgcagatgtgggacacagctggccaggagcgcttccgctctgtgacccacgcctactacagagatgcccacgccctgctgctgctgtatgatgtgaccaacaaggccagctttgacaacatccaggcctggctgacagagatccatgaatatgcccagcatgatgtggccctgatgctgctgggcaacaaggtggacagcgcccacgagcgggtggtgaagcgggaggatggagagaagctggccaaggagtatggcctgcccttcatggagaccagcgccaagacaggcctgaatgtggacctggccttcaccgccatcgccaaggagctgaagcagaggtccatgaaggcccccagcgagccccgcttccggctgcatgactatgtgaagcgggagggccgcggggccagctgctgccggccctag

SEQ ID NO: 166869 - DNA, 666 bp, Artificial Sequence
  Description of Artificial Sequence: Synthetic coding sequence
atgtctgatggagactatgactacctgatcaagttcctggccctgggggacagcggcgtgggcaagacctctgtgctgtaccagtacacagatggcaagttcaacagcaagttcatcaccaccgtgggcatcgacttccgggagaagagggtggtgtaccgggccagcggcccagatggagccaccggccggggccagaggatccacctgcagctgtgggacacagctggccaggagcgcttccgcagcctgaccacagccttcttcagagatgccatgggcttcctgctgctgtttgacctgaccaatgagcagagcttcctgaatgtgaggaactggatcagccagctgcagatgcacgcctactgtgagaacccagacatcgtgctgtgtggcaacaagagtgacctggaggaccagagggtggtgaaggaggaggaggccatcgccctggccgagaagtatggcatcccctactttgagaccagcgctgccaacggcaccaacatcagccaggccatcgagatgctgctggacctgatcatgaagaggatggagcgctgtgtggacaagtcctggatccctgagggcgtggtgcgcagcaatggccacgccagcacagaccagctgtctgaggagaaggagaagggggcctgtggctgctag

SEQ ID NO: 166870 - DNA, 642 bp, Artificial Sequence
  Description of Artificial Sequence: Synthetic coding sequence
atgtctgatggagactatgactacctgatcaagttcctggccctgggggacagcggcgtgggcaagacctctgtgctgtaccagtacacagatggcaagttcaacagcaagttcatcaccaccgtgggcatcgacttccgggagaagagggtggtgtaccgggccagcggcccagatggagccaccggccggggccagaggatccacctgcagctgtgggacacagctggccaggagcgcttccgcagcctgaccacagccttcttcagagatgccatgggcttcctgctgctgtttgacctgaccaatgagcagagcttcctgaatgtgaggaactggatcagccagctgcagatgcacgcctactgtgagaacccagacatcgtgctgtgtggcaacaagagtgacctggaggaccagagggtggtgaaggagaagtatggcatcccctactttgagaccagcgctgccaacggcaccaacatcagccaggccatcgagatgctgctggacctgatcatgaagaggatggagcgctgtgtggacaagtcctggatccctgagggcgtggtgcgcagcaatggccacgccagcacagaccagctgtctgaggagaaggagaagggggcctgtggctgctag

SEQ ID NO: 166871 - DNA, 666 bp, Artificial Sequence; identical to SEQ ID NO: 166869
  Description of Artificial Sequence: Synthetic coding sequence

SEQ ID NO: 166872 - DNA, 663 bp, Artificial Sequence
  Description of Artificial Sequence: Synthetic coding sequence
atgtctgacagcgaggaggagagccaggaccggcagctgaagatcgtggtgctgggagatggagccagcggcaagaccagcctgaccacctgctttgcccaggagaccttcggcaagcagtacaagcagaccatcggcctggacttcttcctgcggcgcatcaccctgcccggcaacctgaatgtgaccctgcagatctgggacattggaggccagaccatcggcggcaagatgctggacaagtacatctacggggcccagggcgtgctgctggtgtatgacatcaccaactaccagagctttgagaacctggaggactggtacacagtggtgaagaaggtgtctgaggagagcgagacccagcccctggtggccctggtgggcaacaagattgacctggagcacatgaggaccatcaagccagagaagcacctgcgcttctgccaggagaatggcttcagcagccactttgtgtctgccaagacaggagacagcgtcttcctgtgcttccagaaggtggccgctgagatcctgggcatcaagctgaacaaggccgagattgagcagagccagagaattgtgcgggcagagatcgtgaagtacccagaggaggagaaccagcacaccaccagcacccagagccgcatctgcagcgtgcagtag

SEQ ID NO: 166873 - DNA, 666 bp, Artificial Sequence
  Description of Artificial Sequence: Synthetic coding sequence
atgtctgacagcgaggaggagagccaggaccggcagctgaagatcgtggtgctgggagatggagccagcggcaagaccagcctgaccacctgctttgcccaggagaccttcggcaagcagtacaagcagaccatcggcctggacttcttcctgcggcgcatcaccctgcccggcaacctgaatgtgaccctgcagatctgggacattggaggccagaccatcggcggcaagatgctggacaagtacatctacggggcccagggcgtgctgctggtgtatgacatcaccaactaccagagctttgagaacctggaggactggtacacagtggtgaagaaggtgtctgaggagagcgagacccagcccctggtggccctggtgggcaacaagattgacctggagcacatgaggaccatcaagccagagaagcacctgcgcttctgccaggagaatggcttcagcagccactttgtgtctgccaagacaggagacagcgtcttcctgtgcttccagaaggtggccgctgagatcctgggcatcaagctgaacaaggccgagattgagcagagccagagggtggtgaaggctgacatcgtgaactacaaccaggagcccatgagcaggacagtgaacccccccaggagctccatgtgtgctgtgcagtag

SEQ ID NO: 166874 - DNA, 615 bp, Artificial Sequence
  Description of Artificial Sequence: Synthetic coding sequence
atgtctgacagcgaggaggagagccaggaccggcagctgaagatcgtggtgctgggagatggagccagcggcaagaccagcctgaccacctgctttgcccaggagaccttcggcaagcagtacaagcagaccatcggcctggacttcttcctgcggcgcatcaccctgcccggcaacctgaatgtgaccctgcagatctgggacattggaggccagaccatcggcggcaagatgctggacaagtacatctacggggcccagggcgtgctgctggtgtatgacatcaccaactaccagagctttgagaacctggaggactggtacacagtggtgaagaaggtgtctgaggagagcgagacccagcccctggtggccctggtgggcaacaagattgacctggagcacatgaggaccatcaagccagagaagcacctgcgcttctgccaggagaatggcttcagcagccactttgtgtctgccaagacaggagacagcgtcttcctgtgcttccagaaggtggccgctgagatcctgggcatcaagctgaacaaggccgagattgagcagagccagggccacttcatcatcttcatcagcagcaccaaccgggagtag

SEQ ID NO: 166875 - DNA, 288 bp, Artificial Sequence
  Description of Artificial Sequence: Synthetic coding sequence
atgtctgacagcgaggaggagagccaggaccggcagctgaagatcgtggtgctgggagatggagccagcggcaagaccagcctgaccacctgctttgcccaggagaccttcggcaagcagtacaagcagaccatcggcctggacttcttcctgcggcgcatcaccctgcccggcaacctgaatgtgaccctgcagatctgggacattggaggccagaccatcggcggcaagatgctggacaagtacatctacggggcccagctgatctggagcatctgtgagcagtag

SEQ ID NO: 166876 - DNA, 639 bp, Artificial Sequence
  Description of Artificial Sequence: Synthetic coding sequence
atggcctatgcctacctgttcaagtacatcatcatcggggacacaggagtgggcaagagctgcctgctgctgcagttcacagacaagcgcttccagcctgtgcatgacctgaccatcggcgtggagtttggagccaggatgatcaccattgatggcaagcagatcaagctgcagatctgggacacagctggccaggagagcttccgcagcatcaccaggagctactacagaggagctgctggggccctgctggtgtatgacatcacccggcgggacaccttcaaccacctgaccacctggctggaggatgcccggcagcacagcaacagcaacatggtgatcatgctgattggcaacaagagtgacctggagagccggcgggaggtgaagaaggaggagggggaggcctttgcccgggagcacggcctcatcttcatggagaccagcgccaagacagccagcaatgtggaggaggccttcatcaacacagccaaggagatctatgagaagatccaggagggcgtgtttgacatcaacaatgaggccaacggcatcaagattggcccccagcacgccgccaccaatgccacccatgctggcaaccagggcggccagcaggccggcggcggctgctgctag

SEQ ID NO: 166877 - DNA, 567 bp, Artificial Sequence
  Description of Artificial Sequence: Synthetic coding sequence
atggcctatgcctacctgttcaagtacatcatcatcggggacacaggagtggagtttggagccaggatgatcaccattgatggcaagcagatcaagctgcagatctgggacacagctggccaggagagcttccgcagcatcaccaggagctactacagaggagctgctggggccctgctggtgtatgacatcacccggcgggacaccttcaaccacctgaccacctggctggaggatgcccggcagcacagcaacagcaacatggtgatcatgctgattggcaacaagagtgacctggagagccggcgggaggtgaagaaggaggagggggaggcctttgcccgggagcacggcctcatcttcatggagaccagcgccaagacagccagcaatgtggaggaggccttcatcaacacagccaaggagatctatgagaagatccaggagggcgtgtttgacatcaacaatgaggccaacggcatcaagattggcccccagcacgccgccaccaatgccacccatgctggcaaccagggcggccagcaggccggcggcggctgctgctag

SEQ ID NO: 166878 - DNA, 501 bp, Artificial Sequence
  Description of Artificial Sequence: Synthetic coding sequence
atgatcaccattgatggcaagcagatcaagctgcagatctgggacacagctggccaggagagcttccgcagcatcaccaggagctactacagaggagctgctggggccctgctggtgtatgacatcacccggcgggacaccttcaaccacctgaccacctggctggaggatgcccggcagcacagcaacagcaacatggtgatcatgctgattggcaacaagagtgacctggagagccggcgggaggtgaagaaggaggagggggaggcctttgcccgggagcacggcctcatcttcatggagaccagcgccaagacagccagcaatgtggaggaggccttcatcaacacagccaaggagatctatgagaagatccaggagggcgtgtttgacatcaacaatgaggccaacggcatcaagattggcccccagcacgccgccaccaatgccacccatgctggcaaccagggcggccagcaggccggcggcggctgctgctag

SEQ ID NO: 166879 - DNA, 630 bp, Artificial Sequence
  Description of Artificial Sequence: Synthetic coding sequence
atgacctacgcctacctgttcaagtacatcatcatcggggacacaggagtgggcaagagctgcctgctgctgcagttcacagacaagcgcttccagcctgtgcatgacctgaccatcggcgtggagtttggagccaggatggtgaacattgatggcaagcagatcaagctgcagatctgggacacagctggccaggagagcttccgcagcatcaccaggagctactacagaggagctgctggggccctgctggtgtatgacatcacccggcgggagaccttcaaccacctgacctcctggctggaggatgcccggcagcacagcagcagcaacatggtgatcatgctgattggcaacaagagtgacctggagagcagaagagatgtgaagcgggaggagggggaggcctttgcccgggagcacggcctcatcttcatggagaccagcgccaagacagcctgcaatgtggaggaggccttcatcaacacagccaaggagatctacaggaagatccagcagggcctgtttgatgtgcacaatgaggccaacggcatcaagattggcccccagcagagcatcagcacctctgtgggccccagcgccagccagagcgctggcctgcaggtgtag

SEQ ID NO: 166880 - DNA, 651 bp, Artificial Sequence
  Description of Artificial Sequence: Synthetic coding sequence
atgacctacgcctacctgttcaagtacatcatcatcggggacacaggagtgggcaagagctgcctgctgctgcagttcacagacaagcgcttccagcctgtgcatgacctgaccatcggcgtggagtttggagccaggatggtgaacattgatggcaagcagatcaagctgcagatctgggacacagctggccaggagagcttccgcagcatcaccaggagctactacagaggagctgctggggccctgctggtgtatgacatcacccggcgggagaccttcaaccacctgacctcctggctggaggatgcccggcagcacagcagcagcaacatggtgatcatgctgattggcaacaagagtgacctggagagcagaagagatgtgaagcgggaggagggggaggcctttgcccgggagcacggcctcatcttcatggagaccagcgccaagacagcctgcaatgtggaggaggccttcatcaacacagccaaggagatctacaggaagatccagcagggcctgtttgatgtgcacaatgaggccaacggcatcaagattggcccccagcagagcatcagcacctctgtgggccccagcgccagccagaggaacagccgggacatcggcagcaacagcggctgctgctag

SEQ ID NO: 166881 - DNA, 189 bp, Artificial Sequence
  Description of Artificial Sequence: Synthetic coding sequence
atgacctacgcctacctgttcaagtacatcatcatcggggacacaggagtgggcaagagctgcctgctgctgcagttcacagacaagcgcttccagcctgtgcatgacctgaccatcggcgtggagtttggagccaggatggtgaacattgatggcaagcagatcaagctgcagatctgggacacctag

SEQ ID NO: 166882 - DNA, 2946 bp, Artificial Sequence
  Description of Artificial Sequence: Synthetic coding sequence
atggctgctgacagcgagcctgagagcgaggtgtttgagatcacagacttcaccacagccagcgagtgggagcgcttcatcagcaaggtggaggaggtgctgaatgactggaagctgattggcaacagcctgggcaagcccctggagaagggcatcttcaccagcggcacctgggaggagaagagtgatgagatcagctttgctgacttcaagttctctgtgacccaccactacctggtgcaggagagcacagacaaggagggcaaggatgagctgctggaggatgtggtgccccagagcatgcaggacctgctgggcatgaacaatgacttccccccccgggcccactgcctggtgcgctggtacggcctgcgggagtttgtggtgattgccccagctgcccacagtgatgctgtgctgtctgagagcaagtgcaacctgctgctgagctctgtgtccatcgccctgggcaacacaggctgccaggtgcccctgtttgtgcagatccaccacaagtggaggaggatgtatgtgggggagtgccagggccctggggtgaggacagactttgagatggtgcacctgaggaaggtgcccaaccagtacacccacctgagcggcctgctggacatcttcaagagcaagattggctgccccctgacccccctgccccctgtgtccatcgccatccgcttcacctacgtgctgcaggactggcagcagtacttctggccccagcagcccccagacattgatgccctggtgggcggggaggtgggcggcctggagtttgggaagctgccctttggagcctgtgaggaccccatcagcgagctgcacctggccaccacctggccccacctgacagagggcatcatcgtggacaatgatgtgtacagcgacctggaccccatccaggccccccactggagcgtgcgggtgaggaaggccgagaacccccagtgcctgctgggggactttgtgacagagttcttcaagatctgcaggaggaaggagagcacagatgagatcctgggccgcagcgcctttgaggaggagggcaaggagacagctgacatcacccacgccctgagcaagctgacagagcccgcctctgtgcccatccacaagctgtctgtgagcaacatggtgcacacagccaagaagaagatcaggaagcaccggggcgtggaggagagccccctgaacaatgatgtgctgaacaccatcctgctcttcctgttcccagatgctgtgtctgagaagcccctggatggcaccaccagcacagacaacaacaaccccccatctgagagcgaggactacaacctgtacaaccagttcaagagcgcccccagcgacagcctgacctacaagctggccctgtgcctgtgcatgatcaacttctaccatggaggcctgaagggcgtggcccacctgtggcaggagtttgtgctggagatgaggttccgctgggagaacaacttcctgatccctggcctggccagcggccccccagacctgcgctgctgcctgctgcaccagaagctgcagatgctgaactgctgcatcgagaggaagaaggccagagatgagggcaagaagaccagcgccagtgatgtgaccaacatctacccaggagatgctgggaaggccggggaccagctggtgcctgacaacctgaaggagacagacaaggagaagggggaggtgggcaagtcctgggacagctggagcgacagcgaggaggagttctttgaatgtctgagtgacacagaggagctgaagggaaatggccaggagagcggcaagaagggcggccccaaggagatggccaacctgcggcctgagggccgcctgtaccagcacggcaagctgaccctgctgcacaatggagagcccctgtacatccctgtgacccaggagcccgcccccatgacagaggacctgctggaggagcagagcgaggtgctggccaagctgggcaccagcgctgagggcgcccacctgcgggccaggatgcagagcgcctgcctgctgagtgacatggagagcttcaaggccgccaaccctggctgcagcctggaggactttgtgcgctggtacagcccccgggactacatcgaggaggaggtgattgatgagaagggaaatgtggtgctgaagggggagctgagcgccaggatgaagatccccagcaacatgtgggtggaggcctgggagacagccaagcccatcccagcccggcggcagaggcggctgtttgatgacacccgggaggccgagaaggtgctgcactacctggccatccagaagccagctgacctggcccggcacctgctgccctgtgtgattcatgctgctgtgctgaaggtgaaggaggaggagagcctggagaacatcagctctgtgaagaagatcatcaagcagatcatcagccacagcagcaaggtgctgcacttccccaaccctgaggacaagaagctggaggagatcatccaccagatcaccaacgtggaggccctgattgcccgggcccggagcctgaaggccaagtttggaacagagaagtgtgagcaggaggaggagaaggaggacctggagagatttgtgtcctgcctgctggagcagcctgaggtgctggtgactggagctggccggggccacgccggccgcatcatccacaagctgtttgtgaatgcccagagagctgctgccatgaccccacctgaggaggagctgaagaggatgggcagccctgaggagcggcggcagaacagcgtgtctgacttccccccacctgctggccgggagttcatcctgcggaccaccgtgcccaggcctgccccctacagcaaggccctgccccagaggatgtacagcgtgctgaccaaggaggacttccggctggccggggccttcagcagtgacaccagcttcttctag

SEQ ID NO: 166883 - DNA, 2808 bp, Artificial Sequence
  Description of Artificial Sequence: Synthetic coding sequence
atgttcagcctcatcagcggcatcttcaccagcggcacctgggaggagaagagtgatgagatcagctttgctgacttcaagttctctgtgacccaccactacctggtgcaggagagcacagacaaggagggcaaggatgagctgctggaggatgtggtgccccagagcatgcaggacctgctgggcatgaacaatgacttccccccccgggcccactgcctggtgcgctggtacggcctgcgggagtttgtggtgattgccccagctgcccacagtgatgctgtgctgtctgagagcaagtgcaacctgctgctgagctctgtgtccatcgccctgggcaacacaggctgccaggtgcccctgtttgtgcagatccaccacaagtggaggaggatgtatgtgggggagtgccagggccctggggtgaggacagactttgagatggtgcacctgaggaaggtgcccaaccagtacacccacctgagcggcctgctggacatcttcaagagcaagattggctgccccctgacccccctgccccctgtgtccatcgccatccgcttcacctacgtgctgcaggactggcagcagtacttctggccccagcagcccccagacattgatgccctggtgggcggggaggtgggcggcctggagtttgggaagctgccctttggagcctgtgaggaccccatcagcgagctgcacctggccaccacctggccccacctgacagagggcatcatcgtggacaatgatgtgtacagcgacctggaccccatccaggccccccactggagcgtgcgggtgaggaaggccgagaacccccagtgcctgctgggggactttgtgacagagttcttcaagatctgcaggaggaaggagagcacagatgagatcctgggccgcagcgcctttgaggaggagggcaaggagacagctgacatcacccacgccctgagcaagctgacagagcccgcctctgtgcccatccacaagctgtctgtgagcaacatggtgcacacagccaagaagaagatcaggaagcaccggggcgtggaggagagccccctgaacaatgatgtgctgaacaccatcctgctcttcctgttcccagatgctgtgtctgagaagcccctggatggcaccaccagcacagacaacaacaaccccccatctgagagcgaggactacaacctgtacaaccagttcaagagcgcccccagcgacagcctgacctacaagctggccctgtgcctgtgcatgatcaacttctaccatggaggcctgaagggcgtggcccacctgtggcaggagtttgtgctggagatgaggttccgctgggagaacaacttcctgatccctggcctggccagcggccccccagacctgcgctgctgcctgctgcaccagaagctgcagatgctgaactgctgcatcgagaggaagaaggccagagatgagggcaagaagaccagcgccagtgatgtgaccaacatctacccaggagatgctgggaaggccggggaccagctggtgcctgacaacctgaaggagacagacaaggagaagggggaggtgggcaagtcctgggacagctggagcgacagcgaggaggagttctttgaatgtctgagtgacacagaggagctgaagggaaatggccaggagagcggcaagaagggcggccccaaggagatggccaacctgcggcctgagggccgcctgtaccagcacggcaagctgaccctgctgcacaatggagagcccctgtacatccctgtgacccaggagcccgcccccatgacagaggacctgctggaggagcagagcgaggtgctggccaagctgggcaccagcgctgagggcgcccacctgcgggccaggatgcagagcgcctgcctgctgagtgacatggagagcttcaaggccgccaaccctggctgcagcctggaggactttgtgcgctggtacagcccccgggactacatcgaggaggaggtgattgatgagaagggaaatgtggtgctgaagggggagctgagcgccaggatgaagatccccagcaacatgtgggtggaggcctgggagacagccaagcccatcccagcccggcggcagaggcggctgtttgatgacacccgggaggccgagaaggtgctgcactacctggccatccagaagccagctgacctggcccggcacctgctgccctgtgtgattcatgctgctgtgctgaaggtgaaggaggaggagagcctggagaacatcagctctgtgaagaagatcatcaagcagatcatcagccacagcagcaaggtgctgcacttccccaaccctgaggacaagaagctggaggagatcatccaccagatcaccaacgtggaggccctgattgcccgggcccggagcctgaaggccaagtttggaacagagaagtgtgagcaggaggaggagaaggaggacctggagagatttgtgtcctgcctgctggagcagcctgaggtgctggtgactggagctggccggggccacgccggccgcatcatccacaagctgtttgtgaatgcccagagagctgctgccatgaccccacctgaggaggagctgaagaggatgggcagccctgaggagcggcggcagaacagcgtgtctgacttccccccacctgctggccgggagttcatcctgcggaccaccgtgcccaggcctgccccctacagcaaggccctgccccagaggatgtacagcgtgctgaccaaggaggacttccggctggccgtgaagatcattgatggagatgtgtag

SEQ ID NO: 166884 - DNA, 2967 bp, Artificial Sequence
  Description of Artificial Sequence: Synthetic coding sequence
atggctgctgacagcgagcctgagagcgaggtgtttgagatcacagacttcaccacagccagcgagtgggagcgcttcatcagcaaggtggaggaggtgctgaatgactggaagctgattggcaacagcctgggcaagcccctggagaagggcatcttcaccagcggcacctgggaggagaagagtgatgagatcagctttgctgacttcaagttctctgtgacccaccactacctggtgcaggagagcacagacaaggagggcaaggatgagctgctggaggatgtggtgccccagagcatgcaggacctgctgggcatgaacaatgacttccccccccgggcccactgcctggtgcgctggtacggcctgcgggagtttgtggtgattgccccagctgcccacagtgatgctgtgctgtctgagagcaagtgcaacctgctgctgagctctgtgtccatcgccctgggcaacacaggctgccaggtgcccctgtttgtgcagatccaccacaagtggaggaggatgtatgtgggggagtgccagggccctggggtgaggacagactttgagatggtgcacctgaggaaggtgcccaaccagtacacccacctgagcggcctgctggacatcttcaagagcaagattggctgccccctgacccccctgccccctgtgtccatcgccatccgcttcacctacgtgctgcaggactggcagcagtacttctggccccagcagcccccagacattgatgccctggtgggcggggaggtgggcggcctggagtttgggaagctgccctttggagcctgtgaggaccccatcagcgagctgcacctggccaccacctggccccacctgacagagggcatcatcgtggacaatgatgtgtacagcgacctggaccccatccaggccccccactggagcgtgcgggtgaggaaggccgagaacccccagtgcctgctgggggactttgtgacagagttcttcaagatctgcaggaggaaggagagcacagatgagatcctgggccgcagcgcctttgaggaggagggcaaggagacagctgacatcacccacgccctgagcaagctgacagagcccgcctctgtgcccatccacaagctgtctgtgagcaacatggtgcacacagccaagaagaagatcaggaagcaccggggcgtggaggagagccccctgaacaatgatgtgctgaacaccatcctgctcttcctgttcccagatgctgtgtctgagaagcccctggatggcaccaccagcacagacaacaacaaccccccatctgagagcgaggactacaacctgtacaaccagttcaagagcgcccccagcgacagcctgacctacaagctggccctgtgcctgtgcatgatcaacttctaccatggaggcctgaagggcgtggcccacctgtggcaggagtttgtgctggagatgaggttccgctgggagaacaacttcctgatccctggcctggccagcggccccccagacctgcgctgctgcctgctgcaccagaagctgcagatgctgaactgctgcatcgagaggaagaaggccagagatgagggcaagaagaccagcgccagtgatgtgaccaacatctacccaggagatgctgggaaggccggggaccagctggtgcctgacaacctgaaggagacagacaaggagaagggggaggtgggcaagtcctgggacagctggagcgacagcgaggaggagttctttgaatgtctgagtgacacagaggagctgaagggaaatggccaggagagcggcaagaagggcggccccaaggagatggccaacctgcggcctgagggccgcctgtaccagcacggcaagctgaccctgctgcacaatggagagcccctgtacatccctgtgacccaggagcccgcccccatgacagaggacctgctggaggagcagagcgaggtgctggccaagctgggcaccagcgctgagggcgcccacctgcgggccaggatgcagagcgcctgcctgctgagtgacatggagagcttcaaggccgccaaccctggctgcagcctggaggactttgtgcgctggtacagcccccgggactacatcgaggaggaggtgattgatgagaagggaaatgtggtgctgaagggggagctgagcgccaggatgaagatccccagcaacatgtgggtggaggcctgggagacagccaagcccatcccagcccggcggcagaggcggctgtttgatgacacccgggaggccgagaaggtgctgcactacctggccatccagaagccagctgacctggcccggcacctgctgccctgtgtgattcatgctgctgtgctgaaggtgaaggaggaggagagcctggagaacatcagctctgtgaagaagatcatcaagcagatcatcagccacagcagcaaggtgctgcacttccccaaccctgaggacaagaagctggaggagatcatccaccagatcaccaacgtggaggccctgattgcccgggcccggagcctgaaggccaagtttggaacagagaagtgtgagcaggaggaggagaaggaggacctggagagatttgtgtcctgcctgctggagcagcctgaggtgctggtgactggagctggccggggccacgccggccgcatcatccacaagctgtttgtgaatgcccagaggctgacagagagcagtgatgaagctgctgccatgaccccacctgaggaggagctgaagaggatgggcagccctgaggagcggcggcagaacagcgtgtctgacttccccccacctgctggccgggagttcatcctgcggaccaccgtgcccaggcctgccccctacagcaaggccctgccccagaggatgtacagcgtgctgaccaaggaggacttccggctggccggggccttcagcagtgacaccagcttcttctag

SEQ ID NO: 166885 - DNA, 4182 bp, Artificial Sequence
  Description of Artificial Sequence: Synthetic coding sequence
atggcctgcagcatcgtgcagttctgctacttccaggacctgcaggccgcccgggacttcctgttcccccacctgcgggaggagatcctgagcggggccctgcggcgggaccccagcaagagcacagactgggaggatgatggctggggcgcctgggaggagaatgagccccaggagcctgaggaggagggcaacacctgcaagacccagaagacctcctggctgcaggactgtgtgctgagcctgagccccaccaatgacctgatggtgattgcccgggagcagaaggctgtgttcctggtgcccaagtggaagtacagcgacaagggcaaggaggagatgcagtttgctgtgggctggagcggcagcctgaatgtggaggagggggagtgtgtgaccagcgccctgtgcatccccctggccagccagaagaggagcagcacaggccgcccagactggacctgcatcgtggtgggcttcaccagcggctacgtgcgcttctacacagaaaatggagtgctgctgctggcccagctgctgaatgaagatcctgtgctgcagctgaagtgcaggacctatgagatccccaggcaccctggggtgacagagcagaatgaggagctgagcatcctgtacccagctgccatcgtgaccattgatggcttcagcctcttccagagcctgcgggcctgcaggaaccaggtggccaaggctgctgccagcggaaatgaaaacatccagcccccacccctggcctacaagaagtggggcctgcaggacatcgacaccatcatcgaccacgcctctgtgggcatcatgaccctgagcccctttgaccagatgaagacagccagcaacattggaggcttcaatgctgccatcaagaacagccccccagccatgagccagtacatcaccgtgggcagcaaccccttcaccggcttcttctacgccctggagggcagcacccagcccctgctgagccacgtggccctggccgtggccagcaagctgaccagcgccctcttcaatgctgccagcggctggctgggctggaagagcaagcatgaggaggaggccgtgcagaagcagaagcccaaggtggagcccgccacccccctggccgtgcgcttcggcctgcctgacagccgccgccacggggagagcatctgcctgagcccctgcaacaccctggccgctgtgacagatgactttggccgggtcatcctgctggatgtggcccggggcatcgccatccgcatgtggaagggctacagagatgcccagatcggctggatccagacagtggaggacctgcacgagcgggtgcctgagaaggctgacttcagccccttcggcaacagccagggccccagccgggtggcccagttcctggtgatctatgccccccggcggggcatcctggaggtgtggagcacccagcagggcccccgggtgggcgccttcaacgtgggcaagcactgccgcctgctgtacccaggctacaagatcatgggcctgaacaacgtgaccagccagagctggcagccccagacctaccagatctgcctggtggaccctgtgtctggctctgtgaagacagtgaatgtgcccttccacctggccctgagtgacaagaagtctgagcgggccaaggacatgcacctggtgaagaagctggccgccctgctgaagaccaagagccccaacctggacctggtggagacagagatcaaggagctgatcctggacatcaagtacccagccaccaagaagcaggccctggagagcatcctggccagcgagcggctgcccttcagctgcctgaggaacatcacccagaccctgatggacaccctgaagagccaggagctggagagcgtggatgagggcctgctgcagttctgtgccaacaagctgaagctgctgcagctgtatgagagcgtgtcccagctgaacagcctggacttccacctggacacccccttcagtgacaatgacctggccctgctgctgcggctggatgagaaggagctgctgaagctgcaggccctgctggagaagtacaagcaggagaacaccaggaccaacgtgcgcttcagtgatgacaaggatggagtgctgcctgtgaagaccttcctggagtacctggagtatgagaaggatgtgctgaacatcaagaagatcagcgaggaggagtatgtggccctgggcagcttcttcttctggaagtgcctgcatggagagagcagcacagaggacatgtgccacaccctggagagcgctggcctgagcccccagctgctgctgagcctgctgctgtctgtgtggctgagcaaggagaaggacatcctggacaagccccagagcatctgctgcctgcacaccatgctgagcctgctgagcaagatgaaggtggccattgatgagacctgggacagccagagcgtgagcccctggtggcagcagatgaggacagcctgcatccagagcgagaacaacggggccgccctgctgagcgcccacgtgggccacagcgtggccgcccagatcagcaacaacatgacagagaagaagttcagccagacagtgctgggcgctgacagcgaggccctgacagacagctgggaggccctgagcctggacacagagtactggaagctgctgctgaagcagctggaggactgcctgatcctgcagaccctgctgcacagcaagggcaacacccagaccagcaaggtgagcagcctgcaggccgagcccctgccccggctgtctgtgaagaagctgctggagggcggcaaaggaggcattgctgacagcgtggccaagtggatcttcaagcaggacttcagccctgaggtgctgaagctggccaatgaggagagagatgctgagaacccagatgagcccaaggagggcgtgaacagaagcttcctggaggtgtctgagatggagatggacctgggcgccatcccagacctgctgcacctggcctatgagcagttcccctgcagcctggagctggatgtgctgcacgcccactgctgctgggagtatgtggtgcagtggaacaaggaccctgaggaggcccgcttctttgtgcgcagcattgagcacctgaagcagatcttcaatgcccacgtgcagaatggaattgccctgatgatgtggaacaccttcctggtgaagcgcttctctgctgccacctacctgatggacaaggtgggcaagagccccaaggaccggctgtgcagaagagatgtgggcatgtctgacacagccatgaccagcttcctgggcagctgcctggacctgctgcagatcctgatggaggctgatgtgtccagagatgagatccaggtgcctgtgctggacacagaagatgcctggctgtctgtggagggccccatcagcatcgtggagctggccctggagcagaagcacatccactaccccctggtggagcaccacagcatcctgtgcagcatcctgtatgctgtgatgaggttcagcctgaagacagtgaagcccctgagcctgtttgacagcaagggcaagaatgccttcttcaaggacctgaccagcatccagctgctgcccagcggggagatggaccccaacttcatctctgtgcggcagcagttcctgctgaaggtggtgtctgctgctgtgcaggcccagcacagcgccaccaaggtgaaggaccccacagaggaggccacccccaccccatttgggaaggaccaggactggccagccctggccgtggacctggcccaccacctgcaggtgtctgaagatgtggtgagaagacactacgtgggggagctgtacaactatggagtggaccacctgggggaggaggccatcctgcaggtgcatgacaaggaggtgctggccagccagctgctggtgctgaccggccagaggctggcccacgccctgctgcacacccagaccaaggagggcatggagctgctggcccggctgccccccaccctgtgcacctggctgaaggccatggacccccaggacctgcagaacacagaggtgcccatcgccaccacagccaagctggtgaacaaggtgattgagctgctgcctgagaagcacggccagtatggcctggccctgcacctgattgaggccgtggaggccatcagcctgcccagcctgtag

SEQ ID NO: 166886 - DNA, 612 bp, Artificial Sequence
  Description of Artificial Sequence: Synthetic coding sequence
atgtccatggaggactatgacttcctgttcaagatcgtgctgattggaaatgctggggtgggcaagacctgcctggtgcggcgcttcacccagggcctcttccccccaggccagggcgccaccatcggcgtggacttcatgatcaagacagtggagatcaacggggagaaggtgaagctgcagatctgggacacagctggccaggagcgcttccgcagcatcacccagagctactacagaagtgccaatgccctgatcctgacctatgacatcacctgtgaggagagcttccgctgcctgcctgagtggctgcgggagattgagcagtatgccagcaacaaggtgatcaccgtgctggtgggcaacaagattgacctggccgagcggcgggaggtgtcccagcagagagctgaggagttcagcgaggcccaggacatgtactacctggagaccagcgccaaggagagtgacaacgtggagaagctgttcctggacctggcctgccgcctcatcagcgaggcccggcagaacaccctggtgaacaacgtgagcagccccctgcccggggagggcaagagcatctcctacctgacctgctgcaacttcaactag

SEQ ID NO: 166887 - DNA, 345 bp, Artificial Sequence
  Description of Artificial Sequence: Synthetic coding sequence
atgtccatggaggactatgacttcctgttcaagatcgtgctgattggaaatgctggggtgggcaagacctgcctggtgcggcgcttcacccagggcctcttccccccaggccagggcgccaccatcggcgtggacttcatgatcaagacagtggagatcaacggggagaaggtgaagctgcagatctgggacacagctggccaggagcgcttccgcagcatcacccagagctactacagaagtgccaatgccctgatcctgacctatgacatcacctgtgaggagagcttccgctgcctgcctgagtggctgcgggagattgagcagtatgccagcaacaagtag

SEQ ID NO: 166888 - DNA, 612 bp, Artificial Sequence; identical to SEQ ID NO: 166886
  Description of Artificial Sequence: Synthetic coding sequence

SEQ ID NO: 166889 - DNA, 168 bp, Artificial Sequence
  Description of Artificial Sequence: Synthetic coding sequence
atgtccatggaggactatgacttcctgttcaagatcgtgctgattggaaatgctggggtgggcaagacctgcctggtgcggcgcttcacccagggcctcttccccccaggccagggcgccaccatcggcgtggacttcatgatcaagacagtggagatcaatggatag

SEQ ID NO: 166890 - DNA, 507 bp, Artificial Sequence
  Description of Artificial Sequence: Synthetic coding sequence
atgtccatggaggactatgacttcctgttcaagatcgtgctgattggaaatgctggggtgggcaagacctgcctggtgcggcgcttcacccagggcctcttccccccaggccagggcgccaccatcggcgtggacttcatgatcaagacagtggagatcaacggggagaaggtgaagctgcagatctgggacacagctggccaggagcgcttccgcagcatcacccagagctactacagaagtgccaatgccctgatcctgacctatgacatcacctgtgaggagagcttccgctgcctgcctgagtggctgcgggagattgagcagtatgccagcaacaaggtgatcaccgtgctggtgggcaacaagattgacctggccgagcggcgggaggtgtcccagcagagagctgaggagttcagcgaggcccaggacatgtactacctggagaccagcgccaaggagagtgacaacgtggagaagctgttcctggacctggcctgctag

SEQ ID NO: 166891 - DNA, 183 bp, Artificial Sequence
  Description of Artificial Sequence: Synthetic coding sequence
atgtccatggaggactatgacttcctgttcaagatcgtgctgattggaaatgctggggtgggcaagacctgcctggtgcggcgcttcacccagggcctcttccccccaggccagggcgccaccatcggcgtggacttcatgatcaagacagtggagatcaacggggagaaggtgaagctgtag

SEQ ID NO: 166892 - DNA, 612 bp, Artificial Sequence; identical to SEQ ID NO: 166886
  Description of Artificial Sequence: Synthetic coding sequence

SEQ ID NO: 166893 - DNA, 303 bp, Artificial Sequence
  Description of Artificial Sequence: Synthetic coding sequence
atgtccatggaggactatgacttcctgttcaagatcgtgctgattggaaatgctggggtgggcaagacctgcctggtgcggcgcttcacccagggcctcttccccccaggccagggcgccaccatcggcgtggacttcatgatcaagacagtggagatcaacggggagaaggtgaagctgcagatctgggacacagctggccaggagcgcttccgcagcatcacccagagctactacagaagtgccaatgccctgatcctgacctatgacatcacctgtgaggagagcttccgctgcctgtag

SEQ ID NO: 166894 - DNA, 495 bp, Artificial Sequence
  Description of Artificial Sequence: Synthetic coding sequence
atgtccatggaggactatgacttcctgttcaagatcgtgctgattggaaatgctggggtgggcaagacctgcctggtgcggcgcttcacccagggcctcttccccccaggccagggcgccaccatcggcgtggacttcatgatcaagacagtggagatcaacggggagaaggtgaagctgcagatctgggacacagctggccaggagcgcttccgcagcatcacccagagctactacagaagtgccaatgccctgatcctgacctatgacatcacctgtgaggagagcttccgctgcctgcctgagtggctgcgggagattgagcagtatgccagcaacaaggtgatcaccgtgctggccacccggctgacctggctgaagggggagcgcttccccagcagcgagctgaagaacagccagaagctgcggacctgcatcatctggaggccccagcccaggaacctgatcatgtggaggaacagcagcctgacctag

SEQ ID NO: 166895 - DNA, 420 bp, Artificial Sequence
  Description of Artificial Sequence: Synthetic coding sequence
atgtccatggaggactatgacttcctgttcaagatcgtgctgattggaaatgctggggtgggcaagacctgcctggtgcggcgcttcacccagggcctcttccccccaggccagggcgccaccatcggcgtggacttcatgatcaagacagtggagatcaacggggagaaggtgaagctgcagatctgggacacagctggccaggagcgcttccgcagcatcacccagagctactacagaagtgccaatgccctgatcctgacctatgacatcacctgtgaggagagcttccgctgcctgcctgagtggctgcgggagattgagcagtatgccagcaacaaggtgatcaccgtgctggtgggcaacaagattgacctggccgagcggcgggaggtgtcccagcagagagctgaggagtag

SEQ ID NO: 166896 - DNA, 588 bp, Artificial Sequence
  Description of Artificial Sequence: Synthetic coding sequence
atgatggccatccgggagctgaaggtgtgcctgctgggggacacaggagtgggcaagagcagcatcgtgtgccgctttgtgcaggaccactttgaccacaacatcagccccaccatcggggccagcttcatgaccaagacagtgccctgtggaaatgagctgcacaagttcctgatctgggacacagctggccaggagcgcttccacagcctggcccccatgtactaccggggcagcgctgctgctgtgattgtgtatgacatcaccaagcaggacagcttctacaccctgaagaagtgggtgaaggagctgaaggagcacggccctgagaacatcgtgatggccatcgccggcaacaagtgtgacctgagtgacatccgggaggtgcccctgaaggatgccaaggagtatgcagagagcattggagccatcgtggtggagaccagcgccaagaatgccatcaacatcgaggagctgttccagggcatcagccggcagatcccccccctggacccccatgaaaatggaaacaacggcaccatcaaggtggagaagcccaccatgcaggccagccgccgctgctgctag

SEQ ID NO: 166897 - DNA, 561 bp, Artificial Sequence
  Description of Artificial Sequence: Synthetic coding sequence
tgcctgctgaatgacaccggggtgggcaagagcagcatcgtgtgccgctttgtgcaggaccactttgaccacaacatcagccccaccatcggggccagcttcatgaccaagacagtgccctgtggaaatgagctgcacaagttcctgatctgggacacagctggccaggagcgcttccacagcctggcccccatgtactaccggggcagcgctgctgctgtgattgtgtatgacatcaccaagcaggacagcttctacaccctgaagaagtgggtgaaggagctgaaggagcacggcccagaaaatattgtgatggccatcgccggcaacaagtgtgacctgagtgacatccgggaggtgcccctgaaggatgccaaggagtatgcagagagcatcggggccatcgtggtggagaccagcgccaagaatgccatcaacatcgaggagctgttccagggcatcagccggcagatcccccccctggacccccatgaaaatggaaataatggcaccatcaaggtggagaagcccaccatgcaggccagccgccgctgctgctag

SEQ ID NO: 166898 - DNA, 678 bp, Artificial Sequence
  Description of Artificial Sequence: Synthetic coding sequence
atggccggcggcggggccggggaccccggcctgggcgctgctgctgccccagcccctgagacccgggagcacctgttcaaggtgctggtgattggagagctgggcgtgggcaagaccagcatcatcaagagatatgtgcaccagctgttcagccagcactaccgggccaccatcggcgtggactttgccctgaaggtgctgaactgggacagcaggaccctggtgcggctgcagctgtgggacattgctggccaggagcgcttcggcaacatgaccagggtgtactacaaggaggccgtgggcgcctttgtggtgtttgacatcagccgcagcagcacctttgaggccgtgctgaagtggaagagtgacctggacagcaaggtgcacctgcccaacggcagccccatcccagctgtgctgctggccaacaagtgtgaccagaacaaggacagcagccagagccccagccaggtggaccagttctgcaaggagcacggctttgctggctggtttgagaccagcgccaaggacaacatcaacatcgaggaggccgcccgcttcctggtggagaagatcctggtgaaccaccagagcttccccaatgaagaaaatgatgtggacaagatcaagctggaccaggagaccctgcgggcagagaacaagagccagtgctgctag

SEQ ID NO: 166899 - DNA, 714 bp, Artificial Sequence
  Description of Artificial Sequence: Synthetic coding sequence
atggcccagcccatcctgggccacggcagcctgcagcctgccagcgctgctggcctggccagcctggagctggacagcagcctggaccagtatgtgcagatccgcatcttcaagatcatcgtcatcggggacagcaatgtgggcaagacctgcctgaccttccgcttctgtggcggcaccttcccagacaagacagaggccaccatcggcgtggacttccgggagaagacagtggagattgaaggagagaagatcaaggtgcaggtgtgggacacagctggccaggagcgcttcaggaagtccatggtggagcactactacagaaatgtgcatgctgtggtgtttgtgtatgatgtgaccaagatgaccagcttcaccaacctgaagatgtggatccaggagtgcaatggacatgctgtgccccccctggtgcccaaggtgctggtgggcaacaagtgtgacctgcgggagcagatccaggtgcccagcaacctggccctgaagtttgctgatgcccacaacatgctgctgtttgagaccagcgccaaggaccccaaggagagccagaatgtggagagcatcttcatgtgcctggcctgccgcctgaaggcccagaagagcctgctgtacagagatgctgagcggcagcagggcaaggtgcagaagctggagttcccccaggaggccaacagcaagaccagctgcccctgctag

SEQ ID NO: 166900 - DNA, 714 bp, Artificial Sequence
  Description of Artificial Sequence: Synthetic coding sequence
atgaacatcctggcccctgtgcggcgggacagagtgctggccgagctgccccagtgcctgaggaaggaggccgccctgcacggccacaaggacttccacccccgggtgacctgtgcctgccaggagcacaggactggaacagtgggcttctgcaaggacacctttgacaagaactacaaggccaccatcggcgtggactttgagatggagagatttgaggtgctgggcatccccttcagcctgcagctgtgggacacagctggccaggagcgcttcaagtgcatcgccagcacctactacagaggagcccaggccatcatcatcgtgttcaacctgaatgatgtggccagcctggagcacaccaagcagtggctggctgatgccctgaaggaaaatgaccccagctctgtgctgctcttcctggtgggcagcaagaaggacctgagcaccccagcccagtatgccctgatggagaaggatgccctgcaggtggcccaggagatgaaggccgagtactgggccgtgagcagcctgactggagaaaatgtgcgggagttcttcttccgggtggccgccctgacctttgaggccaacgtgctggccgagctggagaagagcggggccaggagaattggagatgtggtgcgcatcaacagtgatgacagcaacctgtacctgacagccagcaagaagaagcccacctgctgcccctag

SEQ ID NO: 166901 - DNA, 780 bp, Artificial Sequence
  Description of Artificial Sequence: Synthetic coding sequence
atgaacatcctggcccctgtgcggcgggacagagtgctggccgagctgccccagtgcctgaggaaggaggccgccctgcacggccacaaggacttccacccccgggtgacctgtgcctgccaggagcacaggactggaacagtgggcttcaagatcagcaaggtgattgtggtgggggacctgtctgtgggcaagacctgcctgatcaaccgcttctgcaaggacacctttgacaagaactacaaggccaccatcggcgtggactttgagatggagagatttgaggtgctgggcatccccttcagcctgcagctgtgggacacagctggccaggagcgcttcaagtgcatcgccagcacctactacagaggagcccaggccatcatcatcgtgttcaacctgaatgatgtggccagcctggagcacaccaagcagtggctggctgatgccctgaaggaaaatgaccccagctctgtgctgctcttcctggtgggcagcaagaaggacctgagcaccccagcccagtatgccctgatggagaaggatgccctgcaggtggcccaggagatgaaggccgagtactgggccgtgagcagcctgactggagaaaatgtgcgggagttcttcttccgggtggccgccctgacctttgaggccaacgtgctggccgagctggagaagagcggggccaggagaattggagatgtggtgcgcatcaacagtgatgacagcaacctgtacctgacagccagcaagaagaagcccacctgctgcccctag

SEQ ID NO: 166902 - DNA, 636 bp, Artificial Sequence
  Description of Artificial Sequence: Synthetic coding sequence
atgaacatcctggcccctgtgcggcgggacagagtgctggccgagctgccccagtgcctgaggaaggaggccgccctgcacggccacaaggacttccacccccgggtgacctgtgcctgccaggagcacaggactggaacagtgggcttcaagatcagcaaggtgattgtggtgggggacctgtctgtgggcaagacctgcctgatcaaccgcttctgcaaggacacctttgacaagaactacaaggccaccatcggcgtggactttgagatggagagatttgaggtgctgggcatccccttcagcctgcagctgtgggacacagctggccaggagcgcttcaagtgcatcgccagcacctactacagaggagcccaggccatcatcatcgtgttcaacctgaatgatgtggccagcctggagcacaccaagcagtggctggctgatgccctgaaggaaaatgaccccagctctgtgctgctcttcctggtgggcagcaagaaggacctgagcaccccagcccagtatgccctgatggagaaggatgccctgcaggtggcccaggagatgaaggccgagtactgggccgtgagcagcctgactggagaaaatgtgcgggagttcttcttcagatag

SEQ ID NO: 166903 - DNA, 756 bp, Artificial Sequence
  Description of Artificial Sequence: Synthetic coding sequence
atgaacatcctggcccctgtgcggcgggacagagtgctggccgagctgccccagtgcctgaggaaggaggccgccctgcacggccacaaggacttccacccccgggtgacctgtgcctgccaggagcacaggactggaacagtgggcttcaagatcagcaaggtgattgtggtgggggacctgtctgtgggcaagacctgcctgatcaaccgcttctgcaaggacacctttgacaagaactacaaggccaccatcggcgtggactttgagatggagagatttgaggtgctgggcatccccttcagcctgcagctgtgggacacagctggccaggagcgcttcaagtgcatcgccagcacctactacagaggagcccaggccatcatcatcgtgttcaacctgaatgatgtggccagcctggagcacaccaagcagtggctggctgatgccctgaaggaaaatgaccccagctctgtgctgctcttcctgaccccagcccagtatgccctgatggagaaggatgccctgcaggtggcccaggagatgaaggccgagtactgggccgtgagcagcctgactggagaaaatgtgcgggagttcttcttccgggtggccgccctgacctttgaggccaacgtgctggccgagctggagaagagcggggccaggagaattggagatgtggtgcgcatcaacagtgatgacagcaacctgtacctgacagccagcaagaagaagcccacctgctgcccctag

SEQ ID NO: 166904 - DNA, 780 bp, Artificial Sequence; identical to SEQ ID NO: 166901
  Description of Artificial Sequence: Synthetic coding sequence

SEQ ID NO: 166905 - DNA, 636 bp, Artificial Sequence; identical to SEQ ID NO: 166902
  Description of Artificial Sequence: Synthetic coding sequence

SEQ ID NO: 166906 - DNA, 696 bp, Artificial Sequence
  Description of Artificial Sequence: Synthetic coding sequence
tgaagcctgcgcttccccatcaccaacagcgctggggccccctgcaaggccgccggccgcatgaacatcctggcccctgtgcggcgggacagagtgctggccgagctgccccagtgcctgaggaaggaggccgccctgcacggccacaaggacttccacccccgggtgacctgtgcctgccaggagcacaggactggaacagtgggccgcttcaagatcagcaaggtgattgtggtgggggacctgtctgtgggcaagacctgcctgatcaaccgcttctgcaaggacacctttgacaagaactacaaggccaccatcggcgtggactttgagatggagagatttgaggtgctgggcatccccttcagcctgcagctgtgggacacagctggccaggagcgcttcaagtgcatcgccagcacctactacagaggagcccaggccatcatcatcgtgttcaacctgaatgatgtggccagcctggagcacaccaagcagtggctggctgatgccctgaaggaaaatgaccccagctctgtgctgctcttcctggtgggcagcaagaaggacctgagcaccccagcccagtatgccctgatggagaaggatgccctgcaggtggcccaggagatgaagacagtgcagaggctgcccagcccccgggccctgtgccacccccacagcagccgggcctag

SEQ ID NO: 166907 - DNA, 951 bp, Artificial Sequence
  Description of Artificial Sequence: Synthetic coding sequence
atgagccacctgcccggcctggagctgcggcgggaggccccacccctgctgggccccctgctgagccccttccccctgcctgctggctcctggcaccggcagatgctgcggagcagcctgcgcttccccatcaccaacagcgctggggccccctgcaaggctgctggccgcatgaacatcctggcccctgtgagaagagacagagtgctggccgagctgccccagtgcctgaggaaggaggccgccctgcacggccacaaggacttccacccccgggtgacctgtgcctgccaggagcacaggacaggcaccgtgggcttcaagatcagcaaggtgattgtggtgggggacctgtctgtgggcaagacctgcctgatcaaccgcttctgcaaggacacctttgacaagaactacaaggccaccatcggcgtggactttgagatggagagatttgaggtgctgggcatccccttcagcctgcagctgtgggacacagctggccaggagcgcttcaagtgcatcgccagcacctactacagaggagcccaggccatcatcatcgtgttcaacctgaatgatgtggccagcctggagcacaccaagcagtggctggctgatgccctgaaggaaaatgaccccagctctgtgctgctcttcctggtgggcagcaagaaggacctgagcaccccagcccagtatgccctgatggagaaggatgccctgcaggtggcccaggagatgaaggccgagtactgggccgtgagcagcctgaccggggagaatgtgcgggagttcttcttccgggtggccgccctgacctttgaggccaacgtgctggccgagctggagaagagcggggccaggagaattggagatgtggtgcgcatcaacagtgatgacagcaacctgtacctgacagccagcaagaagaagcccacctgctgcccctag

SEQ ID NO: 166908 - DNA, 825 bp, Artificial Sequence
  Description of Artificial Sequence: Synthetic coding sequence
atgctgcggagcagcctgcgcttccccatcaccaacagcgctggggccccctgcaaggctgctggccgcatgaacatcctggcccctgtgagaagagacagagtgctggccgagctgccccagtgcctgaggaaggaggccgccctgcacggccacaaggacttccacccccgggtgacctgtgcctgccaggagcacaggacaggcaccgtgggcttcaagatcagcaaggtgattgtggtgggggacctgtctgtgggcaagacctgcctgatcaaccgcttctgcaaggacacctttgacaagaactacaaggccaccatcggcgtggactttgagatggagagatttgaggtgctgggcatccccttcagcctgcagctgtgggacacagctggccaggagcgcttcaagtgcatcgccagcacctactacagaggagcccaggccatcatcatcgtgttcaacctgaatgatgtggccagcctggagcacaccaagcagtggctggctgatgccctgaaggaaaatgaccccagctctgtgctgctcttcctgaccccagcccagtatgccctgatggagaaggatgccctgcaggtggcccaggagatgaaggccgagtactgggccgtgagcagcctgaccggggagaatgtgcgggagttcttcttccgggtggccgccctgacctttgaggccaacgtgctggccgagctggagaagagcggggccaggagaattggagatgtggtgcgcatcaacagtgatgacagcaacctgtacctgacagccagcaagaagaagcccacctgctgcccctag

SEQ ID NO: 166909 - DNA, 807 bp, Artificial Sequence
  Description of Artificial Sequence: Synthetic coding sequence
atgagccacctgcccggcctggagctgcggcgggaggccccacccctgctgggccccctgctgagccccttccccctgcctgctggctcctggcaccggcagatgctgcggagcagcctgcgcttccccatcaccaacagcgctggggccccctgcaaggctgctggccgcatgaacatcctggcccctgtgagaagagacagagtgctggccgagctgccccagtgcctgaggaaggaggccgccctgcacggccacaaggacttccacccccgggtgacctgtgcctgccaggagcacaggacaggcaccgtgggccgcttcaagatcagcaaggtgattgtggtgggggacctgtctgtgggcaagacctgcctgatcaaccgcttctgcaaggacacctttgacaagaactacaaggccaccatcggcgtggactttgagatggagagatttgaggtgctgggcatccccttcagcctgcagctgtgggacacagctggccaggagcgcttcaagtgcatcgccagcacctactacagaggagcccaggccatcatcatcgtgttcaacctgaatgatgtggccagcctggagcacaccaagcagtggctggctgatgccctgaaggaaaatgaccccagctctgtgctgctcttcctggtgggcagcaagaaggacctgagcaccccagcccagtatgccctgatggagaaggatgccctgcaggtggcccaggagatgaagacagtgcagaggctgcccagcccccgggccctgtgccacccccacagcagccgggcctag

SEQ ID NO: 166910 - DNA, 1002 bp, Artificial Sequence
  Description of Artificial Sequence: Synthetic coding sequence
atggtgattgctggggcctcctggatgctgggccgggccgccgccagccccacccagaccccacccaccaccagcaccatccgggtggcccggcgcagccgggtggccctggtggccatggtgattgctgctgctggcagcggcggccctggccgggcagagccccagctgagccagcccagcctggactgtggccgcatgaggagcagcctgacccccctgggcccccctgtgtcccgggacagagtcatcgccagcttccccaagtggtacaccccagaggcctgcctgcagctgcgggagcacttccacggccaggtgtctgctgcctgccagaggaggaacacaggcaccgtgggcctgaagctgagcaaggtggtggtggtgggggacctgtatgtgggcaagaccagcctcatccaccgcttctgcaagaatgtgtttgaccgggactacaaggccaccatcggcgtggactttgaaattgaaagatttgaaattgctggcatcccctacagcctgcagatctgggacacagctggccaggagaagttcaagtgcatcgccagcgcctactacagaggagcccaggtgatcatcacagcctttgacctgacagatgtgcagaccctggagcacacccggcagtggctggaggatgccctgcgggagaatgaagctggcagctgcttcatcttcctggtgggcaccaagaaggacctgctgtctggagctgcctgtgagcaggccgaggctgatgctgtgcacctggcccgggagatgcaggccgagtactggagcgtgtctgccaagacaggagaaaatgtgaaggccttcttcagccgggtggccgccctggcctttgagcagagcgtgctgcaggacctggagcggcagagcagcgcccggctgcaggtgggcaatggagacctgatccagatggagggcagccccccagagacccaggagagcaagaggcccagcagcctgggctgctgctag

SEQ ID NO: 166911 - DNA, 936 bp, Artificial Sequence
  Description of Artificial Sequence: Synthetic coding sequence
atggtgattgctggggcctcctggatgctgggccgggccgccgccagccccacccagaccccacccaccaccagcaccatccgggtggcccggcgcagccgggtggccctggtggccatggtgattgctgctgctggcagcggcggccctggccgggcagagccccagctgagccagcccagcctggactgtggccgcatgaggagcagcctgacccccctgggcccccctgtgtcccgggacagagtcatcgccagcttccccaagtggtacaccccagaggcctgcctgcagctgcgggagcacttccacggccaggtgtctgctgcctgccagaggaggaacacaggcaccgtgggcttctgcaagaatgtgtttgaccgggactacaaggccaccatcggcgtggactttgaaattgaaagatttgaaattgctggcatcccctacagcctgcagatctgggacacagctggccaggagaagttcaagtgcatcgccagcgcctactacagaggagcccaggtgatcatcacagcctttgacctgacagatgtgcagaccctggagcacacccggcagtggctggaggatgccctgcgggagaatgaagctggcagctgcttcatcttcctggtgggcaccaagaaggacctgctgtctggagctgcctgtgagcaggccgaggctgatgctgtgcacctggcccgggagatgcaggccgagtactggagcgtgtctgccaagacaggagaaaatgtgaaggccttcttcagccgggtggccgccctggcctttgagcagagcgtgctgcaggacctggagcggcagagcagcgcccggctgcaggtgggcaatggagacctgatccagatggagggcagccccccagagacccaggagagcaagaggcccagcagcctgggctgctgctag

SEQ ID NO: 166912 - DNA, 498 bp, Artificial Sequence
  Description of Artificial Sequence: Synthetic coding sequence
atggtgattgctgctgctggcagcggcggccctggccgggcagagccccagctgagccagcccagcctggactgtggccgcatgaggagcagcctgacccccctgggcccccctgtgtcccgggacagagtgattgccagcttccccaagtggtacaccccagaggcctgcctgcagctgcgggagcacttccacggccaggtgtctgctgcctgccagaggagaaatactggaacagtgggcctgaagctgagcaaggtggtggtggtgggggacctgtatgtgggcaagaccagcctgagcgcccagtatgcccacccccagggcttcctgacagccatgaaccagccccacagcccccggcccctgagccctggctacgcccacagcagccaccccagcagagctgtggccagccgccgctggagggccccctgccggcagcccagcgaccagtactgcagcccccgggcctggcacacagctgctgccctgtag

SEQ ID NO: 166913 - DNA, 549 bp, Artificial Sequence
  Description of Artificial Sequence: Synthetic coding sequence
atggacctgcagaggccagacagctaccagggcggggccggccctgacttcaatgaccacgtgctgcacaagaccatcctggtgggggacagcggcgtgggcaagaccagcctgctggtgcagtttgaccagggcaagttcatccctggcagcttcagcgccaccgtgggcatcggcttcaccaacaaggtggtgacagtggatggagtgcgggtgaagctgcagatctgggacacagctggccaggagcgcttccgctctgtgacccacgcctactacagagatgcccaggccctgctgctgctgtatgacatcaccaacaagagcagctttgacaacatccgggcctggctgacagagatccacgagtatgcccagagagatgtggtgatcatgctgctgggcaacaaggctgacatgagcagcgagagggtcatccgctcagaagatggagagaccctggcccgggagtatggagtgcccttcctggagaccagcgccaagacaggcatgaatgtggagctggccttcctggccatcgccaagtag

SEQ ID NO: 166914 - DNA, 570 bp, Artificial Sequence
  Description of Artificial Sequence: Synthetic coding sequence
atgacaggcaccccaggagctgtggccaccagagatggagaggcccctgagaggagccccccctgcagccccagctatgacctgaccgggaaggtgatgctgctgggggacaccggggtgggcaagacctgcttcctgatccagttcaaggatggagccttcctgagcggcaccttcatcgccaccgtgggcatcgacttcaggaacaaggtggtgacagtggatggagtgcgggtgaagctgcagatctgggacacagctggccaggagcgcttccgctctgtgacccacgcctactacagagatgcccaggccctgctgctgctgtatgacatcaccaacaagagcagctttgacaacatccgggcctggctgacagagatccatgaatatgcccagagagatgtggtgatcatgctgctgggcaacaaggctgacatgagcagcgagagggtcatccgctcagaagatggagagaccctggcccgggagtatggagtgcccttcctggagaccagcgccaagacaggcatgaatgtggagctggccttcctggccatcgccaagtag

SEQ ID NO: 166915 - DNA, 561 bp, Artificial Sequence
  Description of Artificial Sequence: Synthetic coding sequence
atgacaggcaccccaggagctgtggccaccagagatggagaggcccctgagaggagccccccctgcagccccagctatgacctgaccgggaagaacaaggtggtgacagtggatggagtgcgggtgaagctgcagatctgggacacagctggccaggagcgcttccgctctgtgacccacgcctactacagagatgcccaggccctgctgctgctgtatgacatcaccaacaagagcagctttgacaacatccgggcctggctgacagagatccacgagtatgcccagagagatgtggtgatcatgctgctgggcaacaaggctgacatgagcagcgagagggtcatccgctcagaagatggagagaccctggcccgggagtatggagtgcccttcctggagaccagcgccaagacaggcatgaatgtggagctggccttcctggccatcgccaaggagctgaagtaccgggccggccaccaggctgatgagcccagcttccagatccgggactatgtggagagccagaagaagaggagcagctgctgcagcttcatgtag

SEQ ID NO: 166916 - DNA, 672 bp, Artificial Sequence
  Description of Artificial Sequence: Synthetic coding sequence
atgacaggcaccccaggagctgtggccaccagagatggagaggcccctgagaggagccccccctgcagccccagctatgacctgaccgggaaggtgatgctgctgggggacaccggggtgggcaagacctgcttcctgatccagttcaaggatggagccttcctgagcggcaccttcatcgccaccgtgggcatcgacttcaggaacaaggtggtgacagtggatggagtgcgggtgaagctgcagatctgggacacagctggccaggagcgcttccgctctgtgacccacgcctactacagagatgcccaggccctgctgctgctgtatgacatcaccaacaagagcagctttgacaacatccgggcctggctgacagagatccatgaatatgcccagagagatgtggtgatcatgctgctgggcaacaaggctgacatgagcagcgagagggtcatccgctcagaagatggagagaccctggcccgggagtatggagtgcccttcctggagaccagcgccaagacaggcatgaatgtggagctggccttcctggccatcgccaaggagctgaagtacagagctggccaccaggctgatgagcccagcttccagatccgggactatgtggagagccagaagaagaggagcagctgctgcagcttcatgtag

SEQ ID NO: 166917 - DNA, 687 bp, Artificial Sequence
  Description of Artificial Sequence: Synthetic coding sequence
atgtggctgatgtctgaggcccacggggctgagcctgtgctgctgcgggaggccgcccggcccttcacccagaccctgcggctgtgtgtgcccagcggcaacagcaaggtgatgctgctgggggacacaggagtgggcaagacctgcttcctgatccagttcaaggatggagccttcctgagcggcaccttcatcgccaccgtgggcatcgacttcaggaacaaggtggtgacagtggatggagtgcgggtgaagctgcagatctgggacacagctggccaggagcgcttccgctctgtgacccacgcctactacagagatgcccaggccctgctgctgctgtatgacatcaccaacaagagcagctttgacaacatccgggcctggctgacagagatccacgagtatgcccagagagatgtggtgatcatgctgctgggcaacaaggctgacatgagcagcgagagggtcatccgctcagaagatggagagaccctggcccgggagtatggagtgcccttcctggagaccagcgccaagacaggcatgaatgtggagctggccttcctggccatcgccaaggagctgaagtaccgggccggccaccaggctgatgagcccagcttccagatccgggactatgtggagagccagaagaagaggagcagctgctgcagcttcatgtag

SEQ ID NO: 166918 - DNA, 576 bp, Artificial Sequence
  Description of Artificial Sequence: Synthetic coding sequence
atgtggctgatgtctgaggcccacggggctgagcctgtgctgctgcgggaggccgcccggcccttcacccagaccctgcggctgtgtgtgcccagcggcaacagcaagaacaaggtggtgacagtggatggagtgcgggtgaagctgcagatctgggacacagctggccaggagcgcttccgctctgtgacccacgcctactacagagatgcccaggccctgctgctgctgtatgacatcaccaacaagagcagctttgacaacatccgggcctggctgacagagatccatgaatatgcccagagagatgtggtgatcatgctgctgggcaacaaggctgacatgagcagcgagagggtcatccgctcagaagatggagagaccctggcccgggagtatggagtgcccttcctggagaccagcgccaagacaggcatgaatgtggagctggccttcctggccatcgccaaggagctgaagtacagagctggccaccaggctgatgagcccagcttccagatccgggactatgtggagagccagaagaagaggagcagctgctgcagcttcatgtag

SEQ ID NO: 166919 - DNA, 510 bp, Artificial Sequence
  Description of Artificial Sequence: Synthetic coding sequence
atggacctgcagaggccagacagctaccagggcggggccggccctgacttcaatgaccacgtgctgcacaagaccatcctggtgggggacagcggcgtgggcaagaccagcctgctggtgcagtttgaccagggcaagttcatccctggcagcttcagcgccaccgtgggcatcggcttcaccaacaaggtggtgacagtggatggagtgcgggtgaagctgcagatctgggacacagctggccaggagcgcttccgctctgtgacccacgcctactacagagatgcccaggccctgctgctgctgtatgacatcaccaacaagagcagctttgacaacatccgggcctggctgacagagatccacgagtatgcccagagagatgtggtgatcatgctgctgggcaacaaggtgtctggcagcggggccggcagcgcccagccctgcaccagcagcgccctggccggccccatcaccacccaggagcagctgagccgccaccccagctag

SEQ ID NO: 166920 - DNA, 651 bp, Artificial Sequence
  Description of Artificial Sequence: Synthetic coding sequence
atggacctgcagaggccagacagctaccagggcggggccggccctgacttcaatgaccacgtgctgcacaagaccatcctggtgggggacagcggcgtgggcaagaccagcctgctggtgcagtttgaccagggcaagttcatccctggcagcttcagcgccaccgtgggcatcggcttcaccaacaaggtggtgacagtggatggagtgcgggtgaagctgcagatctgggacacagctggccaggagcgcttccgctctgtgacccacgcctactacagagatgcccaggccctgctgctgctgtatgacatcaccaacaagagcagctttgacaacatccgggcctggctgacagagatccacgagtatgcccagagagatgtggtgatcatgctgctgggcaacaaggctgacatgagcagcgagagggtcatccgctcagaagatggagagaccctggcccgggagtatggagtgcccttcctggagaccagcgccaagacaggcatgaatgtggagctggccttcctggccatcgccaaggagctgaagtaccgggccggccaccaggctgatgagcccagcttccagatccgggactatgtggagagccagaagaagaggagcagctgctgcagcttcatgtag

SEQ ID NO: 166921 - DNA, 651 bp, Artificial Sequence; identical to SEQ ID NO: 166920
  Description of Artificial Sequence: Synthetic coding sequence

SEQ ID NO: 166922 - DNA, 672 bp, Artificial Sequence; identical to SEQ ID NO: 166916
  Description of Artificial Sequence: Synthetic coding sequence

SEQ ID NO: 166923 - DNA, 591 bp, Artificial Sequence
  Description of Artificial Sequence: Synthetic coding sequence
atgtgctgcaaggtgatgctgctgggggacacaggagtgggcaagacctgcttcctgatccagttcaaggatggagccttcctgagcggcaccttcatcgccaccgtgggcatcgacttcaggaacaaggtggtgacagtggatggagtgcgggtgaagctgcagatctgggacacagctggccaggagcgcttccgctctgtgacccacgcctactacagagatgcccaggccctgctgctgctgtatgacatcaccaacaagagcagctttgacaacatccgggcctggctgacagagatccacgagtatgcccagagagatgtggtgatcatgctgctgggcaacaaggctgacatgagcagcgagagggtcatccgctcagaagatggagagaccctggcccgggagtatggagtgcccttcctggagaccagcgccaagacaggcatgaatgtggagctggccttcctggccatcgccaaggagctgaagtaccgggccggccaccaggctgatgagcccagcttccagatccgggactatgtggagagccagaagaagaggagcagctgctgcagcttcatgtag

SEQ ID NO: 166924 - DNA, 636 bp, Artificial Sequence
  Description of Artificial Sequence: Synthetic coding sequence
atgcaggccccccacaaggagcacctgtacaagctgctggtgattggagacctgggcgtgggcaagaccagcatcatcaagagatatgtgcaccagaacttcagcagccactaccgggccaccatcggcgtggactttgccctgaaggtgctgcactgggaccctgagaccgtggtgcggctgcagctgtgggacattgctggccaggagcgcttcggcaacatgaccagggtgtactaccgggaggccatgggcgccttcatcgtgtttgatgtgaccaggcctgccacctttgaggccgtggccaagtggaagaatgacctggacagcaagctgagcctgcccaacgggaagcctgtgtctgtggtgctgctggccaacaagtgtgaccagggcaaggatgtgctgatgaacaacggcctgaagatggaccagttctgcaaggagcacggctttgtgggctggtttgagaccagcgccaaggagaacatcaacattgatgaggccagccgctgcctggtgaagcacatcctggccaatgaatgtgacctgatggagagcattgaaccagatgtggtgaagccccacctgaccagcaccaaggtggccagctgcagcggctgtgccaagagctag

SEQ ID NO: 166925 - DNA, 642 bp, Artificial Sequence
  Description of Artificial Sequence: Synthetic coding sequence
atggaggccatctggctgtaccagttccgcctcatcgtcatcggggacagcacagtgggcaagagctgcctgatccgccgcttcacagagggccgctttgcccaggtgtctgaccccaccgtgggcgtggacttcttcagccggctggtggagattgagcccgggaagaggatcaagctgcagatctgggacacagctggccaggagcgcttccgcagcatcacccgggcctactacagaaacagcgtgggcggcctgctgctgtttgacatcaccaacagaagaagcttccagaatgtgcatgagtggctggaggagaccaaggtgcacgtgcagccctaccagatcgtgtttgtgctggtgggccacaagtgtgacctggacacccagaggcaggtgaccaggcatgaggccgagaagctggccgccgcctacggcatgaagtacatcgagaccagcgccagagatgccatcaacgtggagaaggccttcacagacctgacccgggacatctatgagctggtgaagagaggagagatcaccatccaggagggctgggagggcgtgaagagcggctttgtgcccaacgtggtgcacagcagcgaggaggtggtgaagtcagaaagacgctgcctgtgctag

SEQ ID NO: 166926 - DNA, 2187 bp, Artificial Sequence
  Description of Artificial Sequence: Synthetic coding sequence
atggccggccctgagggcttccagtaccgggccctgtaccccttccggcgggagaggcctgaggacctggagctgctgcctggagatgtgctggtggtgtcccgggccgccctgcaggccctgggcgtggccgagggcggggagcgctgcccccagagcgtgggctggatgcctggcctgaatgaaagaacccggcagagaggagacttccctggcacctacgtggagttcctgggccctgtggccctggcccggcccggcccccggccccggggcccccggcccctgcctgcccggcccagagatggagcccctgagcccggcctgaccctgcctgacctgcctgagcagttcagccccccagatgtggccccacccctgctggtgaagctggtggaggccattgaaagaacaggcctggacagcgagagccactacagacctgagctgcctgcccccaggacagactggagcctgagtgatgtggaccagtgggacacagctgccctggctgatggcatcaagagcttcctgctggccctgcctgcccccctggtgaccccagaggccagcgctgaggcccggcgggccctgcgggaggccgccggccctgtgggccctgccctggagccccccaccctgcccctgcaccgggccctgaccctgcgcttcctgctgcagcacctgggccgggtggccagccgggccccagccctgggccctgctgtgcgggccctgggcgccaccttcggccccctgctgctgcgggcccctcctccacccagcagccccccacctgggggcgccccagatggcagcgagcccagcccagacttccctgccctgctggtggagaagctgctgcaggagcacctggaggagcaggaggtggcccccccagccctgccccccaagccacccaaggccaagccagccagcacagtgctggccaacggcggcagcccccccagcctgcaggatgctgagtggtactggggagacatcagccgggaggaggtgaatgagaagctgcgggacaccccagatggcaccttcctggtgagagatgccagcagcaagatccagggcgagtacaccctgaccctgaggaaaggaggcaacaacaagctgatcaaggtgttccacagagatggccactacggcttcagcgagcccctgaccttctgcagcgtggtggacctgatcaaccactacagacatgagagcctggcccagtacaatgccaagctggacacccggctgctgtaccctgtgtccaagtaccagcaggaccagatcgtgaaggaggacagcgtggaggccgtgggcgcccagctgaaggtgtaccaccagcagtaccaggacaagagccgggagtatgaccagctgtatgaggagtacaccaggaccagccaggagctgcagatgaagaggacagccatcgaggccttcaatgagaccatcaagatctttgaggagcagggccagacccaggagaagtgcagcaaggagtacctggagcgcttccggcgggagggcaatgagaaggagatgcagaggatcctgctgaacagcgagcggctgaagagcagaattgctgagatccacgagagcaggaccaagctggagcagcagctgcgggcccaggccagtgacaaccgggagattgacaagaggatgaacagcctgaagccagacctgatgcagctgaggaagatccgggaccagtacctggtgtggctgacccagaagggggcccggcagaagaagatcaatgagtggctgggcatcaagaatgaaacagaggaccagtatgccctgatggaggatgaagatgacctgccccaccacgaggagaggacctggtacgtgggcaagatcaacagaacccaggccgaggagatgctgagcggcaagagagatggcaccttcctgatccgggagagcagccagaggggctgctacgcctgcagcgtggtggtggatggagacaccaagcactgcgtcatctacagaacagccactggatttggatttgctgagccctacaacctgtatggcagcctgaaggagctggtgctgcactaccagcacgccagcctggtgcagcacaatgatgccctgactgtgaccctggcccaccctgtgcgggcccctggccctggccccccacctgctgccaggtag

SEQ ID NO: 166927 - DNA, 660 bp, Artificial Sequence
  Description of Artificial Sequence: Synthetic coding sequence
atggcctctgtgacagatggcaagacaggagtgaaggatgccagtgaccagaactttgactacatgttcaagctgctgatcatcggcaacagctctgtgggcaagaccagcttcctgttccgctatgcagatgacaccttcaccccagcctttgtgtccacagtgggcatcgacttcaaggtgaagacagtgtacagacatgagaagagggtgaagctgcagatctgggacacagctggccaggagcgctaccgcaccatcaccacagcctactacagaggagccatgggcttcatcctgatgtatgacatcaccaatgaggagagcttcaatgctgtgcaggactgggccacccagatcaagacctacagctgggacaatgcccaggtgatcctggtgggcaacaagtgtgacatggaggaggagcgggtggtgcccacagagaagggccagctgctggccgagcagctgggctttgacttctttgaggccagcgccaaggagaacatctctgtgcggcaggcctttgagcggctggtggatgccatctgtgacaagatgtctgacagcctggacacagaccccagcatgctgggcagcagcaagaacacccggctgagtgacaccccacccctgctgcagcagaactgcagctgctag

SEQ ID NO: 166928 - DNA, 660 bp, Artificial Sequence; identical to SEQ ID NO: 166927
  Description of Artificial Sequence: Synthetic coding sequence

SEQ ID NO: 166929 - DNA, 684 bp, Artificial Sequence
  Description of Artificial Sequence: Synthetic coding sequence
atgagacatgaggcccccatgcagatggccagcgcccaggatgcccgctatggccagaaggacagcagtgaccagaactttgactacatgttcaagctgctgatcatcggcaacagctctgtgggcaagaccagcttcctgttccgctatgcagatgacagcttcaccagcgcctttgtgtccacagtgggcatcgacttcaaggtgaagacagtgttcaagaatgagaagaggatcaagctgcagatctgggacacagctggccaggagcgctaccgcaccatcaccacagcctactacagaggagccatgggcttcatcctgatgtatgacatcaccaatgaggagagcttcaatgctgtgcaggactggagcacccagatcaagacctacagctgggacaatgcccaggtgatcctggtgggcaacaagtgtgacatggaggatgagagggtcatcagcacagagcggggccagcacctgggggagcagctgggctttgagttctttgagaccagcgccaaggacaacatcaacgtgaagcagacctttgagcggctggtggacatcatctgtgacaagatgtctgagagcctggagacagatcctgccatcacagctgccaagcagaacacccggctgaaggagaccccacctccaccccagcccaactgtgcctgctag

SEQ ID NO: 166930 - DNA, 783 bp, Artificial Sequence
  Description of Artificial Sequence: Synthetic coding sequence
atggccggcagccccctgctgtggggcccccgggccggcggcgtgggcctgctggtgctgctgctgctgggcctcttccggcccccaccagccctgtgtgcccggcctgtgaaggagccccggggcctgtctgctgccagcccccccctggccgagactggagccccccggcgcttccgccgctctgtgcccagaggagaggccgccggggctgtgcaggagctggcccgggccctggcccacctgctggaggccgagcggcaggagcgggcccgggcagaggcccaggaggccgaggaccagcaggcccgggtgctggcccagctgctgcgggtgtggggcgcccccaggaacagcgaccctgccctgggcctggatgatgatcctgatgccccagctgcccagctggcccgggccctgctgcgggcccggctggaccctgctgccctggccgcccagctggtgcctgcccctgtgcctgctgctgccctgcggccccggccccctgtgtatgatgatggccctgctggcccagatgctgaggaggccggagatgagaccccagatgtggaccctgagctgctgcgctacctgctgggccgcatcctggccggcagcgctgacagcgagggcgtggccgccccccggcggctgcggcgggctgctgaccatgatgtgggcagcgagctgcccccagagggcgtgctgggcgccctgctgcgggtgaagaggctggagaccccagccccccaggtgcctgcccggcggctgctgcccccatag

SEQ ID NO: 166931 - DNA, 657 bp, Artificial Sequence
  Description of Artificial Sequence: Synthetic coding sequence
atgagccagacagccatgtctgagacctatgacttcctgttcaagttcctggtgattggaaatgccggcaccgggaagagctgcctgctgcaccagttcatcgagaagaagttcaaggatgacagcaaccacaccatcggcgtggagtttggcagcaagatcatcaacgtgggcggcaagtatgtgaagctgcagatctgggacacagctggccaggagcgcttccgctctgtgaccaggagctactacagaggagctgctggggccctgctggtgtatgacatcaccagccgggagacctacaatgccctgaccaactggctgacagatgccaggatgctggccagccagaacatcgtcatcatcctgtgtggcaacaagaaggacctggatgctgaccgggaggtgaccttcctggaggccagcagatttgcccaggagaatgagctgatgttcctggagaccagcgccctgactggagaaaatgtggaggaggcctttgtgcagtgtgccaggaagatcctgaacaagattgagagcggggagctggaccctgagaggatgggcagcggcatccagtatggagatgctgccctgcggcagctgcggagcccccggcgggcccaggccccaaatgcccaggagtgtggctgctag

SEQ ID NO: 166932 - DNA, 648 bp, Artificial Sequence
  Description of Artificial Sequence: Synthetic coding sequence
atggccagcagaggagccacccggcccaacggccccaacacaggcaacaagatctgccagttcaagctggtgctgctgggggagagcgctgtgggcaagagcagcctggtgctgcgctttgtgaagggccagttccacgagttccaggagagcaccatcggggccgccttcctgacccagacagtgtgcctggatgacaccaccgtgaagtttgagatctgggacacagctggccaggagcgctaccacagcctggcccccatgtactacagaggagcccaggccgccatcgtggtgtatgacatcaccaatgaggagagctttgcccgggccaagaactgggtgaaggagctgcagaggcaggccagccccaacatcgtcatcgccctgagcggcaacaaggctgacctggccaacaagagagctgtggacttccaggaggcccagagctatgcagatgacaacagcctgctcttcatggagaccagcgccaagacctccatgaatgtgaatgagatcttcatggccatcgccaagaagctgcccaagaatgagccccagaaccctggggccaacagcgcccggggccggggcgtggacctgacagagcccacccagcccaccaggaaccagtgctgcagcaactag

SEQ ID NO: 166933 - DNA, 606 bp, Artificial Sequence
  Description of Artificial Sequence: Synthetic coding sequence
atggccagcagaggagccacccggcccaacggccccaacacaggcaacaagatctgccagttcaagctggtgctgctgggggagagcgctgtgggcaagagcagcctggtgctgcgctttgtgaagggccagttccacgagttccaggagagcaccatcggcgtgaagtttgagatctgggacacagctggccaggagcgctaccacagcctggcccccatgtactacagaggagcccaggccgccatcgtggtgtatgacatcaccaatgaggagagctttgcccgggccaagaactgggtgaaggagctgcagaggcaggccagccccaacatcgtcatcgccctgagcggcaacaaggctgacctggccaacaagagagctgtggacttccaggaggcccagagctatgcagatgacaacagcctgctcttcatggagaccagcgccaagacctccatgaatgtgaatgagatcttcatggccatcgccaagaagctgcccaagaatgagccccagaaccctggggccaacagcgcccggggccggggcgtggacctgacagagcccacccagcccaccaggaaccagtgctgcagcaactag

SEQ ID NO: 166934 - DNA, 48 bp, Artificial Sequence
  Description of Artificial Sequence: Synthetic coding sequence
atggccagcagaggagccacccggcccaacggccccaacacaggatag

SEQ ID NO: 166935 - DNA, 648 bp, Artificial Sequence
  Description of Artificial Sequence: Synthetic coding sequence
atgaccagccgcagcacagcccggcccaacggccagccccaggccagcaagatctgccagttcaagctggtgctgctgggggagagcgctgtgggcaagagcagcctggtgctgcgctttgtgaagggccagttccacgagtaccaggagagcaccatcggggccgccttcctgacccagagcgtgtgcctggatgacaccaccgtgaagtttgagatctgggacacagctggccaggagcgctaccacagcctggcccccatgtactacagaggagcccaggccgccatcgtggtgtatgacatcaccaaccaggagacctttgcccgggccaagacctgggtgaaggagctgcagaggcaggccagccccagcatcgtcatcgccctggccggcaacaaggctgacctggccaacaagaggatggtggagtatgaggaggcccaggcctatgcagatgacaacagcctgctcttcatggagaccagcgccaagacagccatgaatgtgaatgacctcttcctggccatcgccaagaagctgcccaagtctgagccccagaacctgggcggcgctgctggccgcagccggggcgtggacctgcacgagcagagccagcagaacaagagccagtgctgcagcaactag

SEQ ID NO: 166936 - DNA, 525 bp, Artificial Sequence
  Description of Artificial Sequence: Synthetic coding sequence
atgaccagccgcagcacagcccggcccaacggccagccccaggccagcaagatctgccagttcaagctggtgctgctgggggagagcgctgtgggcaagagcagcctggtgctgcgctttgtgaagggccagttccacgagtaccaggagagcaccatcggggccgccttcctgacccagagcgtgtgcctggatgacaccaccgtgaagtttgagatctgggacacagctggccaggagcgctaccacagcctggcccccatgtactacagaggagcccaggccgccatcgtggtgtatgacatcaccaaccaggaggcccaggcctatgcagatgacaacagcctgctcttcatggagaccagcgccaagacagccatgaatgtgaatgacctcttcctggccatcgccaagaagctgcccaagtctgagccccagaacctgggcggggccgccggccgcagcagaggagtggacctgcacgagcagagccagcagaacaagagccagtgctgcagcaactag

SEQ ID NO: 166937 - DNA, 348 bp, Artificial Sequence
  Description of Artificial Sequence: Synthetic coding sequence
atgaccagccgcagcacagcccggcccaacggccagccccaggccagcaagatctgccagttcaagctggtgctgctgggggagagcgctgtgggcaagagcagcctggtgctgcgctttgtgaagggccagttccacgagtaccaggagagcaccatcggggccgccttcctgacccagagcgtgtgcctggatgacaccaccgtgaagtttgagatctgggacacagctggccaggagcgctaccacagcctggcccccatgtactacagaggagcccaggccgccatcgtggtgtatgacatcaccaaccaggagacctttgcccgggccaagacctgggtgtag

SEQ ID NO: 166938 - DNA, 303 bp, Artificial Sequence
  Description of Artificial Sequence: Synthetic coding sequence
atgaccagccgcagcacagcccggcccaacggccagccccaggccagcaagatctgccagttcaagctggtgctgctgggggagagcgctgtgggcaagagcagcctggtgctgcgctttgtgaagggccagttccacgagtaccaggagagcaccatcggggccgccttcctgacccagagcgtgtgcctggatgacaccaccgtgaagtttgagatctgggacacagctggccaggagcgctaccacagcctggcccccatgtactacagaggagcccaggccgccatcgtggtgtactag

SEQ ID NO: 166939 - DNA, 648 bp, Artificial Sequence; identical to SEQ ID NO: 166935
  Description of Artificial Sequence: Synthetic coding sequence

SEQ ID NO: 166940 - DNA, 651 bp, Artificial Sequence
  Description of Artificial Sequence: Synthetic coding sequence
atggccggccggggcggggccgcccggcccaatggacctgctgctggcaacaagatctgccagttcaagctggtgctgctgggggagagcgctgtgggcaagagcagcctggtgctgcgctttgtgaagggccagttccacgagtaccaggagagcaccatcggggccgccttcctgacccagacagtgtgcctggatgacaccaccgtgaagtttgagatctgggacacagctggccaggagcgctaccacagcctggcccccatgtactacagaggagcccaggccgccatcgtggtgtatgacatcaccaacacagacacctttgcccgggccaagaactgggtgaaggagctgcagaggcaggccagccccaacatcgtgattgccctggccggcaacaaggctgacctggccagcaagagagctgtggagttccaggaggcccaggcctatgcagatgacaacagcctgctcttcatggagaccagcgccaagacagccatgaatgtgaatgagatcttcatggccatcgccaagaagctgcccaagaatgagccccagaatgccactggagcccctggcaggaacagaggagtggacctgcaggagaacaacccagccagccgcagccagtgctgcagcaactag

SEQ ID NO: 166941 - DNA, 651 bp, Artificial Sequence; identical to SEQ ID NO: 166940
  Description of Artificial Sequence: Synthetic coding sequence

SEQ ID NO: 166942 - DNA, 750 bp, Artificial Sequence
  Description of Artificial Sequence: Synthetic coding sequence
atggagctgtcctggaggagccccagccccctgagcgccagcctgcacagcaccagcccccacccccacgccctgtggaccaccacagctggccgggccatggccggccggggcggggccgcccggcccaacggccctgctgctggcaacaagatctgccagttcaagctggtgctgctgggggagagcgctgtgggcaagagcagcctggtgctgcgctttgtgaagggccagttccacgagtaccaggagagcaccatcggggccgccttcctgacccagacagtgtgcctggatgacaccaccgtgaagtttgagatctgggacacagctggccaggagcgctaccacagcctggcccccatgtactacagaggagcccaggccgccatcgtggtgtatgacatcaccaacacagacacctttgcccgggccaagaactgggtgaaggagctgcagaggcaggccagccccaacatcgtcatcgccctggccggcaacaaggctgacctggccagcaagagagctgtggagttccaggaggcccaggcctatgcagatgacaacagcctgctcttcatggagaccagcgccaagacagccatgaatgtgaatgagatcttcatggccatcgccaagaagctgcccaagaatgagccccagaatgccaccggggcccctggaagaaacagaggagtggacctgcaggagaacaacccagccagccgcagccagtgctgcagcaactag

SEQ ID NO: 166943 - DNA, 225 bp, Artificial Sequence
  Description of Artificial Sequence: Synthetic coding sequence
atggccggccggggcggggccgcccggcccaatggacctgctgctggcaacaagatctgccagttcaagctggtgctgctgggggagagcgctgtgggcaagagcagcctggtgctgcgctttgtgaagggccagttccacgagtaccaggagagcaccatcggggccgccttcctgacccagacagtgtgcctggatgacaccaccgtgaagtttgagatctag

SEQ ID NO: 166944 - DNA, 279 bp, Artificial Sequence
  Description of Artificial Sequence: Synthetic coding sequence
atggccggccggggcggggccgcccggcccaatggacctgctgctggcaacaagatctgccagttcaagctggtgctgctgggggagagcgctgtgggcaagagcagcctggtgctgcgctttgtgaagggccagttccacgagtaccaggagagcaccatcggggccgccttcctgacccagacagtgtgcctggatgacaccaccgtgaagtttgagatctgggacacagctggccaggagcgctaccacagcctggcccccatgtactacagatag

SEQ ID NO: 166945 - DNA, 375 bp, Artificial Sequence
  Description of Artificial Sequence: Synthetic coding sequence
atggccggccggggcggggccgcccggcccaatggacctgctgctggcaacaagatctgccagttcaagctggtgctgctgggggagagcgctgtgggcaagagcagcctggtgctgcgctttgtgaagggccagttccacgagtaccaggagagcaccatcggggccgccttcctgacccagacagtgtgcctggatgacaccaccgtgaagtttgagatctgggacacagctggccaggagcgctaccacagcctggcccccatgtactacagaggagcccaggccgccatcgtggtgtatgacatcaccaacacagacacctttgcccgggccaagaactgggtgaaggagctgcagaggcaggccagctag

SEQ ID NO: 166946 - DNA, 627 bp, Artificial Sequence
  Description of Artificial Sequence: Synthetic coding sequence
atgagcactggaggagactttggaaaccccctgaggaagttcaagctggtgttcctgggggagcagagcgtgggcaagaccagcctcatcacccgcttcatgtatgacagctttgacaacacctaccaggccaccatcggcatcgacttcctgagcaagaccatgtacctggaggacaggaccatccggctgcagctgtgggacacagctggccaggagcgcttccgcagcctcatccccagctacatccgggacagcgctgctgctgtggtggtgtatgacatcaccaacgtgaacagcttccagcagaccaccaagtggattgatgatgtgaggacagagcggggcagtgatgtgatcatcatgctggtgggcaacaagacagacctggccgacaagaggcaggtgtccattgaggagggggagaggaaggccaaggagctgaatgtgatgtttattgagaccagcgccaaggccggctacaacgtgaagcagctgttccggcgggtggccgccgccctgcccggcatggagagcacccaggacaggagccgggaggacatgattgacatcaagctggagaagccccaggagcagcctgtgtctgagggcggctgcagctgctag

SEQ ID NO: 166947 - DNA, 627 bp, Artificial Sequence
  Description of Artificial Sequence: Synthetic coding sequence
atgagcactggaggagactttggaaaccccctgaggaagttcaagctggtgttcctgggggagcagagcgtgggcaagaccagcctcatcacccgcttcatgtatgacagctttgacaacacctaccaggccaccatcggcatcgacttcctgagcaagaccatgtacctggaggacagaacagtgcggctgcagctgtgggacacagctggccaggagcgcttccgcagcctcatccccagctacatccgggacagcacagtggccgtggtggtgtatgacatcaccaacgtgaacagcttccagcagaccaccaagtggattgatgatgtgaggacagagcggggcagtgatgtgatcatcatgctggtgggcaacaagacagacctggccgacaagaggcaggtgtccattgaggagggggagaggaaggccaaggagctgaatgtgatgtttattgagaccagcgccaaggccggctacaacgtgaagcagctgttccggcgggtggccgccgccctgcccggcatggagagcacccaggacaggagccgggaggacatgattgacatcaagctggagaagccccaggagcagcctgtgtctgagggcggctgcagctgctag

SEQ ID NO: 166948 - DNA, 627 bp, Artificial Sequence; identical to SEQ ID NO: 166946
  Description of Artificial Sequence: Synthetic coding sequence

SEQ ID NO: 166949 - DNA, 525 bp, Artificial Sequence
  Description of Artificial Sequence: Synthetic coding sequence
tgacccctgaggaagttcaagctggtgttcctgggggagcagagcgtgggcaagaccagcctcatcacccgcttcatgtatgacagctttgacaacacctaccaggccaccatcggcatcgacttcctgagcaagaccatgtacctggaggacagaacagtgcggctgcagctgtgggacacagctggccaggagcgcttccgcagcctcatccccagctacatccgggacagcacagtggccgtggtggtgtatgacatcaccaacgtgaacagcttccagcagaccaccaagtggattgatgatgtgaggacagagcggggcagtgatgtgatcatcatgctggtgggcaacaagacagacctggccgacaagaggcaggtgtccattgaggagggggagaggaaggccaaggagctgaatgtgatgtttattgagaccagcgccaaggccggctacaacgtgaagcagagaattggcagctgccacgtggcccaggccagcctggagctgctggacagctag

SEQ ID NO: 166950 - DNA, 225 bp, Artificial Sequence
  Description of Artificial Sequence: Synthetic coding sequence
atgagcactggaggagactttggaaaccccctgaggaagttcaagctggtgttcctgggggagcagagcgtgggcaagaccagcctcatcacccgcttcatgtatgacagctttgacaacacctaccaggccaccatcggcatcgacttcctgagcaagaccatgtacctggaggacagaacagtgcggctgcagctgtgggacacagctggccaggagaggtag

SEQ ID NO: 166951 - DNA, 528 bp, Artificial Sequence
  Description of Artificial Sequence: Synthetic coding sequence
atgtatgacagctttgacaacacctaccaggccaccatcggcatcgacttcctgagcaagaccatgtacctggaggacaggaccatccggctgcagctgtgggacacagctggccaggagcgcttccgcagcctcatccccagctacatccgggacagcgctgctgctgtggtggtgtatgacatcaccaacgtgaacagcttccagcagaccaccaagtggattgatgatgtgaggacagagcggggcagtgatgtgatcatcatgctggtgggcaacaagacagacctggccgacaagaggcaggtgtccattgaggagggggagaggaaggccaaggagctgaatgtgatgttcatcgagaccagcgccaaggccggctacaacgtgaagcagctgttcagaagagtggccgccgccctgcccggcatggagagcacccaggacaggagccgggaggacatgattgacatcaagctggagaagccccaggagcagcctgtgtctgagggcggctgcagctgctag

SEQ ID NO: 166952 - DNA, 429 bp, Artificial Sequence
  Description of Artificial Sequence: Synthetic coding sequence
atgagcactggaggagactttggaaaccccctgaggaagttcaagctggtgttcctgggggagcagagcgtgggcaagaccagcctcatcacccgcttcatgtatgacagctttgacaacacctaccaggccaccatcggcatcgacttcctgagcaagaccatgtacctggaggacaggaccatccggctgcagctgtgggacacagctggccaggagcgcttccgcagcctcatccccagctacatccgggacagcgctgctgctgtggtggtgtatgacatcaccaacgtgaacagcttccagcagaccaccaagtggattgatgatgtgaggacagagcggggcagtgatgtgatcatcatgctggtgggcaacaagacagacctggccgacaagaggcaggtgtccattgaggagggggagtag

SEQ ID NO: 166953 - DNA, 315 bp, Artificial Sequence
  Description of Artificial Sequence: Synthetic coding sequence
atgagcactggaggagactttggaaaccccctgaggaagttcaagctggtgttcctgggggagcagagcgtgggcaagaccagcctcatcacccgcttcatgtatgacagctttgacaacacctaccaggccaccatcggcatcgacttcctgagcaagaccatgtacctggaggacaggaccctcttccggcgggtggccgccgccctgcccggcatggagagcacccaggacaggagccgggaggacatgattgacatcaagctggagaagccccaggagcagcctgtgtctgagggcggctgcagctgctag

SEQ ID NO: 166954 - DNA, 606 bp, Artificial Sequence
  Description of Artificial Sequence: Synthetic coding sequence
tgagtgttcccccggggcctggccctgcggtctgcagatgtggtggaggtgggcaagaccagcctcatcacccgcttcatgtatgacagctttgacaacacctaccaggccaccatcggcatcgacttcctgagcaagaccatgtacctggaggacaggaccatccggctgcagctgtgggacacagctggccaggagcgcttccgcagcctcatccccagctacatccgggacagcgctgctgctgtggtggtgtatgacatcaccaacgtgaacagcttccagcagaccaccaagtggattgatgatgtgaggacagagcggggcagtgatgtgatcatcatgctggtgggcaacaagacagacctggccgacaagaggcaggtgtccattgaggagggggagaggaaggccaaggagctgaatgtgatgttcatcgagaccagcgccaaggccggctacaacgtgaagcagctgttcagaagagtggccgccgccctgcccggcatggagagcacccaggacaggagccgggaggacatgattgacatcaagctggagaagccccaggagcagcctgtgtctgagggcggctgcagctgctag

SEQ ID NO: 166955 - DNA, 144 bp, Artificial Sequence
  Description of Artificial Sequence: Synthetic coding sequence
atgagcactggaggagactttggaaaccccctgaggaagttcaagctggtgttcctgggggagcagagcgtgggcaagaccagcctcatcacccgcttcatgtatgacagctttgacaacacctaccaggccaccatcggctag

SEQ ID NO: 166956 - DNA, 765 bp, Artificial Sequence
  Description of Artificial Sequence: Synthetic coding sequence
atgtctgctggaggagactttggaaaccccctgaggaagttcaagctggtgttcctgggggagcagagcgtggccaagaccagcctcatcacccgcttccgctatgacagctttgacaacacctaccaggccatcatcggcatcgacttcctgagcaagaccatgtacctggaggatggcaccatcggcctgcggctgtgggacacagctggccaggagcggctgcggagcctcatcccccgctacatccgggacagcgctgctgctgtggtggtgtatgacatcaccaacgtgaacagcttccagcagaccaccaagtggattgatgatgtgaggacagagcggggcagtgatgtgatcatcaccctggtgggcaacagaacagacctggccgacaagaggcaggtgtctgtggaggagggggagaggaaggccaagggcctgaatgtgaccttcatcgagacccgggccaaggccggctacaacgtgaagcagctgttccggcgggtggccgccgccctgcccggcatggagagcacccaggacggcagccgggaggacatgtctgacatcaagctggagaagccccaggagcagacagtgtctgagggcggctgcagctgctacagccccatgagcagcagcaccctgccccagaagccaccctacagcttcatcgactgcagcgtgaacatcggcctgaacctcttccccagcctcatcaccttctgcaacagcagcctgctgcctgtgtcctggaggtag

SEQ ID NO: 166957 - DNA, 612 bp, Artificial Sequence
  Description of Artificial Sequence: Synthetic coding sequence
atgggcagccgggaccacctgttcaaggtgctggtggtgggagatgctgctgtgggcaagaccagcctggtgcagcgctacagccaggacagcttcagcaagcactacaagagcacagtgggcgtggactttgccctgaaggtgctgcagtggagcgactatgagatcgtgcggctgcagctgtgggacattgctggccaggagcgcttcacctccatgacccggctgtactacagagatgccagcgcctgcgtcatcatgtttgatgtgaccaatgccaccaccttcagcaacagccagcgctggaagcaggacctggacagcaagctgaccctgcccaacggggagcctgtgccctgcctgctgctggccaacaagtgtgacctgagcccctgggccgtgtcccgggaccagattgaccgcttcagcaaagaaaatggcttcaccggctggacagagacctctgtgaaggagaacaagaacatcaatgaggccatgagggtgctgattgagaagatgatgaggaacagcacagaggacatcatgagcctgagcacccagggcgactacatcaacctgcagaccaagagcagctcctggagctgctgctag

SEQ ID NO: 166958 - DNA, 612 bp, Artificial Sequence; identical to SEQ ID NO: 166957
  Description of Artificial Sequence: Synthetic coding sequence

SEQ ID NO: 166959 - DNA, 612 bp, Artificial Sequence; identical to SEQ ID NO: 166957
  Description of Artificial Sequence: Synthetic coding sequence

SEQ ID NO: 166960 - DNA, 396 bp, Artificial Sequence
  Description of Artificial Sequence: Synthetic coding sequence
atgacccggctgtactacagagatgccagcgcctgcgtcatcatgtttgatgtgaccaatgccaccaccttcagcaacagccagcgctggaagcaggacctggacagcaagctgaccctgcccaacggggagcctgtgccctgcctgctgctggccaacaagtgtgacctgagcccctgggccgtgtcccgggaccagattgaccgcttcagcaaagaaaatggcttcaccggctggacagagacctctgtgaaggagaacaagaacatcaatgaggccatgagggtgctgattgagaagatgatgaggaacagcacagaggacatcatgagcctgagcacccagggcgactacatcaacctgcagaccaagagcagctcctggagctgctgctag

SEQ ID NO: 166961 - DNA, 540 bp, Artificial Sequence
  Description of Artificial Sequence: Synthetic coding sequence
atgggcagccgggaccacctgttcaaggtgctggtggtgggagatgctgctgtgggcaagaccagcctggtgcagcgctacagccaggacagcttcagcaagcactacaagagcacagtgggcggccaggagcgcttcacctccatgacccggctgtactacagagatgccagcgcctgcgtcatcatgtttgatgtgaccaatgccaccaccttcagcaacagccagcgctggaagcaggacctggacagcaagctgaccctgcccaacggggagcctgtgccctgcctgctgctggccaacaagtgtgacctgagcccctgggccgtgtcccgggaccagattgaccgcttcagcaaagaaaatggcttcaccggctggacagagacctctgtgaaggagaacaagaacatcaatgaggccatgagggtgctgattgagaagatgatgaggaacagcacagaggacatcatgagcctgagcacccagggcgactacatcaacctgcagaccaagagcagctcctggagctgctgctag

SEQ ID NO: 166962 - DNA, 624 bp, Artificial Sequence
  Description of Artificial Sequence: Synthetic coding sequence
atggccaagacctatgactacctgttcaagctgctgctgattggagacagcggcgtgggcaagacctgtgtgctcttccgcttctctgaagatgccttcaacagcaccttcatcagcaccatcggcatcgacttcaagatccgcaccatcgagctggatggcaagaggatcaagctgcagatctgggacacagctggccaggagcgcttccgcaccatcaccacagcctactacagaggagccatgggcatcatgctggtgtatgacatcaccaatgagaagagctttgacaacatccggaactggatccggaacatcgaggagcacgccagcgcagatgtggagaagatgatcctgggcaacaagtgtgatgtgaatgacaagaggcaggtgtccaaggagcggggggagaagctggccctggactatggcatcaagttcatggagaccagcgccaaggccaacatcaacgtggagaatgccttcttcaccctggcccgggacatcaaggccaagatggacaagaagctggagggcaacagcccccagggcagcaaccagggcgtgaagatcaccccagaccagcagaagaggagcagcttcttccgctgtgtgctgctgtag

SEQ ID NO: 166963 - DNA, 606 bp, Artificial Sequence
  Description of Artificial Sequence: Synthetic coding sequence
atgtctgggaagagcctgctgctgaaggtgatcctgctgggagatggaggagtgggcaagagcagcctgatgaacagatatgtgaccaacaagtttgacagccaggccttccacaccatcggcgtggagttcctgaacagagacctggaggtggatggccgctttgtgaccctgcagatctgggacacagctggccaggagcgcttcaagagcctgcggacccccttctacagaggagctgactgctgcctgctgaccttctctgtggatgaccggcagagctttgagaacctgggcaactggcagaaggagttcatctactatgcagatgtgaaggaccctgagcacttcccctttgtggtgctgggcaacaaggtggacaaggaggaccggcaggtgaccacagaggaggcccagacctggtgcatggagaatggagactacccctacctggagaccagcgccaaggatgacaccaacgtgacagtggcctttgaggaggccgtgcggcaggtgctggccgtggaggagcagctggagcactgcatgctgggccacaccatcgacctgaacagcggcagcaaggccggcagcagctgctgctag

SEQ ID NO: 166964 - DNA, 2589 bp, Artificial Sequence
  Description of Artificial Sequence: Synthetic coding sequence
atggcccagcccggccctgccagccagccagatgtgtccctgcagcagagggtggccgagctggagaagatcaatgctgagttcctgcgggcccagcagcagctggagcaggagttcaaccagaagagggccaagttcaaggagctgtacctggccaaggaggaggacctgaagaggcagaatgctgtgctgcaggccgcccaggatgacctgggccacctgcggacccagctgtgggaggcccaggccgagatggagaacatcaaggccatcgccaccgtgtctgagaacaccaagcaggaggccattgatgaggtgaagaggcagtggagggaggaggtggccagcctgcaggccgtgatgaaggagaccgtgcgggactatgagcaccagttccacctgcggctggagcaggagaggacccagtgggcccagtaccgggagagcgctgagcgggagattgctgacctgcggcggcggctgtctgagggccaggaggaggagaacctggagaatgagatgaagaaggcccaggaggatgctgagaagctgcggtctgtggtgatgcccatggagaaggagattgctgccctgaaggacaagctgacagaagctgaggacaagatcaaggagctggaggccagcaaggtgaaggagctgaaccactacctggaggccgagaagagctgcaggacagacctggagatgtatgtggccgtgctgaacacccagaagtctgtgctgcaggaggatgctgagaagctgaggaaggagctgcacgaggtgtgccacctgctggagcaggagcggcagcagcacaaccagctgaagcacacctggcagaaggccaatgaccagttcctggagagccagaggctgctgatgagggacatgcagaggatggagatcgtgctgaccagcgagcagctgcggcaggtggaggagctgaagaagaaggaccaggaggatgatgagcagcagaggctgaacaagaggaaggaccacaagaaggcagatgtggaggaggagatcaagatccctgtggtgtgtgccctgacccaggaggagagcagcgcccagctgagcaatgaggaggagcacctggacagcacccggggctctgtgcacagcctggatgctggcctgctgctgcccagcggggaccccttcagcaagagtgacaatgacatgttcaaggatggcctgcggcgggcccagagcacagacagcctgggcaccagcggcagcctgcagagcaaggccctgggctacaactacaaggccaagtctgctggcaacctggatgaaagtgactttggccccctggtgggcgctgacagcgtgtctgagaactttgacacagccagcctgggcagcctgcagatgcccagcggcttcatgctgaccaaggaccaggagcgggccatcaaggccatgaccccagagcaggaggagacagccagcctgctgagctctgtgacccagggcatggagagcgcctacgtgagccccagcggctaccgcctggtgtctgaaacagagtggaacctgctgcagaaggaggtgcacaatgccggcaacaagctgggcagaagatgtgacatgtgcagcaactatgagaagcagctgcagggcatccagatccaggaggccgagacccgggaccaggtgaagaagctgcagctgatgctgcggcaggccaatgaccagctggagaagaccatgaaggacaagcaggagctggaggacttcatcaagcagagcagcgaggacagcagccaccagatcagcgccctggtgctgcgggcccaggccagcgagatcctgctggaggagctgcagcagggcctgagccaggccaagagagatgtgcaggagcagatggctgtgctgatgcagagccgggagcaggtgtctgaggagctggtgcggctgcagaaggacaatgacagcctgcagggcaagcacagcctgcacgtgtccctgcagcaggccgaggacttcatcctgcctgacaccacagaggccctgcgggagctggtgctgaagtaccgggaggacatcatcaacgtgaggacagctgctgaccacgtggaggagaagctgaaggccgagatcctcttcctgaaggagcagatccaggccgagcagtgcctgaaggagaacctggaggagaccctgcagctggagattgagaactgcaaggaggagatcgccagcatcagcagcctgaaggccgagctggagcgcatcaaggtggagaagggccagctggagagcaccctgcgggagaagagccagcagctggagagcctgcaggagatcaagatcagcctggaggagcagctgaagaaggagacagctgccaaggccaccgtggagcagctgatgtttgaggagaagaacaaggcccagaggctgcagacagagctggatgtgtctgagcaggtgcagagggactttgtgaagctgagccagaccctgcaggtgcagctggagcgcatccggcaggccgacagcctggagcgcatccgggccatcctgaatgacaccaagctgacagacatcaaccagctgcctgagacctag

SEQ ID NO: 166965 - DNA, 2490 bp, Artificial Sequence
  Description of Artificial Sequence: Synthetic coding sequence
atggcccagcccggccctgccagccagccagatgtgtccctgcagcagagggtggccgagctggagaagatcaatgctgagttcctgcgggcccagcagcagctggagcaggagttcaaccagaagagggccaagttcaaggagctgtacctggccaaggaggaggacctgaagaggcagaatgctgtgctgcaggccgcccaggatgacctgggccacctgcggacccagctgtgggaggcccaggccgagatggagaacatcaaggccatcgccaccgtgtctgagaacaccaagcaggaggccattgatgaggtgaagaggcagtggagggaggaggtggccagcctgcaggccgtgatgaaggagaccgtgcgggactatgagcaccagttccacctgcggctggagcaggagaggacccagtgggcccagtaccgggagagcgctgagcgggagattgctgacctgcggcggcggctgtctgagggccaggaggaggagaacctggagaatgagatgaagaaggcccaggaggatgctgagaagctgcggtctgtggtgatgcccatggagaaggagattgctgccctgaaggacaagctgacagaagctgaggacaagatcaaggagctggaggccagcaaggtgaaggagctgaaccactacctggaggccgagaagagctgcaggacagacctggagatgtatgtggccgtgctgaacacccagaagtctgtgctgcaggaggatgctgagaagctgaggaaggagctgcacgaggtgtgccacctgctggagcaggagcggcagcagcacaaccagctgaagcacacctggcagaaggccaatgaccagttcctggagagccagaggctgctgatgagggacatgcagaggatggagatcgtgctgaccagcgagcagctgcggcaggtggaggagctgaagaagaaggaccaggaggatgatgagcagcagaggctgaacaagaggaaggaccacaagaaggcagatgtggaggaggagatcaagatccctgtggtgtgtgccctgacccaggaggagagcagcgcccagctgagcaatgaggaggagcacctggacagcacccggggctctgtgcacagcctggatgctggcctgctgctgcccagcggggaccccttcagcaagagtgacaatgacatgttcaaggatggcctgcggcgggcccagagcacagacagcctgggcaccagcggcagcctgcagagcaaggccctgggctacaactacaaggccaagtctgctggcaacctggatgaaagtgactttggccccctggtgggcgctgacagcgtgtctgagaactttgacacagccagcctgggcagcctgcagatgcccagcggcttcatgctgaccaaggaccaggagcgggccatcaaggccatgaccccagagcaggaggagacagccagcctgctgagctctgtgacccagggcatggagagcgcctacgtgagccccagcggctaccgcctggtgtctgaaacagagtggaacctgctgcagaaggaggtgcacaatgccggcaacaagctgggcagaagatgtgacatgtgcagcaactatgagaagcagctgcagggcatccagatccaggaggccgagacccgggaccaggtgaagaagctgcagctgatgctgcggcaggccaatgaccagctggagaagaccatgaaggacaagcaggagctggaggacttcatcaagcagagcagcgaggacagcagccaccagatcagcgccctggtgctgcgggcccaggccagcgagatcctgctggaggagctgcagcagggcctgagccaggccaagagagatgtgcaggagcagatggctgtgctgatgcagagccgggagcaggtgtctgaggagctggtgcggctgcagaaggacaatgacagcctgcagggcaagcacagcctgcacgtgtccctgcagcaggccgaggacttcatcctgcctgacaccacagaggccctgcgggagctggtgctgaagtaccgggaggacatcatcaacgtgaggacagctgctgaccacgtggaggagaagctgaaggccgagatcctcttcctgaaggagcagatccaggccgagcagtgcctgaaggagaacctggaggagaccctgcagctggagattgagaactgcaaggaggagatcgccagcatcagcagcctgaaggccgagctggagcgcatcaaggtggagaagggccaggccaccgtggagcagctgatgtttgaggagaagaacaaggcccagaggctgcagacagagctggatgtgtctgagcaggtgcagagggactttgtgaagctgagccagaccctgcaggtgcagctggagcgcatccggcaggccgacagcctggagcgcatccgggccatcctgaatgacaccaagctgacagacatcaaccagctgcctgagacctag

SEQ ID NO: 166966 - DNA, 2490 bp, Artificial Sequence; identical to SEQ ID NO: 166965
  Description of Artificial Sequence: Synthetic coding sequence

SEQ ID NO: 166967 - DNA, 2460 bp, Artificial Sequence
  Description of Artificial Sequence: Synthetic coding sequence
atggcccagcccggccctgccagccagccagatgaggacctgaagaggcagaatgctgtgctgcaggccgcccaggatgacctgggccacctgcggacccagctgtgggaggcccaggccgagatggagaacatcaaggccatcgccaccgtgtctgagaacaccaagcaggaggccattgatgaggtgaagaggcagtggagggaggaggtggccagcctgcaggccgtgatgaaggagaccgtgcgggactatgagcaccagttccacctgcggctggagcaggagaggacccagtgggcccagtaccgggagagcgctgagcgggagattgctgacctgcggcggcggctgtctgagggccaggaggaggagaacctggagaatgagatgaagaaggcccaggaggatgctgagaagctgcggtctgtggtgatgcccatggagaaggagattgctgccctgaaggacaagctgacagaagctgaggacaagatcaaggagctggaggccagcaaggtgaaggagctgaaccactacctggaggccgagaagagctgcaggacagacctggagatgtatgtggccgtgctgaacacccagaagtctgtgctgcaggaggatgctgagaagctgaggaaggagctgcacgaggtgtgccacctgctggagcaggagcggcagcagcacaaccagctgaagcacacctggcagaaggccaatgaccagttcctggagagccagaggctgctgatgagggacatgcagaggatggagatcgtgctgaccagcgagcagctgcggcaggtggaggagctgaagaagaaggaccaggaggatgatgagcagcagaggctgaacaagaggaaggaccacaagaaggcagatgtggaggaggagatcaagatccctgtggtgtgtgccctgacccaggaggagagcagcgcccagctgagcaatgaggaggagcacctggacagcacccggggctctgtgcacagcctggatgctggcctgctgctgcccagcggggaccccttcagcaagagtgacaatgacatgttcaaggatggcctgcggcgggcccagagcacagacagcctgggcaccagcggcagcctgcagagcaaggccctgggctacaactacaaggccaagtctgctggcaacctggatgaaagtgactttggccccctggtgggcgctgacagcgtgtctgaaaattttgacacagccagcctgggcagcctgcagatgcccagcggcttcatgctgaccaaggaccaggagcgggccatcaaggccatgaccccagagcaggaggagacagccagcctgctgagctctgtgacccagggcatggagagcgcctacgtgagccccagcggctaccgcctggtgtctgaaacagagtggaacctgctgcagaaggaggtgcacaatgccggcaacaagctgggccgccgctgtgacatgtgcagcaactatgagaagcagctgcagggcatccagatccaggaggccgagacccgggaccaggtgaagaagctgcagctgatgctgcggcaggccaatgaccagctggagaagaccatgaaggacaagcaggagctggaggacttcatcaagcagagcagcgaggacagcagccaccagatcagcgccctggtgctgcgggcccaggccagcgagatcctgctggaggagctgcagcagggcctgagccaggccaagagagatgtgcaggagcagatggctgtgctgatgcagagccgggagcaggtgtctgaggagctggtgcggctgcagaaggacaatgacagcctgcagggcaagcacagcctgcacgtgtccctgcagcaggccgaggacttcatcctgcctgacaccacagaggccctgcgggagctggtgctgaagtaccgggaggacatcatcaacgtgaggacagctgctgaccacgtggaggagaagctgaaggccgagatcctcttcctgaaggagcagatccaggccgagcagtgcctgaaggagaacctggaggagaccctgcagctggagattgagaactgcaaggaggagatcgccagcatcagcagcctgaaggccgagctggagcgcatcaaggtggagaagggccagctggagagcaccctgcgggagaagagccagcagctggagagcctgcaggagatcaagatcagcctggaggagcagctgaagaaggagacagctgccaaggccaccgtggagcagctgatgtttgaggagaagaacaaggcccagaggctgcagacagagctggatgtgtctgagcaggtgcagagggactttgtgaagctgagccagaccctgcaggtgcagctggagcgcatccggcaggccgacagcctggagcgcatccgggccatcctgaatgacaccaagctgacagacatcaaccagctgcctgagacctag

SEQ ID NO: 166968 - DNA, 2151 bp, Artificial Sequence
  Description of Artificial Sequence: Synthetic coding sequence
atggcccagcccggccctgccagccagccagatgtgtccctgcagcagagggtggccgagctggagaagatcaatgctgagttcctgcgggcccagcagcagctggagcaggagttcaaccagaagagggccaagttcaaggagctgtacctggccaaggaggaggacctgaagaggcagaatgctgtgctgcaggccgcccaggatgacctgggccacctgcggacccagctgtgggaggcccaggccgagatggagaacatcaaggccatcgccaccgtgtctgagaacaccaagcaggaggccattgatgaggtgaagaggcagtggagggaggaggtggccagcctgcaggccgtgatgaaggagaccgtgcgggactatgagcaccagttccacctgcggctggagcaggagaggacccagtgggcccagtaccgggagagcgctgagcgggagattgctgacctgcggcggcggctgtctgagggccaggaggaggagaacctggagaatgagatgaagaaggcccaggaggatgctgagaagctgcggtctgtggtgatgcccatggagaaggagattgctgccctgaaggacaagctgacagaagctgaggacaagatcaaggagctggaggccagcaaggtgaaggagctgaaccactacctggaggccgagaagagctgcaggacagacctggagatgtatgtggccgtgctgaacacccagaagtctgtgctgcaggaggatgctgagaagctgaggaaggagctgcaccaggagcggcagcagcacaaccagctgaagcacacctggcagaaggccaatgaccagttcctggagagccagaggctgctgatgagggacatgcagaggatggagatcgtgctgaccagcgagcagctgcggcaggtggaggagctgaagaagaaggaccaggaggatgatgagcagcagaggctgaacaagaggaaggaccacaagaaggcagatgtggaggaggagatcaagatccctgtggtgtgtgccctgacccaggaggagagcagcgcccagctgagcaatgaggaggagcacctggacagcacccggggctctgtgcacagcctggatgctggcctgctgctgcccagcggggaccccttcagcaagagtgacaatgacatgttcaaggatggcctgcggcgggcccagagcacagacagcctgggcaccagcggcagcctgcagagcaaggccctgggctacaactacaaggccaagtctgctggcaacctggatgaaagtgactttggccccctggtgggcgctgacagcgtgtctgaaaattttgacacagccagcctgggcagcctgcagatgcccagcggcttcatgctgaccaaggaccaggagcgggccatcaaggccatgaccccagagcaggaggagacagccagcctgctgagctctgtgacccagggcatggagagcgcctacgtgagccccagcggctaccgcctggtgtctgaaacagagtggaacctgctgcagaaggaggtgcacaatgccggcaacaagctgggccgccgctgtgacatgtgcagcaactatgagaagcagctgcagggcatccagatccaggaggccgagacccgggaccaggtgaagaagctgcagctgatgctgcggcaggccaatgaccagctggagaagaccatgaaggacaagcaggagctggaggacttcatcaagcagagcagcgaggacagcagccaccagatcagcgccctggtgctgcgggcccaggccagcgagatcctgctggaggagctgcagcagggcctgagccaggccaagagagatgtgcaggagcagatggctgtgctgatgcagagccgggagcaggtgtctgaggagctggtgcggctgcagaaggacaatgacagcctgcagggcaagcacagcctgcacgtgtccctgcagcaggccgaggacttcatcctgcctgacaccacagaggccctgcgggagctggtgctgaagtaccgggaggacatcatcaacgtgaggacagctgctgaccacgtggaggagaagctgaaggccgagatcctcttcctgaaggagcagatccaggccgagcagtgcctgaagaagaagaagtag

SEQ ID NO: 166969 - DNA, 2589 bp, Artificial Sequence; identical to SEQ ID NO: 166964
  Description of Artificial Sequence: Synthetic coding sequence

SEQ ID NO: 166970 - DNA, 1602 bp, Artificial Sequence
  Description of Artificial Sequence: Synthetic coding sequence
atggctgctgctgcccctgtggccgcagatgatgatgagaggagaagaagacctggggccgccctggaggacagccgcagccaggagggcgccaacggggaggccgagagcggggagctgagccggctgcgggcagagctggccggggccctggccgagatggagaccatgaaggctgtggccgaggtgtctgagagcaccaaggccgaggccgtggccgctgtgcagaggcagtgccaggaggaggtggccagcctgcaggccatcctgaaggacagcatcagcagctatgaggcccagatcacagccctgaagcaggagcggcagcagcagcagcaggactgtgaggagaaggagcgggagctgggccgcctgaagcagctgctgagccgggcctaccccctggacagcctggagaagcagatggagaaggcccatgaagattctgagaagctgcgggagatcgtgctgcccatggagaaggagattgaggagctgaaggccaagctgctgcgggcagaggagctgatccaggagatccagaggcggcccaggcatgcccccagcctgcacggcagcacagagctgctgcccctgagccgggaccccagcccccccctggagcccctggaggagctgtctggagatggcggccctgctgctgaggcctttgcccacaactgtgatgattctgccagcatcagcagcttcagcctgggcggcggcgtgggcagcagcagcagcctgccccagagccggcagggcctgagccctgagcaggaggagacagccagcctggtgtccacaggcaccctggtgcctgagggcatctacctgcccccacctggctaccagctggtgcctgacacccagtgggagcagctgcagacagagatgcaggtgctgctggcccaggtgcagaacagcgagcagctgctgcggaccctgcagggcaccgtgtcccaggcccaggagcgggtgcagctgcagatggccgagctggtgaccacccacaagtgcctgcaccacgaggtgaagaggctgaatgaggagaaccagggcctgcgggcagagcagctgcccagcagcgccccccagggcagccagcaggagcagggcgaggaggagagcctgcccagctctgtgcctgagctgcagcagctgctgtgctgcacccggcaggaggcccgggcccggctgcaggcccaggagcacggggctgagcggctgcgcatcgagatcgtgaccctgcgggaggccctggaggaggagaccgtggcccgggccagcctggagggccagctgcgggtgcagcgggaggagacagccagcctgtgcagcctgaggacagagatggagcgggtgcagcaggagcagagcaaggcccagctgcctgacctgctgtctgagcagagggccaaggtgctgcggctgcaggccgagctggagaccagcgagcaggtgcagagggactttgtgcggctgagccaggccctgcaggtgcggctggagcgcatccggcaggccgagaccctggagcaggtgcgcagcatcatggatgaggcccccctgacagatgtgcgggacatcaaggacacctag

SEQ ID NO: 166971 - DNA, 1710 bp, Artificial Sequence
  Description of Artificial Sequence: Synthetic coding sequence
atggctgctgctgcccctgtggccgcagatgatgatgagaggagaagaagacctggggccgccctggaggacagccgcagccaggagggcgccaacggggaggccgagagcggggagctgagccggctgcgggcagagctggccggggccctggccgagatggagaccatgaaggctgtggccgaggtgtctgagagcaccaaggccgaggccgtggccgctgtgcagaggcagtgccaggaggaggtggccagcctgcaggccatcctgaaggacagcatcagcagctatgaggcccagatcacagccctgaagcaggagcggcagcagcagcagcaggactgtgaggagaaggagcgggagctgggccgcctgaagcagctgctgagccgggcctaccccctggacagcctggagaagcagatggagaaggcccatgaagattctgagaagctgcgggagatcgtgctgcccatggagaaggagattgaggagctgaaggccaagctgctgcgggcagaggagctgatccaggagatccagaggcggcccaggcatgcccccagcctgcacggcagcacagagctgctgcccctgagccgggaccccagcccccccctggagcccctggaggagctgtctggagatggcggccctgctgctgaggcctttgcccacaactgtgatgattctgccagcatcagcagcttcagcctgggcggcggcgtgggcagcagcagcagcctgccccagagccggcagggcctgagccctgagcaggaggagacagccagcctggtgtccacaggcaccctggtgcctgagggcatctacctgcccccacctggctaccagctggtgcctgacacccagtgggagcagctgcagacagagggccggcagctgcagaaggacctggagagcgtgtcccgggagagagatgagctgcaggagggcctgcggcgcagcaatgaagactgtgccaagcagatgcaggtgctgctggcccaggtgcagaacagcgagcagctgctgcggaccctgcagggcaccgtgtcccaggcccaggagcgggtgcagctgcagatggccgagctggtgaccacccacaagtgcctgcaccacgaggtgaagaggctgaatgaggagaaccagggcctgcgggcagagcagctgcccagcagcgccccccagggcagccagcaggagcagggcgaggaggagagcctgcccagctctgtgcctgagctgcagcagctgctgtgctgcacccggcaggaggcccgggcccggctgcaggcccaggagcacggggctgagcggctgcgcatcgagatcgtgaccctgcgggaggccctggaggaggagaccgtggcccgggccagcctggagggccagctgcgggtgcagcgggaggagacagaggtgctggaggccagcctgtgcagcctgaggacagagatggagcgggtgcagcaggagcagagcaaggcccagctgcctgacctgctgtctgagcagagggccaaggtgctgcggctgcaggccgagctggagaccagcgagcaggtgcagagggactttgtgcggctgagccaggccctgcaggtgcggctggagcgcatccggcaggccgagaccctggagcaggtgcgcagcatcatggatgaggcccccctgacagatgtgcgggacatcaaggacacctag

SEQ ID NO: 166972 - DNA, 1497 bp, Artificial Sequence
  Description of Artificial Sequence: Synthetic coding sequence
atggctgctgctgcccctgtggccgcagatgatgatgagaggagaagaagacctggagctgacagcatcagcagctatgaggcccagatcacagccctgaagcaggagcggcagcagcagcagcaggactgtgaggagaaggagcgggagctgggccgcctgaagcagctgctgagccgggcctaccccctggacagcctggagaagcagatggagaaggcccacgaggacagcgagaagctgcgggagatcgtgctgcccatggagaaggagattgaggagctgaaggccaagctgctgcgggcagaggagctgatccaggagatccagaggcggcccaggcatgcccccagcctgcacggcagcacagagctgctgcccctgagccgggaccccagcccccccctggagcccctggaggagctgtctggagatggcggccctgctgctgaggcctttgcccacaactgtgatgacagcgccagcatcagcagcttcagcctgggcggcggcgtgggcagcagcagcagcctgccccagagccggcagggcctgagccctgagcaggaggagacagccagcctggtgtccacaggcaccctggtgcctgagggcatctacctgcccccacctggctaccagctggtgcctgacacccagtgggagcagctgcagacagagggccggcagctgcagaaggacctggagagcgtgtcccgggagagagatgagctgcaggagggcctgcggcgcagcaatgaagactgtgccaagcagatgcaggtgctgctggcccaggtgcagaacagcgagcagctgctgcggaccctgcagggcaccgtgtcccaggcccaggagcgggtgcagctgcagatggccgagctggtgaccacccacaagtgcctgcaccacgaggtgaagaggctgaatgaggagaaccagggcctgcgggcagagcagctgcccagcagcgccccccagggcagccagcaggagcagggcgaggaggagagcctgcccagctctgtgcctgagctgcagcagctgctgtgctgcacccggcaggaggcccgggcccggctgcaggcccaggagcacggggctgagcggctgagaattgaaattgtgaccctgcgggaggccctggaggaggagaccgtggcccgggccagcctggagggccagctgcgggtgcagcgggaggagacagaggtgctggaggccagcctgtgcagcctgaggacagagatggagcgggtgcagcaggagcagagcaaggcccagctgcctgacctgctgtctgagcagagggccaaggtgctgcggctgcaggccgagctggagaccagcgagcaggtgcagagggactttgtgcggctgagccaggccctgcaggtgcggctggagcgcatccggcaggccgagaccctggagcaggtgcgcagcatcatggatgaggcccccctgacagatgtgcgggacatcaaggacacctag

SEQ ID NO: 166973 - DNA, 2085 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctggagaacatgaggaagaatgtggccggagatggagtgaaccgctgcatcctgtgtggggagcagctgggcatgctgggcagcgcctgtgtggtgtgtgaggactgcaagaagaatgtgtgcaccaagtgtggggtggagaccaacaaccggctgcacagcgtgtggctgtgcaagatctgcatcgagcagcgggaggtgtggaagaggtctggggcctggttcttcaagggcttccccaagcaggtgctgccccagcccatgcccatcaagaagaccaagccccagcagcctgtgtctgagcctgctgcccctgagcagcctgcccctgagcccaagcacccagcccgggccccagcccggggggacagtgaagatagaagaggccctggccagaagacaggccctgaccctgccagcgcccctggccggggcaactacggcccccctgtgcggcgggccagcgaggccaggatgagcagcagcagccgggacagcgagagctgggaccacagcggcggggccggggacagcagccgcagccctgctggcctgcggcgggccaacagcgtgcaggccagcaggcctgcccctggctctgtgcagagccctgccccaccccagcccggccagcccggcaccccaggcggcagccggcccggccctggccctgctggccgcttcccagaccagaagccagaggtggcccccagcgaccccggcaccacagccccaccccgggaggagaggactggaggagtgggcggctacccagctgtgggcgcccgggaggacaggatgagccaccccagcggcccctacagccaggccagcgctgctgccccccagcctgctgctgcccggcagcccccacctcctgaggaggaggaggaggaggccaacagctatgacagtgatgaggccaccaccctgggcgccctggagttcagcctgctgtatgaccaggacaacagcagcctgcagtgcaccatcatcaaggccaagggcctgaagcccatggacagcaatggcctggccgacccctacgtgaagctgcacctgctgcccggggccagcaagagcaacaagctgcggaccaagaccctgaggaacaccaggaaccccatctggaatgagaccctggtgtaccacggcatcacagatgaggacatgcagaggaagaccctgcgcatctctgtgtgtgatgaggacaagtttggccacaatgagttcatcggggagacccgcttcagcctgaagaagctgaagcccaaccagaggaagaacttcaacatctgcctggagagggtcatccccatgaagagagctggcaccaccggcagcgcccggggcatggccctgtatgaggaggagcaggtggagcgggtgggggacatcgaggagcggggcaagatcctggtgtccctgatgtacagcacccagcagggcggcctcatcgtgggcatcatccgctgtgtgcacctggccgccatggatgccaacggctacagcgacccctttgtgaagctgtggctgaagccagacatgggcaagaaggccaagcacaagacccagatcaagaagaagaccctgaaccctgagttcaatgaggagttcttctatgacatcaagcacagcgacctggccaagaagagcctggacatctctgtgtgggactatgacatcggcaagagcaatgactacatcggcggctgccagctgggcatcagcgccaagggggagcggctgaagcactggtatgagtgcctgaagaacaaggacaagaagattgagcgctggcaccagctgcagaatgaaaaccacgtgtccagtgactag

SEQ ID NO: 166974 - DNA, 2085 bp, Artificial Sequence; identical to SEQ ID NO: 166973
  Description of Artificial Sequence: Synthetic coding sequence

SEQ ID NO: 166975 - DNA, 2085 bp, Artificial Sequence; identical to SEQ ID NO: 166973
  Description of Artificial Sequence: Synthetic coding sequence

SEQ ID NO: 166976 - DNA, 1938 bp, Artificial Sequence
  Description of Artificial Sequence: Synthetic coding sequence
atgacagacaccgtcttcagcaacagcagcaaccgctggatgtaccccagcgaccggcccctgcagagcaagctgaaggaccggcggctggtggaccggctggagaacatgaggaagaatgtggccggagatggagtgaaccgctgcatcctgtgtggggagcagctgggcatgctgggcagcgcctgtgtggtgtgtgaggactgcaagaagaatgtgtgcaccaagtgtggggtggagaccaacaaccggctgcacagcgtgtggctgtgcaagatctgcatcgagcagcgggaggtgtggaagaggtctggggcctggttcttcaagggcttccccaagcaggtgctgccccagcccatgcccatcaagaagaccaagccccagcagcctgtgtctgagcctgctgcccctgagcagcctgcccctgagcccaagcacccagcccgggccccagcccggggggacagcgaggaccggcggggccctggccagaagacaggccctgaccctgccagcgcccctggccggggcaactacggcccccctgtgagaagagccagcgaggccaggatgagcagcagcagccgggacagcgagagctgggaccacagcggcggggccggggacagcagccgcagccctgctggcctgcggcgggccaacagcgtgcaggccagcaggcctgcccctggctctgtgcagagccctgccccaccccagcccggccagcccggcacccctgggggcagcaggcctggccctggccctgctggccgcttcccagaccagaagccagaggtggcccccagcgaccccggcaccacagccccaccccgggaggagaggactggaggagtgggcggctacccagctgtgggcgcccgggaggacaggatgagccaccccagcggcccctacagccaggccagcgctgctgccccccagcctgctgctgcccggcagcccccacctcctgaggaggaggaggaggaggccaacagctatgacagtgatgaggccaccaccctgggcgccctggagttcagcctgctgtatgaccaggacaacagcagcctgcagtgcaccatcatcaaggccaagggcctgaagcccatggacagcaatggcctggccgacccctacgtgaagctgcacctgctgcccggggccagcaagagcaacaagctgcggaccaagaccctgaggaacaccaggaaccccatctggaatgagaccctggtgtaccacggcatcacagatgaggacatgcagaggaagaccctgcgcatctctgtgtgtgatgaggacaagtttggccacaatgagttcatcggggagacccgcttcagcctgaagaagctgaagcccaaccagaggaagaacttcaacatctgcctggagagggtcatccccatgaagagagctggcaccactggaagtgcccggggcatggccctgtatgaggaggagcaggtggagcgggtgggggacatcgaggagcggggcaagatcctggtgtccctgatgtacagcacccagcagggcggcctgattgtgggcatcatccgctgtgtgcacctggccgccatggatgccaacggctacagcgacccctttgtgaagctgtggctgaagccagacatgggcaagaaggccaagcacaagacccagatcaagaagaagaccctgaaccctgagttcaatgaggagttcttctatgacatcaagcacagcgacctggccaagaagagcctggacatctctgtgtgggactatgacatcggcaagagcaatgactacatcggcggctgccagctgggcatcagcgccaagggggagcggctgaagcactggtatgaatgtctgaagaacaaggacaagaagattgagcgctggcaccagctgcagaatgaaaatcatgtgtccagtgactag

SEQ ID NO: 166977 - DNA, 2085 bp, Artificial Sequence; identical to SEQ ID NO: 166973
  Description of Artificial Sequence: Synthetic coding sequence

SEQ ID NO: 166978 - DNA, 39 bp, Artificial Sequence
  Description of Artificial Sequence: Synthetic coding sequence
atgacagacaccgtcttcagcaacagcagcaacagatag

SEQ ID NO: 166979 - DNA, 252 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctgtag

SEQ ID NO: 166980 - DNA, 285 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctggagaacatgaggaagaatgtggccggagatggatag

SEQ ID NO: 166981 - DNA, 492 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctggagaacatgaggaagaatgtggccggagatggagtgaaccgctgcatcctgtgtggggagcagctgggcatgctgggcagcgcctgtgtggtgtgtgaggactgcaagaagaatgtgtgcaccaagtgtggggtggagaccaacaaccggctgcacagcgtgtggctgtgcaagatctgcatcgagcagcgggaggtgtggaagaggtctggggcctggttcttcaagggcttccccaagtag

SEQ ID NO: 166982 - DNA, 384 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctggagaacatgaggaagaatgtggccggagatggagtgaaccgctgcatcctgtgtggggagcagctgggcatgctgggcagcgcctgtgtggtgtgtgaggactgcaagaagaatgtgtgcaccaagtgtggctag

SEQ ID NO: 166983 - DNA, 315 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctggagaacatgaggaagaatgtggccggagatggagtgaaccgctgcatcctgtgtggggagcagtag

SEQ ID NO: 166984 - DNA, 120 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggctag

SEQ ID NO: 166985 - DNA, 348 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctggagaacatgaggaagaatgtggccggagatggagtgaaccgctgcatcctgtgtggggagcagctgggcatgctgggcagcgcctgtgtggtgtgctag

SEQ ID NO: 166986 - DNA, 2073 bp, Artificial Sequence
  Description of Artificial Sequence: Synthetic coding sequence
atgacagacaccgtcttcagcaacagcagcaaccgctggatgtaccccagcgaccggcccctgcagagcaagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctggagaacatgaggaagaatgtggccggagatggagtgaaccgctgcatcctgtgtggggagcagctgggcatgctgggcagcgcctgtgtggtgtgtgaggactgcaagaagaatgtgtgcaccaagtgtggggtggagaccaacaaccggctgcacagcgtgtggctgtgcaagatctgcatcgagcagcgggaggtgtggaagaggtctggggcctggttcttcaagggcttccccaagcaggtgctgccccagcccatgcccatcaagaagaccaagccccagcagcctgtgtctgagcctgctgcccctgagcagcctgcccctgagcccaagcacccagcccgggccccagcccggggggacagtgaagatagaagaggccctggccagaagacaggccctgaccctgccagcgcccctggccggggcaactacggcccccctgtgcggcgggccagcgaggccaggatgagcagcagcagccgggacagcgagagctgggaccacagcggcggggccggggacagcagccgcagccctgctggcctgcggcgggccaacagcgtgcaggccagcaggcctgcccctggctctgtgcagagccctgccccaccccagcccggccagcccggcaccccaggcggcagccggcccggccctggccctgctggccgcttcccagaccagaagccagaggtggcccccagcgaccccggcaccacagccccaccccgggaggagaggactggaggagtgggcggctacccagctgtgggcgcccgggaggacaggatgagccaccccagcggcccctacagccaggccagcgctgctgccccccagcctgctgctgcccggcagcccccacctcctgaggaggaggaggaggaggccaacagctatgacagtgatgaggccaccaccctgggcgccctggagttcagcctgctgtatgaccaggacaacagcagcctgcagtgcaccatcatcaaggccaagggcctgaagcccatggacagcaatggcctggccgacccctacgtgaagctgcacctgctgcccggggccagcaagagcaacaagctgcggaccaagaccctgaggaacaccaggaaccccatctggaatgagaccctggtgtaccacggcatcacagatgaggacatgcagaggaagaccctgcgcatctctgtgtgtgatgaggacaagtttggccacaatgagttcatcggggagacccgcttcagcctgaagaagctgaagcccaaccagaggaagaacttcaacatctgcctggagagggtcatccccatgaagagagctggcaccaccggcagcgcccggggcatggccctgtatgaggaggagcaggtggagcgggtgggggacatcgaggagcggggcaagatcctggtgtccctgatgtacagcacccagcagggcggcctcatcgtgggcatcatccgctgtgtgcacctggccgccatggatgccaacggctacagcgacccctttgtgaagctgtggctgaagccagacatgggcaagaaggccaagcacaagacccagatcaagaagaagaccctgaaccctgagttcaatgaggagttcttctatgacatcaagcacagcgacctggccaagaagagcctggacatctctgtgtgggactatgacatcggcaagagcaatgactacatcggcggctgccagctgggcatcagcgccaagggggagcggctgaagcactggtatgagtgcctgaagaacaaggacaagaagattgagcgctggcaccagctgcagaatgaaaaccacgtgtccagtgactag

SEQ ID NO: 166987 - DNA, 378 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctggagaacatgaggaagaatgtggccggagatggagtgaaccgctgcatcctgtgtggggagcagctgggcatgctgggcagcgcctgtgtggtgtgtgaggactgcaagaagaatgtgtgcaccaagtag

SEQ ID NO: 166988 - DNA, 546 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctggagaacatgaggaagaatgtggccggagatggagtgaaccgctgcatcctgtgtggggagcagctgggcatgctgggcagcgcctgtgtggtgtgtgaggactgcaagaagaatgtgtgcaccaagtgtggggtggagaccaacaaccggctgcacagcgtgtggctgtgcaagatctgcatcgagcagcgggaggtgtggaagaggtctggggcctggttcttcaagggcttccccaagcaggtgctgccccagcccatgcccatcaagaagaccaagccccagcagcctgtgtag

SEQ ID NO: 166989 - DNA, 285 bp, Artificial Sequence; identical to SEQ ID NO: 166980
  Description of Artificial Sequence: Synthetic coding sequence

SEQ ID NO: 166990 - DNA, 363 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctggagaacatgaggaagaatgtggccggagatggagtgaaccgctgcatcctgtgtggggagcagctgggcatgctgggcagcgcctgtgtggtgtgtgaggactgcaagaagtag

SEQ ID NO: 166991 - DNA, 405 bp, Artificial Sequence
  Description of Artificial Sequence: Synthetic coding sequence
atgacagacaccgtcttcagcaacagcagcaaccgctggatgtaccccagcgaccggcccctgcagagcaatgacaaggagcagctgcaggccggctggagcgtgcaccctgggggccagcctgaccggcagaggaagcaggaggagctgacagatgaggagaaggagatcatcaacagagtcatcgcccgggcagagaagatggaggagatggagcaggagcgcatcggccgcctggtggaccggctggagaacatgaggaagaatgtggccggagatggagtgaaccgctgcatcctgtgtggggagcagctgggcatgctgggcagcgcctgtgtggtgtgtgaggactgcaagaagaatgtgtgcaccaagtgtggggtggagaccaacaaccggctgtag

SEQ ID NO: 166992 - DNA, 948 bp, Artificial Sequence
  Description of Artificial Sequence: Synthetic coding sequence
atggctgacaccatcttcggcagcggaaatgaccagtgggtgtgccccaatgaccggcagctggccctgcgggccaagctgcagacaggctggagcgtgcacacctaccagacagagaagcagaggaggaagcagcacctgagccctgctgaggtggaggccatcctgcaggtgatccagagagctgagcggctggatgtgctggagcagcagagaattggccgcctggtggagcggctggagaccatgagaagaaatgtgatgggaaatggcctgagccagtgcctgctgtgtggggaggtgctgggcttcctgggcagcagctctgtgttctgcaaggactgcaggaagaaggtgtgcaccaagtgtggcatcgaggccagccctggccagaagaggcccctgtggctgtgcaagatctgcagcgagcagcgggaggtgtggaagaggtctggggcctggttctacaagggcctgcccaagtacatcctgcccctgaagaccccaggccgggcagatgacccccacttccggcccctgcccacagagcctgctgagcgggagcccaggagcagcgagaccagccgcatctacacctgggcccggggccgggtggtgtccagtgacagcgacagcgacagcgacctgagcagcagcagcctggaggaccggctgcccagcactggagtgcgggacaggaagggggacaagccctggaaggagagcggcggctctgtggaggcccccaggatgggcttcacccaccccccaggccacctgagcggctgccagagcagcctggccagcggggagaccggcaccggcagcgctgaccccccaggcggccccaggcctggcctgacccggcgggcccctgtgaaggacaccccaggccgggccccagctgctgatgctgccccagctggccccagcagctgcctgggctag

SEQ ID NO: 166993 - DNA, 861 bp, Artificial Sequence
  Description of Artificial Sequence: Synthetic coding sequence
atggctgacaccatcttcggcagcggaaatgaccagtgggtgtgccccaatgaccggcagctggccctgcgggccaagctgcagacaggctggagcgtgcacacctaccagacagagaagcagaggaggaagcagcacctgagccctgctgaggtggaggccatcctgcaggtgatccagagagctgagcggctggatgtgctggagcagcagagaattggccgcctggtggagcggctggagaccatgagaagaaatgtgatgggaaatggcctgagccagtgcctgctgtgtggggaggtgctgggcttcctgggcagcagctctgtgttctgcaaggactgcaggaaggtgtggaagaggtctggggcctggttctacaagggcctgcccaagtacatcctgcccctgaagaccccaggccgggcagatgacccccacttccggcccctgcccacagagcctgctgagcgggagcccaggagcagcgagaccagccgcatctacacctgggcccggggccgggtggtgtccagtgacagcgacagcgacagcgacctgagcagcagcagcctggaggaccggctgcccagcactggagtgcgggacagaaaaggagacaagccctggaaggagagcggcggctctgtggaggcccccaggatgggcttcacccaccccccaggccacctgagcggctgccagagcagcctggccagcggggagactggaactggatctgctgaccccccaggcggcccccggcccggcctgacccggcgggcccctgtgaaggacaccccaggccgggccccagctgctgatgctgccccagctggccccagcagctgcctgggctag

SEQ ID NO: 166994 - DNA, 861 bp, Artificial Sequence; identical to SEQ ID NO: 166993
  Description of Artificial Sequence: Synthetic coding sequence

SEQ ID NO: 166995 - DNA, 2331 bp, Artificial Sequence
  Description of Artificial Sequence: Synthetic coding sequence
atgaaccctgaggagcagatcgtgacctggctgatcagcctgggcgtgctggagagccccaagaagaccatctgtgaccctgaggagttcctgaagagcagcctgaagaatggagtggtgctgtgcaagctgatcaaccggctgatgcctggctctgtggagaagttctgcctggacccccagacagaggccgactgcatcaacaacatcaatgacttcctgaagggctgtgccaccctgcaggtggagatctttgatcctgatgacctgtacagcggcgtgaacttcagcaaggtgctgagcaccctgctggccgtgaacaaggccacagaggaccagctgtctgagcggccctgtggccgcagcagcagcctgtctgctgccaacaccagccagaccaacccccagggcgctgtgagcagcacagtgtctggcctgcagaggcagagcaagacagtggagatgacagaaaatggcagccaccagctgattgtgaaggcccgcttcaacttcaagcagaccaatgaagatgagctgtctgtgtgcaagggggacatcatctacgtgaccagggtggaggagggcggctggtgggagggcaccctgaatggaagaacaggctggttccccagcaactacgtgcgggagatcaagagcagcgagcggcccctgagccccaaggctgtgaagggctttgaaacagcccccctgaccaagaactactacacagtggtgctgcagaacatcctggacacagagaaggagtatgccaaggagctgcagagcctgctggtgacctacctgcggcccctgcagagcaacaacaacctgagcacagtggaggtgaccagcctgctgggcaactttgaggaggtgtgcaccttccagcagaccctgtgccaggccctggaggagtgcagcaagtttcctgagaaccagcacaaggtgggcggctgcctgctgagcctgatgccccacttcaagtccatgtacctggcctactgtgccaaccaccccagcgctgtgaatgtgctgacccagcacagtgatgagctggagcagttcatggagaaccagggcgccagcagccctggcatcctgatcctgaccaccaacctgagcaagcccttcatgaggctggagaagtatgtgaccctgctgcaggagctggagcggcacatggaggacacccacccagaccaccaggacatcctgaaggccatcgtggccttcaagaccctgatgggccagtgccaggacctgaggaagaggaagcagctggagctgcagatcctgtctgagcccatccaggcctgggagggggaggacatcaagaacctgggcaatgtcatcttcatgagccaggtgatggtgcagtacggggcctgtgaggagaaggaggagcgctacctgatgctgttcagcaatgtgctgatcatgctgagcgccagccccaggatgagcggcttcatctaccagggcaagatccccatcgccggcaccgtggtgacccggctggatgaaattgagggcaatgactgcacctttgagatcactggaaacacagtggagcgcatcgtggtgcactgcaacaacaaccaggacttccaggagtggctggagcagctgaacagactcatccggggccctgccagctgcagcagcctgagcaagaccagcagcagcagctgcagcgcccacagcagcttcagcagcacaggccagccccggggccccctggagcccccccagatcatcaagccctggagcctgagctgcctgcggcctgccccacccctgcggcccagcgctgccctgggctacaaggagaggatgagctacatcctgaaggagagcagcaagagccccaagaccatgaagaagttcctgcacaagaggaagacagagaggaagcccagcgaggaggagtatgtgatcaggaagagcacagctgccctggaggaggatgcccagatcctgaaggtgattgaggcctactgcaccagcgccaacttccagcagggccacggcagcagcaccaggaaggacagcatcccccaggtgctgctgcctgaggaggagaagctgatcatcgaggagaccaggagcaatggccagaccatcatggaggagaagagcctggtggacacagtgtatgccctgaaggatgaggtgcgggagctgaagcaggagaacaagaggatgaagcagtgcctggaggaggagctgaagagccggcgggacctggagaagctggtgcggcggctgctgaagcagacagatgagtgcatccggggggagagcagcagcaagaccagcatcctgccctag

SEQ ID NO: 166996 - DNA, 1869 bp, Artificial Sequence
  Description of Artificial Sequence: Synthetic coding sequence
atgacagaaaatggcagccaccagctgattgtgaaggcccgcttcaacttcaagcagaccaatgaagatgagctgtctgtgtgcaagggggacatcatctacgtgaccagggtggaggagggcggctggtgggagggcaccctgaatggaagaacaggctggttccccagcaactacgtgcgggagatcaagagcagcgagcggcccctgagccccaaggctgtgaagggctttgaaacagcccccctgaccaagaactactacacagtggtgctgcagaacatcctggacacagagaaggagtatgccaaggagctgcagagcctgctggtgacctacctgcggcccctgcagagcaacaacaacctgagcacagtggaggtgaccagcctgctgggcaactttgaggaggtgtgcaccttccagcagaccctgtgccaggccctggaggagtgcagcaagtttcctgagaaccagcacaaggtgggcggctgcctgctgagcctgatgccccacttcaagtccatgtacctggcctactgtgccaaccaccccagcgctgtgaatgtgctgacccagcacagtgatgagctggagcagttcatggagaaccagggcgccagcagccctggcatcctgatcctgaccaccaacctgagcaagcccttcatgaggctggagaagtatgtgaccctgctgcaggagctggagcggcacatggaggacacccacccagaccaccaggacatcctgaaggccatcgtggccttcaagaccctgatgggccagtgccaggacctgaggaagaggaagcagctggagctgcagatcctgtctgagcccatccaggcctgggagggggaggacatcaagaacctgggcaatgtcatcttcatgagccaggtgatggtgcagtacggggcctgtgaggagaaggaggagcgctacctgatgctgttcagcaatgtgctgatcatgctgagcgccagccccaggatgagcggcttcatctaccagggcaagatccccatcgccggcaccgtggtgacccggctggatgaaattgagggcaatgactgcacctttgagatcactggaaacacagtggagcgcatcgtggtgcactgcaacaacaaccaggacttccaggagtggctggagcagctgaacagactcatccggggccctgccagctgcagcagcctgagcaagaccagcagcagcagctgcagcgcccacagcagcttcagcagcacaggccagccccggggccccctggagcccccccagatcatcaagccctggagcctgagctgcctgcggcctgccccacccctgcggcccagcgctgccctgggctacaaggagaggatgagctacatcctgaaggagagcagcaagagccccaagaccatgaagaagttcctgcacaagaggaagacagagaggaagcccagcgaggaggagtatgtgatcaggaagagcacagctgccctggaggaggatgcccagatcctgaaggtgattgaggcctactgcaccagcgccaacttccagcagggccacggcagcagcaccaggaaggacagcatcccccaggtgctgctgcctgaggaggagaagctgatcatcgaggagaccaggagcaatggccagaccatcatggaggagaagagcctggtggacacagtgtatgccctgaaggatgaggtgcgggagctgaagcaggagaacaagaggatgaagcagtgcctggaggaggagctgaagagccggcgggacctggagaagctggtgcggcggctgctgaagcagacagatgagtgcatccggggggagagcagcagcaagaccagcatcctgccctag

SEQ ID NO: 166997 - DNA, 1869 bp, Artificial Sequence; identical to SEQ ID NO: 166996
  Description of Artificial Sequence: Synthetic coding sequence

SEQ ID NO: 166998 - DNA, 1950 bp, Artificial Sequence
  Description of Artificial Sequence: Synthetic coding sequence
atgacagaaaatggcagccaccagctgattgtgaaggcccgcttcaacttcaagcagaccaatgaagatgagctgtctgtgtgcaagggggacatcatctacgtgaccagggtggaggagggcggctggtgggagggcaccctgaatggaagaacaggctggttccccagcaactacgtgcgggagatcaagagcagtgatggagtgtccctgctgctgcccggcctggagtgcaatggagccatcagcgcccaccacaacctgtgcctgcccggcagcaagaggcccctgagccccaaggctgtgaagggctttgaaacagcccccctgaccaagaactactacacagtggtgctgcagaacatcctggacacagagaaggagtatgccaaggagctgcagagcctgctggtgacctacctgcggcccctgcagagcaacaacaacctgagcacagtggaggtgaccagcctgctgggcaactttgaggaggtgtgcaccttccagcagaccctgtgccaggccctggaggagtgcagcaagtttcctgagaaccagcacaaggtgggcggctgcctgctgagcctgatgccccacttcaagtccatgtacctggcctactgtgccaaccaccccagcgctgtgaatgtgctgacccagcacagtgatgagctggagcagttcatggagaaccagggcgccagcagccctggcatcctgatcctgaccaccaacctgagcaagcccttcatgaggctggagaagtatgtgaccctgctgcaggagctggagcggcacatggaggacacccacccagaccaccaggacatcctgaaggccatcgtggccttcaagaccctgatgggccagtgccaggacctgaggaagaggaagcagctggagctgcagatcctgtctgagcccatccaggcctgggagggggaggacatcaagaacctgggcaatgtcatcttcatgagccaggtgatggtgcagtatggagcctgtgaggagaaggaggagcgctacctgatgctgttcagcaatgtgctgatcatgctgagcgccagccccaggatgagcggcttcatctaccagggcaagatccccatcgccggcaccgtggtgacccggctggatgaaattgagggcaatgactgcacctttgagatcaccggcaacacagtggagagaattgtggtgcactgcaacaacaaccaggacttccaggagtggctggagcagctgaacagactcatccggggccctgccagctgcagcagcctgagcaagaccagcagcagcagctgcagcgcccacagcagcttcagcagcacaggccagccccggggccccctggagcccccccagatcatcaagccctggagcctgagctgcctgcggcctgccccacccctgcggcccagcgctgccctgggctacaaggagaggatgagctacatcctgaaggagagcagcaagagccccaagaccatgaagaagttcctgcacaagaggaagacagagaggaagcccagcgaggaggagtatgtgatcaggaagagcacagctgccctggaggaggatgcccagatcctgaaggtgattgaggcctactgcaccagcgccaacttccagcagggccacggcagcagcaccaggaaggacagcatcccccaggtgctgctgcctgaggaggagaagctgatcatcgaggagaccaggagcaatggccagaccatcatggaggagaagagcctggtggacacagtgtatgccctgaaggatgaggtgcgggagctgaagcaggagaacaagaggatgaagcagtgcctggaggaggagctgaagagcagaagagacctggagaagctggtgcggcggctgctgaagcagacagatgagtgcatccggggggagagcagcagcaagaccagcatcctgccctag

SEQ ID NO: 166999 - DNA, 1869 bp, Artificial Sequence
  Description of Artificial Sequence: Synthetic coding sequence
atgacagaaaatggcagccaccagctgattgtgaaggcccgcttcaacttcaagcagaccaatgaagatgagctgtctgtgtgcaagggggacatcatctacgtgaccagggtggaggagggcggctggtgggagggcaccctgaatggaagaacaggctggttccccagcaactacgtgcgggagatcaagagcagcgagcggcccctgagccccaaggctgtgaagggctttgaaacagcccccctgaccaagaactactacacagtggtgctgcagaacatcctggacacagagaaggagtatgccaaggagctgcagagcctgctggtgacctacctgcggcccctgcagagcaacaacaacctgagcacagtggaggtgaccagcctgctgggcaactttgaggaggtgtgcaccttccagcagaccctgtgccaggccctggaggagtgcagcaagtttcctgagaaccagcacaaggtgggcggctgcctgctgagcctgatgccccacttcaagtccatgtacctggcctactgtgccaaccaccccagcgctgtgaatgtgctgacccagcacagtgatgagctggagcagttcatggagaaccagggcgccagcagccctggcatcctgatcctgaccaccaacctgagcaagcccttcatgaggctggagaagtatgtgaccctgctgcaggagctggagcggcacatggaggacacccacccagaccaccaggacatcctgaaggccatcgtggccttcaagaccctgatgggccagtgccaggacctgaggaagaggaagcagctggagctgcagatcctgtctgagcccatccaggcctgggagggggaggacatcaagaacctgggcaatgtcatcttcatgagccaggtgatggtgcagtacggggcctgtgaggagaaggaggagcgctacctgatgctgttcagcaatgtgctgatcatgctgagcgccagccccaggatgagcggcttcatctaccagggcaagatccccatcgccggcaccgtggtgacccggctggatgaaattgagggcaatgactgcacctttgagatcactggaaacacagtggagcgcatcgtggtgcactgcaacaacaaccaggacttccaggagtggctggagcagctgaacagactcatccggggccctgccagctgcagcagcctgagcaagaccagcagcagcagctgcagcgcccacagcagcttcagcagcacaggccagccccggggccccctggagcccccccagatcatcaagccctggagcctgagctgcctgcggcctgccccacccctgcggcccagcgctgccctgggctacaaggaggccttcacctttgtgtttgaggagagcagcaagagccccaagaccatgaagaagttcctgcacaagaggaagacagagaggaagcccagcgaggaggagtatgtgatcaggaagagcacagctgccctggaggaggatgcccagatcctgaaggtgattgaggcctactgcaccagcgccaacttccagcagggccacggcagcagcaccaggaaggacagcatcccccaggtgctgctgcctgaggaggagaagctgatcatcgaggagaccaggagcaatggccagaccatcatggaggagaagagcctggtggacacagtgtatgccctgaaggatgaggtgcgggagctgaagcaggagaacaagaggatgaagcagtgcctggaggaggagctgaagagccggcgggacctggagaagctggtgcggcggctgctgaagcagacagatgagtgcatccggggggagagcagcagcaagaccagcatcctgccctag

SEQ ID NO: 167000 - DNA, 1896 bp, Artificial Sequence
  Description of Artificial Sequence: Synthetic coding sequence
atgttttatgcccactttgtgctgagcaagaggggccccctggccaagatctggctggccgcccactgggacaagaagctgaccaaggcccacgtgtttgagtgcaacctggagagctctgtggagagcatcatcagccccaaggtgaagatggccctgcggaccagcggccacctgctgctgggcgtggtgcgcatctaccacaggaaggccaagtacctgctggccgactgcaatgaggccttcatcaagatcaagatggccttccggcctggggtggtggacctgcctgaagaaaatcgggaggccgcctacaatgccatcaccctgcctgaggagttccatgactttgaccagcccctgcctgacctggatgacattgatgtggcccagcagttcagcctgaaccagagccgggtggaggagatcaccatgagggaggaggtgggcaacatcagcatcctgcaggagaatgactttggagactttggcatggatgaccgggagatcatgagggagggcagcgcctttgaagatgatgacatgctggtgtccaccaccaccagcaacctgctgctggagagcgagcagagcaccagcaacctgaatgagaagatcaaccacctggagtatgaggaccagtacaaggatgacaactttggagagggcaatgatggcggcatcctggatgacaagctgatcagcaacaatgatggcggcatctttgatgatcctccagccctgtctgaggccggcgtgatgctgcctgagcagcctgcccatgatgacatggatgaagatgacaacgtgtccatgggcggccctgacagcccagacagcgtggaccctgtggagcccatgcccaccatgacagaccagaccaccctggtgcccaatgaggaggaggcctttgccctggagcccatcgacatcaccgtgaaggagaccaaggccaagaggaagaggaagctgattgtggacagcgtgaaggagctggacagcaagaccatccgggcccagctgagtgactacagcgacatcgtgaccaccctggacctggccccacccaccaagaagctgatgatgtggaaggagaccggcggcgtggagaagctgttcagcctgcctgcccagcccctgtggaacaaccggctgctgaagctgttcacccgctgcctgacccccctggtgcctgaggacctgaggaagaggaggaagggcggggaggccgacaacctggatgagttcctgaaggagtttgaaaatcctgaggtgccccgggaggaccagcagcagcagcaccagcagagagatgtgattgatgagcccatcatcgaggagcccagccggctgcaggagagcgtgatggaggccagcaggaccaacattgatgagagcgccatgcctcctcctccaccccagggcgtgaagaggaaggccggccagattgatcctgagcctgtgatgccaccccagcaggtggagcagatggagatcccccctgtggagctgcccccagaggagccccccaacatctgccagctgatccctgagctggagctgctgcctgagaaggagaaggagaaggagaaggagaaggaggatgatgaggaggaggaggatgaagatgccagcggcggggaccaggaccaggaggagcggcgctggaacaagaggacccagcagatgctgcacggcctgcagagggccctggccaagacaggagctgagagcatcagcctgctggagctgtgcaggaacaccaacaggaagcaggccgccgccaagttctacagcttcctggtgctgaagaagcagcaggccatcgagctgacccaggaggagccctacagcgacatcatcgccaccccaggcccccgcttccacatcatctag

SEQ ID NO: 167001 - DNA, 501 bp, Artificial Sequence
  Description of Artificial Sequence: Synthetic coding sequence
atggcccccaagaaggccaagaagagagctgggggcgccaacagcaatgtgttctccatgtttgagcagacccagatccaggagttcaaggaggccttcaccatcatggaccagaacagagatggcttcatcgacaagaatgacctgcgggacacctttgctgccctgggccgggtgaatgtgaagaatgaggagattgatgagatgatcaaggaggcccctggccccatcaacttcaccgtcttcctgaccatgtttggagagaagctgaagggagctgaccctgaggagaccatcctgaatgccttcaaggtgtttgatcctgagggcaaaggagtgctgaaggctgactatgtgcgggagatgctgaccacccaggccgagcgcttcagcaaggaggaggtggaccagatgtttgctgccttccccccagatgtgactggaaacctggactacaagaacctggtgcacatcatcacccatggagaggagaaggactag

SEQ ID NO: 167002 - DNA, 909 bp, Artificial Sequence
  Description of Artificial Sequence: Synthetic coding sequence
atggtgcggcctgtgcgccacaagaagcctgtgaactacagccagtttgaccacagcgacagtgatgatgactttgtgtctgccaccgtgcccctgaacaagaagagcaggacagcccccaaggagctgaagcaggacaagcccaagcccaacctgaacaacctgaggaaggaggagatccctgtgcaggagaagacccccaagaagaggctgcctgagggcaccttcagcatcccagccagcgctgtgccctgcaccaagatggccctggatgacaagctgtaccagagggacctggaggtggccctggccctgtctgtgaaggagctgcccaccgtgaccaccaacgtgcagaacagccaggacaagagcattgagaagcacggcagcagcaagattgagaccatgaacaagagcccccacatcagcaactgcagcgtggccagtgactacctggacctggacaagatcaccgtggaggatgatgtgggcggcgtgcagggcaagaggaaggccgccagcaaggctgctgcccagcagaggaagatcctgctggagggcagtgatggagacagcgccaatgacacagagccagactttgcccctggagaggacagtgaagatgacagcgacttctgtgagagcgaggacaatgatgaggacttctccatgaggaagagcaaggtgaaggagatcaagaagaaggaggtgaaggtgaagagccctgtggagaagaaggagaagaagagcaagagcaaatgtaatgccctggccgccagcggcggcagccgcagcagcagcagccccctggtggtggtgtctgtgaagagccccaaccagagcctgcggctgggcctgagccggctggcccgggtgaagcccctgcaccccaatgccaccagcacctag

SEQ ID NO: 167003 - DNA, 1008 bp, Artificial Sequence
  Description of Artificial Sequence: Synthetic coding sequence
atggtgcggcctgtgcgccacaagaagcctgtgaactacagccagtttgaccacagcgacagtgatgatgactttgtgtctgccaccgtgcccctgaacaagaagagcaggacagcccccaaggagctgaagcaggacaagcccaagcccaacctgaacaacctgaggaaggaggagatccctgtgcaggagaagacccccaagaagaggatggccctggatgacaagctgtaccagagggacctggaggtggccctggccctgtctgtgaaggagctgcccaccgtgaccaccaacgtgcagaacagccaggacaagagcattgagaagcacggcagcagcaagattgagaccatgaacaagagcccccacatcagcaactgcagcgtggccagtgactacctggacctggacaagatcaccgtggaggatgatgtgggcggcgtgcagggcaagaggaaggccgccagcaaggccgccgcccagcagaggaagatcctgctggagggcagtgatggagacagcgccaatgacacagagccagactttgcccctggagaagattctgaagatgacagcgacttctgtgagagtgaagataatgatgaggacttctccatgaggaagagcaaggtgaaggagatcaagaagaaggaggtgaaggtgaagagccctgtggagaagaaggagaagaagagcaagagcaagtgcaatgccctggtgacctctgtggacagcgccccagctgctgtgaagtctgagagccagagcctgcccaagaaggtgtccctgagcagtgacaccaccaggaagcccctggagatccgcagccccagcgctgagagcaagaagcccaagtgggtgcccccagctgccagcggcggcagccgcagcagcagcagccccctggtggtggtgtctgtgaagagccccaaccagagcctgcggctgggcctgagccggctggcccgggtgaagcccctgcaccccaatgccaccagcacctag

SEQ ID NO: 167004 - DNA, 702 bp, Artificial Sequence
  Description of Artificial Sequence: Synthetic coding sequence
atgaacaagagcccccacatcagcaactgcagcgtggccagtgactacctggacctggacaagatcaccgtggaggatgatgtgggcggcgtgcagggcaagaggaaggccgccagcaaggccgccgcccagcagaggaagatcctgctggagggcagtgatggagacagcgccaatgacacagagccagactttgcccctggagaagattctgaagatgacagcgacttctgtgagagtgaagataatgatgaggacttctccatgaggaagagcaaggtgaaggagatcaagaagaaggaggtgaaggtgaagagccctgtggagaagaaggagaagaagagcaagagcaagtgcaatgccctggtgacctctgtggacagcgccccagctgctgtgaagtctgagagccagagcctgcccaagaaggtgtccctgagcagtgacaccaccaggaagcccctggagatccgcagccccagcgctgagagcaagaagcccaagtgggtgcccccaggcatggcctacctgagcagcaggactggagcctggaagatcatcacagctgccagcggcggcagccgcagcagcagcagccccctggtggtggtgtctgtgaagagccccaaccagagcctgcggctgggcctgagccggctggcccgggtgaagcccctgcaccccaatgccaccagcacctag

SEQ ID NO: 167005 - DNA, 408 bp, Artificial Sequence
  Description of Artificial Sequence: Synthetic coding sequence
atgaggggcaagaccttccgctttgagatgcagagggacctggtgtccttccccctgagccctgctgtgcgggtgaagctggtgtctgctggcttccagacagctgaggagctgctggaggtgaagcccagcgagctgagcaaggaggtgggcatcagcaaggccgaggccctggagaccctgcagatcatcagaagagaatgtctgaccaacaagcccaggtatgccggcaccagcgagagccacaagaagtgcacagccctggagctgctggagcaggagcacacccagggcttcatcatcaccttctgcagcgccctggatgacatcctgggcggcggcgtgcccctgatgaagaccacagagatctgtggggcccctggggtgggcaagacccagctgtggtag

SEQ ID NO: 167006 - DNA, 855 bp, Artificial Sequence
  Description of Artificial Sequence: Synthetic coding sequence
atggccgagctggtgccctttgctgtgcccattgaaagtgacaagaccctgctggtgtgggagctgagcagcggccccacagctgaggccctgcaccacagcctcttcaccgccttcagccagtttggcctgctgtacagcgtgcgggtcttccccaatgctgctgtggcccaccctggcttctatgctgtgatcaagttctacagcgcccgggccgcccaccgggcccagaaggcctgtgacaggaagcagctgttccagaagagccctgtgaaggtgcggctgggcaccaggcacaaggctgtgcagcaccaggccctggccctgaacagcagcaagtgccaggagctggccaactactacttcggcttcaacggctgcagcaagaggatcatcaagctgcaggagctgagtgacctggaggagcgggagaatgaagacagcatggtgcccctgcccaagcagagcctgaagttcttctgtgccctggaggtggtgctgcccagctgtgactgccgcagccctggcatcggcctggtggaggagcccatggacaaggtggaggagggccccctgtccttcctgatgaagaggaagacagcccagaagctggccatccagaaggccctgagtgatgccttccagaagctgctgattgtggtgctggagagcggcaagattgctgtggagtaccggcccagtgaagatattgtgggcgtgcgctgtgaggaggagctgcacggcctcatccaggtgccctgcagcccctggaagcagtatggccaggaggaggagggctacctgagtgacttcagcctggaggaggaggagttccggctgcctgagctggactag

SEQ ID NO: 167007 - DNA, 351 bp, Artificial Sequence
  Description of Artificial Sequence: Synthetic coding sequence
atgcacctgctggtgcccccaccccagcacagcctcttcaccgccttcagccagtttggcctgctgtacagcgtgcgggtcttccccaatgctgctgtggcccaccctggcttctacgccgtcatcaagttctacagcgcccgggccgcccaccgggcccagaaggcctgtgacaggaagcagctgttccagaagagccctgtgaaggtgcggctgggcaccaggcacaaggctgtgcagcaccaggccctggccctgaacagcagcaagtgccaggagctggccaactactacttcggcttcaacggctgcagcaagaggatcatcaaggaccactaccacagcctgtag

SEQ ID NO: 167008 - DNA, 711 bp, Artificial Sequence
  Description of Artificial Sequence: Synthetic coding sequence
atggccgagctggtgccctttgctgtgcccattgaaagtgacaagaccctgctggtgtgggagctgagcagcggccccacagctgaggccctgcaccacagcctcttcaccgccttcagccagtttggcctgctgtacagcgtgcgggtcttccccaatgctgctgtggcccaccctggcttctatgctgtgatcaagttctacagcgcccgggccgcccaccgggcccagaaggcctgtgacaggaagcagctgttccagaagagccctgtgaaggtgcggctgggcaccaggcacaaggctgtgcagcaccaggccctggccctgaacagcagcaagtgccaggagctggccaactactacttcggcttcaacggctgcagcaagaggatcatcaagctgcaggagctgagtgacctggaggagcgggagaatgaagacagcatggtgcccctgcccaagcagagcctgaagttcttctgtgccctggaggtggtgctgcccagctgtgactgccgcagccctggcatcggcctggtggaggagcccatggacaaggtggaggagggccccctgtccttcctgatgaagaggaagacagcccagaagctggccatccagaaggccctgagtgatgccttccagaagctgctgattgtggtgctgggcaagacagtgctgatcatcctggaggtgctgcagttccagtag

SEQ ID NO: 167009 - DNA, 786 bp, Artificial Sequence
  Description of Artificial Sequence: Synthetic coding sequence
atgcacctgctggtgcccccaccccagcacagcctcttcaccgccttcagccagtttggcctgctgtacagcgtgcgggtcttccccaatgctgctgtggcccaccctggcttctacgccgtcatcaagttctacagcgcccgggccgcccaccgggcccagaaggcctgtgacaggaagcagctgttccagaagagccctgtgaaggtgcggctgggcaccaggcacaaggctgtgcagcaccaggccctggccctgaacagcagcaagtgccaggagctggccaactactacttcggcttcaacggctgcagcaagaggatcatcaagctgcaggagctgagtgacctggaggagagagaaaatgaagattccatggtgcccctgcccaagcagagcctgaagttcttctgtgccctggaggtggtgctgcccagctgtgactgccgcagccctggcatcggcctggtggaggagcccatggacaaggtggaggagggccccctgtccttcctgatgaagaggaagacagcccagaagctggccatccagaaggccctgagtgatgccttccagaagctgctgattgtggtgctggagagcggcaagattgctgtggagtaccggcccagcgaggacatcgtgggcgtgcgctgtgaggaggagctgcacggcctcatccaggtgccctgcagcccctggaagcagtatggccaggaggaggagggctacctgagtgacttcagcctggaggaggaggagttccggctgcctgagctggactag

SEQ ID NO: 167010 - DNA, 393 bp, Artificial Sequence
  Description of Artificial Sequence: Synthetic coding sequence
tttggcttcaacggctgcagcaagaggatcatcaagctgcaggagctgagtgacctggaggagagagaaaatgaagattccatggtgcccctgcccaagcagagcctgaagttcttctgtgccctggaggtggtgctgcccagctgtgactgccgcagccctggcatcggcctggtggaggagcccatggacaaggtggaggaggagagcggcaagattgctgtggagtaccggcccagtgaagatattgtgggcgtgcgctgtgaggaggagctgcacggcctcatccaggtgccctgcagcccctggaagcagtatggccaggaggaggagggctacctgagtgacttcagcctggaggaggaggagttccggctgcctgagctggactag

SEQ ID NO: 167011 - DNA, 501 bp, Artificial Sequence
  Description of Artificial Sequence: Synthetic coding sequence
atggccgagctggtgccctttgctgtgcccattgaaagtgacaagaccctgctggtgtgggagctgagcagcggccccacagctgaggccctgcaccacagcctcttcaccgccttcagccagtttggcctgctgtacagcgtgcgggtcttccccaatgctgctgtggcccaccctggcttctatgctgtgatcaagttctacagcgcccgggccgcccaccgggcccagaaggcctgtgacaggaagcagctgttccagaagagccctgtgaaggtgcggctgggcaccaggcacaaggctgtgcagcaccaggccctggccctgaacagcagcaagtgccaggagctggccaactactacttcggcttcaacggctgcagcaagaggatcatcaaggtgccctgcagcccctggaagcagtatggccaggaggaggagggctacctgagtgacttcagcctggaggaggaggagttccggctgcctgagctggactag

SEQ ID NO: 167012 - DNA, 642 bp, Artificial Sequence
  Description of Artificial Sequence: Synthetic coding sequence
atgcacctgctggtgcccccaccccagcacagcctcttcaccgccttcagccagtttggcctgctgtacagcgtgcgggtcttccccaatgctgctgtggcccaccctggcttctacgccgtcatcaagttctacagcgcccgggccgcccaccgggcccagaaggcctgtgacaggaagcagctgttccagaagagccctgtgaaggtgcggctgggcaccaggcacaaggctgtgcagcaccaggccctggccctgaacagcagcaagtgccaggagctggccaactactacttcggcttcaacggctgcagcaagaggatcatcaagctgcaggagctgagtgacctggaggagagagaaaatgaagattccatggtgcccctgcccaagcagagcctgaagttcttctgtgccctggaggtggtgctgcccagctgtgactgccgcagccctggcatcggcctggtggaggagcccatggacaaggtggaggagggccccctgtccttcctgatgaagaggaagacagcccagaagctggccatccagaaggccctgagtgatgccttccagaagctgctgattgtggtgctgggcaagacagtgctgatcatcctggaggtgctgcagttccagtag

SEQ ID NO: 167013 - DNA, 756 bp, Artificial Sequence
  Description of Artificial Sequence: Synthetic coding sequence
atggccgagctggtgccctttgctgtgcccattgaaagtgacaagaccctgctggtgtgggagctgagcagcggccccacagctgaggccctgcaccacagcctcttcaccgccttcagccagtttggcctgctgtacagcgtgcgggtcttccccaatgctgctgtggcccaccctggcttctatgctgtgatcaagttctacagcgcccgggccgcccaccgggcccagaaggcctgtgacaggaagcagctgttccagaagagccctgtgaaggtgcggctgggcaccaggcacaaggctgtgcagcaccaggccctggccctgaacagcagcaagtgccaggagctggccaactactacttcggcttcaacggctgcagcaagaggatcatcaagctgcaggagctgagtgacctggaggagcgggagaatgaagacagcatggtgcccctgcccaagcagagcctgaagttcttctgtgccctggaggtggtgctgcccagctgtgactgccgcagccctggcatcggcctggtggaggagcccatggacaaggtggaggaggagagcggcaagattgctgtggagtaccggcccagcgaggacatcgtgggcgtgcgctgtgaggaggagctgcacggcctcatccaggtgccctgcagcccctggaagcagtatggccaggaggaggagggctacctgagtgacttcagcctggaggaggaggagttccggctgcctgagctggactag

SEQ ID NO: 167014 - DNA, 420 bp, Artificial Sequence
  Description of Artificial Sequence: Synthetic coding sequence
atggccgagctggtgccctttgctgtgcccattgaaagtgacaagaccctgctggtgtgggagctgagcagcggccccacagctgaggccctgcaccacagcctcttcaccgccttcagccagtttggcctgctgtacagcgtgcgggtcttccccaatgctgctgtggcccaccctggcttctatgctgtgatcaagttctacagcgcccgggccgcccaccgggcccagaaggcctgtgacaggaagcagctgttccagaagagccctgtgaaggtgcggctgggcaccaggcacaaggctgtgcagcaccaggccctggccctgaacagcagcaagtgccaggagctggccaactactacttcggcttcaacggctgcagcaagaggatcatcaaggaccactaccacagcctgtag

SEQ ID NO: 167015 - DNA, 432 bp, Artificial Sequence
  Description of Artificial Sequence: Synthetic coding sequence
atgcacctgctggtgcccccaccccagcacagcctcttcaccgccttcagccagtttggcctgctgtacagcgtgcgggtcttccccaatgctgctgtggcccaccctggcttctacgccgtcatcaagttctacagcgcccgggccgcccaccgggcccagaaggcctgtgacaggaagcagctgttccagaagagccctgtgaaggtgcggctgggcaccaggcacaaggctgtgcagcaccaggccctggccctgaacagcagcaagtgccaggagctggccaactactacttcggcttcaacggctgcagcaagaggatcatcaaggtgccctgcagcccctggaagcagtatggccaggaggaggagggctacctgagtgacttcagcctggaggaggaggagttccggctgcctgagctggactag

SEQ ID NO: 167016 - DNA, 2733 bp, Artificial Sequence
  Description of Artificial Sequence: Synthetic coding sequence
atgagaagatctgctgcccccagccagctgcagggcaacagcttcaagaagcccaagttcatccccccaggccgcagcaaccctggcctgaatgaggagatcaccaagctgaacccagacatcaagctgtttgagggcgtggccatcaacaacaccttcctgcccagccagaatgacctgcgcatctgcagcctgaacctgcccagcgaggagagcacccgggagatcaacaacagagacaactgcagcggcaagtactgctttgaggcccccaccctggccaccctggaccccccccacacagtgcacagcgcccccaaggaggtggccgtgtccaaggagcaggaggagaagagtgacagcctggtgaagtacttctctgtggtgtggtgcaagcccagcaagaagaagcacaagaagtgggagggagatgctgtgctgattgtgaagggcaagagcttcatcctgaagaacctggagggcaaggacatcggccggggcatcggctacaagttcaaggagctggagaagattgaggagggccagaccctgatgatctgtgggaaggagattgaggtgatgggcgtcatcagcccagatgacttcagcagcggccgctgcttccagctgggcggcggcagcacagccatcagccacagcagccaggtggccaggaagtgcttcagcaaccccttcaagtctgtgtgcaagcccagcagcaaggagaaccggcagaatgacttccagaactgcaagcccaggcatgacccctacacccccaacagcctggtgatgcccaggccagacaagaaccaccagtgggtgttcaacaagaactgcttccccctggtggatgtggtgattgacccctacctggtgtaccacctgcggccccaccagaaggagggcatcatcttcctgtatgaatgtgtgatgggcatgaggatgaatggccgctgtggggccatcctggctgatgagatgggcctgggcaagaccctgcagtgcatcagcctcatctggaccctgcagtgccagggcccctatggaggcaagcctgtgatcaagaagaccctcatcgtgaccccaggcagcctggtgaacaactggaagaaggagttccagaagtggctgggcagcgagcgcatcaagatcttcaccgtggaccaggaccacaaggtggaggagttcatcaagagcatcttctacagcgtgctgatcatctcctatgagatgctgctgcggagcctggaccagatcaagaacatcaagtttgacctgctgatctgtgatgagggccaccggctgaagaacagcgccatcaagaccaccacagccctgatcagcctgagctgtgagaagaggatcatcctgaccggcacccccatccagaatgacctgcaggagttctttgccctgattgactttgtgaaccctggcatcctgggcagcctgagcagctacaggaagatctatgaggagcccatcatcctgagccgggagcccagcgccagcgaggaggagaaggagctgggggagcggcgggctgctgagctgacctgcctgaccggcctcttcatcctgcggaggacccaggagatcatcaacaagtacctgccccccaagattgaaaatgtggtgttctgcaggcctggggccctgcagatcgagctgtacaggaagctgctgaacagccaggtggtgcgcttctgcctgcagggcctgctggagaacagcccccacctgatctgcattggagccctgaagaagctgtgcaaccacccctgcctgctcttcaacagcatcaaggagaaggagtgcagcagcacctgtgacaagaatgaggagaagagcctgtacaagggcctgctgtctgtgtttcctgctgactacaaccccctgctcttcacagagaaggagagcggcaagctgcaggtgctgagcaagctgctggccgtcatccacgagctgcggcccacagagaaggtggtgctggtgagcaactacacccagaccctgaacatcctgcaggaggtgtgcaagagacatggctacgcctacacccggctggatggccagacccccatcagccagaggcagcagatcgtggatggcttcaacagccagcacagcagcttcttcatcttcctgctgagcagcaaggccggcggcgtgggcctgaacctgattggaggcagccacctgatcctgtatgacatcgactggaacccagccacagacatccaggccatgagccgggtgtggagagatggccagaagtaccctgtgcacatctaccgcctgctgaccaccggcaccatcgaggagaagatctaccagaggcagatcagcaagcagggcctgtgtggggctgtggtggacctgaccaagaccagcgagcacatccagttctctgtggaggagctgaagaacctcttcaccctgcacgagagcagtgactgtgtgacccatgacctgctggactgtgagtgcaccggggaggaggtgcacactggagacagcctggagaagttcatcgtgtcccgggactgccagctgggcccccaccaccagaagagcaacagcctgaagcccctgtccatgagccagctgaagcagtggaagcacttcagcggggaccacctgaacctgacagaccccttcctggagcgcatcacagaaaatgtgtccttcatcttccagaacatcaccacccaggccaccggcacctag

SEQ ID NO: 167017 - DNA, 900 bp, Artificial Sequence
  Description of Artificial Sequence: Synthetic coding sequence
atggtgggcaaggcccggagcagcaacttcaccctgtctgagaagctggacctgctgaagctggtgaagccctacgtgaagatcctggaggagcacaccaacaagcacagcgtgattgtggagaagaaccgctgctgggacatcatcgctgtgaactacaatgccatcggcgtggacaggcctcccaggacagcccagggcctgcggaccctgtacaagaggctgaaggagtatgccaagcaggagctgctgcagcagaaggagacccagagcgacttcaagagcaacatcagcgagcccaccaagaaggtgatggagatgatcccccagatcagcagcttctgcctggtgcgggacaggaaccacatccagagcgccaacctggatgaggaggcccaggccggcaccagcagcctgcaggtgatgctggaccaccaccctgtggccatcaccgtggaggtgaagcaggaggaggacatcaagcccccaccacccctggtgctgaacagccagcagagcgacaccctggagcagcgggaggagcacgagctggtgcacgtgatggagaggagcctgagccccagcctgagctctgtggacatgaggatgaccagcagccccagcagcatccccaggagagatgacttcttcagacatgaaagtggagagcacttccgcagcctgctgggctatgacccccagatcctgcagatgctgaaggaggagcaccagatcatcctggagaaccagaagaactttggcctgtatgtgcaggagaagagagatggcctgaagaggcggcagcagctggaggaggagctgctgcgggccaagattgaggtggagaagctgaaggccatccggctgcggcatgacctgcctgagtacaacagcctgtag

SEQ ID NO: 167018 - DNA, 378 bp, Artificial Sequence
  Description of Artificial Sequence: Synthetic coding sequence
atgagaagatctgctgcccccagccagctgcagggcaacagcttcaagaagcccaagttcatccccccaggccgcagcaaccctggcctgaatgaggagatcaccaagctgaacccagacatcaagctgtttgagggcgtggccatcaacaacaccttcctgcccagccagaatgacctgcgcatctgcagcctgaacctgcccagcgaggagagcacccgggagatcaacaacagagacaactgcagcggcaagtactgctttgaggcccccaccctggccaccctggaccccccccacacagtgcacagcgcccccaaggaggtggccgtgtccaaggagcaggaggagaagagtgacagcctggtgaagtactag

SEQ ID NO: 167019 - DNA, 354 bp, Artificial Sequence
  Description of Artificial Sequence: Synthetic coding sequence
atgagaagatctgctgcccccagccagctgcagggcaacagcttcaagaagcccaagttcatccccccaggccgcagcaaccctggcctgaatgaggagatcaccaagctgaacccagacatcaagctgtttgagggcgtggccatcaacaacaccttcctgcccagccagaatgacctgcgcatctgcagcctgaacctgcccagcgaggagagcacccgggagatcaacaacagagacaactgcagcggcaagtactgctttgaggcccccaccctggccaccctggaccccccccacacagtgcagacctggatgagaagacaccggctggtgcctgtgcactacagatag

SEQ ID NO: 167020 - DNA, 477 bp, Artificial Sequence
  Description of Artificial Sequence: Synthetic coding sequence
atgctggaccaccaccctgtggccatcaccgtggaggtgaagcaggaggaggacatcaagcccccaccacccctggtgctgaacagccagcagagcgacaccctggagcagcgggaggagcacgagctggtgcacgtgatggagaggagcctgagccccagcctgagctctgtggacatgaggatgaccagcagccccagcagcatccccaggagagatgacttcttcagacatgagagcggggagcacttccgcagcctgctgggctatgacccccagatcctgcagatgctgaaggaggagcaccagatcatcctggagaaccagaagaactttggcctgtatgtgcaggagaagagagatggcctgaagaggcggcagcagctggaggaggagctgctgcgggccaagattgaggtggagaagctgaaggccatccggctgcggcatgacctgcctgagtacaacagcctgtag

SEQ ID NO: 167021 - DNA, 1749 bp, Artificial Sequence
  Description of Artificial Sequence: Synthetic coding sequence
atgggcctgggcaagaccctgcagtgcatcagcctcatctggaccctgcagtgccagggcccctacggcggcaagcctgtgatcaagaagaccctgattgtgaccccaggcagcctggtgaacaactggaagaaggagttccagaagtggctgggcagcgagcgcatcaagatcttcaccgtggaccaggaccacaaggtggaggagttcatcaagagcatcttctacagcgtgctgatcatctcctatgagatgctgctgcggagcctggaccagatcaagaacatcaagtttgacctgctgatctgtgatgagggccaccggctgaagaacagcgccatcaagaccaccacagccctgatcagcctgagctgtgagaagaggatcatcctgaccggcacccccatccagaatgacctgcaggagttctttgccctgattgactttgtgaaccctggcatcctgggcagcctgagcagctacaggaagatctatgaggagcccatcatcctgagccgggagcccagcgccagcgaggaggagaaggagctgggggagcgggagcagctgaacctgctggccagcctggacagcctgctgcggaggacccaggagatcatcaacaagtacctgccccccaagattgaaaatgtggtgttctgcaggcctggggccctgcagatcgagctgtacaggaagctgctgaacagccaggtggtgcgcttctgcctgcagggcctgctggagaacagcccccacctgatctgcattggagccctgaagaagctgtgcaaccacccctgcctgctcttcaacagcatcaaggagaaggagtgcagcagcacctgtgacaagaatgaggagaagagcctgtacaagggcctgctgtctgtgtttcctgctgactacaaccccctgctcttcacagagaaggagagcggcaagctgcaggtgctgagcaagctgctggccgtcatccacgagctgcggcccacagagaaggtggtgctggtgagcaactacacccagaccctgaacatcctgcaggaggtgtgcaagagacatggctacgcctacacccggctggatggccagacccccatcagccagaggcagcagatcgtggatggcttcaacagccagcacagcagcttcttcatcttcctgctgagcagcaaggccggcggcgtgggcctgaacctgattggaggcagccacctgatcctgtatgacatcgactggaacccagccacagacatccaggccatgagccgggtgtggagagatggccagaagtaccctgtgcacatctaccgcctgctgaccaccggcaccatcgaggagaagatctaccagaggcagatcagcaagcagggcctgtgtggggctgtggtggacctgaccaagaccagcgagcacatccagttctctgtggaggagctgaagaacctcttcaccctgcacgagagcagtgactgtgtgacccatgacctgctggactgtgagtgcaccggggaggaggtgcacactggagacagcctggagaagttcatcgtgtcccgggactgccagctgggcccccaccaccagaagagcaacagcctgaagcccctgtccatgagccagctgaagcagtggaagcacttcagcggggaccacctgaacctgacagaccccttcctggagcgcatcacagaaaatgtgtccttcatcttccagaacatcaccacccaggccaccggcacctag

SEQ ID NO: 167022 - DNA, 1290 bp, Artificial Sequence
  Description of Artificial Sequence: Synthetic coding sequence
atggccgccatgctgaagtgtgtgatgagcggcagccaggtgaaggtgtttgggaaggctgtgcaggccctgagccgcatcagtgatgagttctggctggaccccagcaagaagggcctggccctgcgctgtgtgaacagcagccgcagcgcctacggctgtgtgctcttcagccctgtgttcttccagcactaccagtggagcgccctggtgaagatgtctgaaaatgagctggacaccaccctgcacctgaagtgcaagctgggcatgaagagcatcctgcccatcttccgctgcctgaacagcctggagagaaatattgaaaaatgtcgcatcttcaccaggagtgacaagtgcaaggtggtgatccagttcttctacagacatggcatcaagaggacccacaacatctgcttccaggagagccagcccctgcaggtgatctttgacaagaatgtgtgcaccaacaccctgatgatccagccccggctgctggctgatgccatcgtgctcttcaccagcagccaggaggaggtgaccctggccgtgacccccctgaacttctgcctgaagagcagcaatgaggagagcatggacctgagcaatgctgtgcacagcgagatgtttgtgggcagtgatgaatttgacttcttccagatcggcatggacacagagatcaccttctgcttcaaggagctgaagggcatcctgaccttcagcgaggccacccacgcccccatcagcatctactttgacttccctgggaagcccctggccctgagcattgatgacatgctggtggaggccaacttcatcctggccaccctggctgatgagcagagccgggccagcagcccccagagcctgtgcctgagccagaagaggaagagaagtgacctgattgagaagaaggccggcaagaatgtgacaggccaggccctggagtgcatcagcaagaaggccgccccccggcggctgtaccccaaggagaccctgaccaacatcagcgccctggagaactgtggcagccctgccatgaagagggtggatggagatgtgtctgaggtgtctgagagctctgtgagcaacacagaggaggtgcccggcagcctgtgcctgaggaagttcagctgcatgttctttggagctgtgtccagtgaccagcaggagcacttcaaccacccctttgacagcctggcccgggccagtgacagcgaggaggacatgaacaacgtgtgctgcaggaaggagttcaatggaagtgatgccaagtacttctgcatcatctag

SEQ ID NO: 167023 - DNA, 1038 bp, Artificial Sequence
  Description of Artificial Sequence: Synthetic coding sequence
atgtctgaaaatgagctggacaccaccctgcacctgaagtgcaagctgggcatgaagagcatcctgcccatcttccgctgcctgaacagcctggagagaaatattgaaaaatgtcgcatcttcaccaggagtgacaagtgcaaggtggtgatccagttcttctacagacatggcatcaagaggacccacaacatctgcttccaggagagccagcccctgcaggtgatctttgacaagaatgtgtgcaccaacaccctgatgatccagccccggctgctggctgatgccatcgtgctcttcaccagcagccaggaggaggtgaccctggccgtgacccccctgaacttctgcctgaagagcagcaatgaggagagcatggacctgagcaatgctgtgcacagcgagatgtttgtgggcagtgatgaatttgacttcttccagatcggcatggacacagagatcaccttctgcttcaaggagctgaagggcatcctgaccttcagcgaggccacccacgcccccatcagcatctactttgacttccctgggaagcccctggccctgagcattgatgacatgctggtggaggccaacttcatcctggccaccctggctgatgagcagagccgggccagcagcccccagagcctgtgcctgagccagaagaggaagagaagtgacctgattgagaagaaggccggcaagaatgtgacaggccaggccctggagtgcatcagcaagaaggccgccccccggcggctgtaccccaaggagaccctgaccaacatcagcgccctggagaactgtggcagccctgccatgaagagggtggatggagatgtgtctgaggtgtctgagagctctgtgagcaacacagaggaggtgcccggcagcctgtgcctgaggaagttcagctgcatgttctttggagctgtgtccagtgaccagcaggagcacttcaaccacccctttgacagcctggcccgggccagtgacagcgaggaggacatgaacaacggcagcttcagcatcttctag

SEQ ID NO: 167024 - DNA, 1038 bp, Artificial Sequence; identical to SEQ ID NO: 167023
  Description of Artificial Sequence: Synthetic coding sequence

SEQ ID NO: 167025 - DNA, 1449 bp, Artificial Sequence; identical to SEQ ID NO: 153007
  Description of Artificial Sequence: Synthetic coding sequence

SEQ ID NO: 167026 - DNA, 1410 bp, Artificial Sequence
  Description of Artificial Sequence: Synthetic coding sequence
atggaggacagcaccagccccaagcaggagaaggagaaccaggaggagctgggggagacccggcggccctgggagggcaagacagctgccagcccccagtacagcgagcctgagagcagcgagcccctggaggccaagcagggccctgagaccggccggcagagccgcagcagccggccctggagcccccagagccgggccaagacccccctgggcggccctgctggccctgagaccagcagccctgcccctgtgagcccccgggagcccagcagcagccccagccccctggccccagcccggcaggacctggccgccccaccccagagcgacaggaccaccagcgtcatccctgaggccggcaccccctacccagaccccctggagcagagcagtgacaagcgggagagcaccccccaccacaccagccagagcgagggcaacaccttccagcagagccagcagcccaagccccacctgtgtggcagaagagatgtgtcctacaacaatgccaagcagaaggagctgcgctttgatgtgttccaggaggaggacagcaacagcgactatgacctgcagcagcctgcccctgggggcagcgaggtggcccccagcatgctggagatcaccatccagaatgccaaggcctacctgctgaagaccagcagcaacagcggcttcaacctgtatgaccacctgagcaacatgctgaccaagatcctgaatgaaagaccagaaaatgctgtggacatctttgagaacatcagccaggatgtgaagatggcccacttcagcaagaagtttgatgccctgcagaatgaaaatgagctgctgcccacctatgaaattgctgagaagcagaaggccctcttcctgcagggccacctggagggcgtggaccaggagctggaggatgaaattggccgctgcaactggttcaacagcatccagaagaatgaggaggaggaggaggaggaggatgaggagaaggatgacagcgactacatcgagcaggaggtgggcctgcccctgctgacccccatcagcgaggacctggagatccagaacatccccccctggaccacccggctgagcagcaacctgatcccccagtatgccatcgctgtgctgcagagcaacctgtggccaggggcctatgccttcagcaatggcaagaagtttgagaacttctacatcggctggggccacaagtacagcccagacaactacaccccacctgtgcccccacctgtgtaccaggagtaccccagcggccctgagatcacagagatggatgaccccagcgtggaggaggagcaggccttccgggccgcccaggaggccgtgctgctggccgcagaaaatgaggagagcgaggaggatgaagatgaagaagatgattatgactag

SEQ ID NO: 167027 - DNA, 1803 bp, Artificial Sequence
  Description of Artificial Sequence: Synthetic coding sequence
atggaggacagcaccagccccaagcaggagaaggagaaccaggaggagctgggggagacccggcggccctgggagggcaagacagctgccagcccccagtacagcgagcctgagagcagcgagcccctggaggccaagcagggccctgagaccggccggcagagccgcagcagccggccctggagcccccagagccgggccaagacccccctgggcggccctgctggccctgagaccagcagccctgcccctgtgagcccccgggagcccagcagcagccccagccccctggccccagcccggcaggacctggccgccccaccccagagcgacaggaccaccagcgtcatccctgaggccggcaccccctacccagaccccctggagcagagcagtgacaagcgggagagcaccccccaccacaccagccagagcgagggcaacaccttccagcagagccagcagcccaagccccacctgtgtggcagaagagatgtgtcctacaacaatgccaagcagaaggagctgcgctttgatgtgttccaggaggaggacagcaacagcgactatgacctgcagcagcctgcccctgggggcagcgaggtggcccccagcatgctggagatcaccatccagaatgccaaggcctacctgctgaagaccagcagcaacagcggcttcaacctgtatgaccacctgagcaacatgctgaccaagatcctgaatgaaagaccagaaaatgctgtggacatctttgagaacatcagccaggatgtgaagatggcccacttcagcaagaagtttgatgccctgcagaatgaaaatgagctgctgcccacctatgaaattgctgagaagcagaaggccctcttcctgcagggccacctggagggcgtggaccaggagctggaggatgaaattgctgaaaatgccctgcccaacgtgatggagagcgccttctactttgagcaggccggcgtgggcctgggcacagatgagacctaccgcatcttcctggccctgaagcagctgacagacacccaccccatccagcgctgccgcttctggggcaagatcctgggcctggagatgaactacatcgtggccgaggtggagttccgggagggagaagatgaggaggaggtggaggaggaggatgtggccgaggagcgggacaatggagagagcgaggcccatgaagatgaagaagatgagctgcccaagagcttctacaaggccccccaggccatccccaaggaggagagcaggactggagccaacaagtatgtgtactttgtgtgcaatgaacctggccggccctgggtgaagctgccccctgtgatcccagcccagatcgtcatcgccaggaagatcaagaagttcttcaccggccgcctggatgcccccatcatctcctacccacccttccctggaaatgaaagcaactacctgcgggcccagatcgcccgcatctctgctggcacccacgtgagccccctgggcttctaccagtttggagaggaggagggggaggaggaggaggaggccgagggcggcaggaacagctttgaagaaaatccagactttgagggcatccaggtgattgacctggtggagagcctgagcaactgggtgcaccacgtgcagcacatcctgagccagcgcttccgcatctacccacctggccagcacggctacccccagatctccttccacaacatgctgctgcagagcttcaaccccaccttcggcctggagcacatgcccagccccatggccaagagcctgaagatcagcacctag

SEQ ID NO: 167028 - DNA, 1536 bp, Artificial Sequence
  Description of Artificial Sequence: Synthetic coding sequence
atgctggagatcaccatccagaatgccaaggcctacctgctgaagaccagcagcaacagcggcttcaacctgtatgaccacctgagcaacatgctgaccaagatcctgaatgaaagaccagaaaatgctgtggacatctttgagaacatcagccaggatgtgaagatggcccacttcagcaagaagtttgatgccctgcagaatgaaaatgagctgctgcccacctatgaaattgctgagaagcagaaggccctcttcctgcagggccacctggagggcgtggaccaggagctggaggatgaaattgctgaaaatgccctgcccaacgtgatggagagcgccttctactttgagcaggccggcgtgggcctgggcacagatgagacctaccgcatcttcctggccctgaagcagctgacagacacccaccccatccagcgctgccgcttctggggcaagatcctgggcctggagatgaactacatcgtggccgaggtggagttccgggagggggaggatgaggaggaggtggaggaggaggatgtggccgaggagcgggacaacggggagagcgaggcccatgaagatgaggaggatgagctgcccaagagcttctacaaggccccccaggccatccccaaggaggagagcaggactggagccaacaagtatgtgtactttgtgtgcaatgagcccggccggccctgggtgaagctgccccctgtgatcccagcccagatcgtgattgccaggaagatcaagaagttcttcaccggccgcctggatgcccccatcatctcctacccacccttccctggaaatgaaagcaactacctgcgggcccagatcgcccgcatctctgctggcacccacgtgagccccctgggcttctaccagtttggagaggaggagggggaggaggaggaggaggccgagggcggcagaaattcctttgaggagaacccagactttgagggcatccaggtgattgacctggtggagagcctgagcaactgggtgcaccacgtgcagcacatcctgagccagggccgctgcaactggttcaacagcatccagaagaatgaggaggaggaggaggaggaggatgaggagaaggatgacagcgactacatcgagcaggaggtgggcctgcccctgctgacccccatcagcgaggacctggagatccagaacatccccccctggaccacccggctgagcagcaacctgatcccccagtatgccatcgctgtgctgcagagcaacctgtggccaggggcctatgccttcagcaatggcaagaagtttgagaacttctacatcggctggggccacaagtacagcccagacaactacaccccacctgtgcccccacctgtgtaccaggagtaccccagcggccctgagatcacagagatggatgaccccagcgtggaggaggagcaggccttccgggccgcccaggaggccgtgctgctggccgcagaaaatgaggagagcgaggaggatgaagatgaagaagatgattatgactag

SEQ ID NO: 167029 - DNA, 531 bp, Artificial Sequence
  Description of Artificial Sequence: Synthetic coding sequence
atgctggtgaagagggactaccgctatgacagagtgctcttctggggccgcatcctgggcctggtggccgactactacatcgcccagggcctgtctgaggaccagctggcccccaggaagaccctgtacagcctgaactgcacagagtggagcctgctgcccccagccacagaggagatggtggcccagagctctgtggtgaagggccgcttcatgggagaccccagctatgaatatgagcacacagagctgcagaaggtgaatgaaggagagaaggtgtttgaggaggagatcgtggtgcagatcaaggaggagacccggctggtgtctgtcatcgaccagattgacaaggctgtggccatcatccccaggggggccctcttcaagacccccttcggccccacccacgtgaacagaacatttgagggctactacaactggtacaagaccccagccccccaccccacctgtgatggcaaccagggcgtgcgggcccggggccgcagccccagcctgggccgcttcctgtag

SEQ ID NO: 167030 - DNA, 831 bp, Artificial Sequence
  Description of Artificial Sequence: Synthetic coding sequence
atggatgctgacagcctgctgctgagcctggagctggccagcggcagcggccagggcctgagcccagaccggcgggccagcctgctgaccagcctgatgctggtgaagagggactaccgctatgacagagtgctcttctggggccgcatcctgggcctggtggccgactactacatcgcccagggcctgtctgaggaccagctggcccccaggaagaccctgtacagcctgaactgcacagagtggagcctgctgcccccagccacagaggagatggtggcccagagctctgtggtgaagggccgcttcatgggagaccccagctatgaatatgagcacacagagctgcagaaggtgaatgaaggagagaaggtgtttgaggaggagatcgtggtgcagatcaaggaggagacccggctggtgtctgtcatcgaccagattgacaaggctgtggccatcatccccaggggggccctcttcaagacccccttcggccccacccacgtgaacagaacatttgagggcctgagcctgtctgaggccaagaagctgagcagctacttccacttccgggagcctgtggagctgaagaacaagaccctgctggagaaggctgacctggaccccagcctggacttcatggacagcctggagcatgacatccccaagggctcctggagcatccagatggagagaggaaatgccctggtggtgctgcggagcctgctgtggccaggcctgaccttctaccacgcccccaggaccaagaactacggctacgtgtatgtgggcactggagagaagaacatggacctgcccttcatgctgtag

SEQ ID NO: 167031 - DNA, 921 bp, Artificial Sequence
  Description of Artificial Sequence: Synthetic coding sequence
atggatgctgacagcctgctgctgagcctggagctggccagcggcagcggccagggcctgagcccagaccggcgggccagcctgctgaccagcctgatgctggtgaagagggactaccgctatgacagagtgctcttctggggccgcatcctgggcctggtggccgactactacatcgcccagggcctgtctgaggaccagctggcccccaggaagaccctgtacagcctgaactgcacagagtggagcctgctgcccccagccacagaggagatggtggcccagagctctgtggtgaagggccgcttcatgggagaccccagctatgaatatgagcacacagagctgcagaaggtgaatgaaggagagaaggtgtttgaggaggagatcgtcatcgacaaggctgtggccatcatccccaggggggccctcttcaagaccccatttggccccacccacgtgaacagaacatttgagggcctgagcctgtctgaggccaagaagctgagcagctacttccacttccgggagcctgtggagctgaagaacaagaccctgctggagaaggctgacctggaccccagcctggacttcatggacagcctggagcatgacatccccaagggcagcgaggccgtggtgcagggcgacttcacctggctgctgagccgctgtggcttcggctggccctgctcctgggacagctgcagcgtgtccatgagggtgctggagcacccagatggagagggccagtgccctggaggagctgcccagcctgccctggccggcccccacctgctgccctgcagcccccaccaggagctgtggctgcggctgcggggccactggagggaggagcacggcctggccctgcacgccatcgagtgggagcccgcctggatgttcctgaacagagtgtag

SEQ ID NO: 167032 - DNA, 402 bp, Artificial Sequence
  Description of Artificial Sequence: Synthetic coding sequence
tgactgaactgcacagagtggagcctgctgcccccagccacagaggagatggtggcccagagctctgtggtgaagggccgcttcatgggagaccccagctatgaatatgagcacacagagctgcagaaggtgaatgaaggagagaaggtgtttgaggaggagatcgtggtgcagatcaaggaggagacccggctggtgtctgtgattgaccagattgacaaggctgtggccatcatccccaggggggccctcttcaagaccccatttggccccacccacgtgaacagaacatttgagggctactacaactggtacaagaccccagccccccaccccacctgtgatggcaaccagggcgtgcgggcccggggccgcagccccagcctgggccgcttcctgtag

SEQ ID NO: 167033 - DNA, 1086 bp, Artificial Sequence
  Description of Artificial Sequence: Synthetic coding sequence
atgtgggtgctgaccccagctgcctttgctgggaagctgctgtctgtgttccggcagcccctgagcagcctgtggaggagcctggtgcccctcttctgctggctgcgggccaccttctggctgctggccaccaagaggaggaagcagcagctggtgctgcggggcccagatgagaccaaggaggaggaggaggacccccccctgcccaccacccccacctctgtgaactaccacttcacccggcagtgcaactacaagtgtggcttctgcttccacacagccaagaccagctttgtgctgcccctggaggaggccaagaggggcctgctgctgctgaaggaggccggcatggagaagatcaacttctctggaggagagcccttcctgcaggacagaggagagtacctgggcaagctggtgcgcttctgcaaggtggagctgcggctgcccagcgtgtccatcgtgtccaatggcagcctcatccgggagcgctggttccagaactatggagagtacctggacatcctggccatcagctgtgacagctttgatgaggaggtgaatgtgctgattggccggggccagggcaagaagaaccacgtggagaacctgcagaagctgcggcgctggtgccgggactacagagtggccttcaagatcaacagcgtcatcaaccgcttcaacgtggaggaggacatgacagagcagatcaaggccctgaaccctgtgcgctggaaggtgttccagtgcctgctgattgaaggagagaactgtggggaggatgccctgcgggaggccgagagatttgtgattggagatgaggagtttgagcgcttcctggagcggcacaaggaggtgtcctgcctggtgcctgagagcaaccagaagatgaaggacagctacctgatcctggatgagtacatgaggttcctgaactgcaggaaaggaaggaaggaccccagcaagagcatcctggatgtgggcgtggaggaggccatcaagttcagcggctttgatgagaagatgttcctgaagagaggaggcaagtacatctggagcaaggctgacctgaagctggactggtag

SEQ ID NO: 167034 - DNA, 765 bp, Artificial Sequence
  Description of Artificial Sequence: Synthetic coding sequence
atgctgcacagcagccactacccaggcatggagaagatcaacttcagcggcggggagcccttcctgcaggacagaggagagtacctgggcaagctggtgcgcttctgcaaggtggagctgcggctgcccagcgtgtccatcgtgtccaatggcagcctcatccgggagcgctggttccagaactacggggagtacctggacatcctggccatcagctgtgacagctttgatgaggaggtgaatgtgctgattggccggggccagggcaagaagaaccacgtggagaacctgcagaagctgcggcgctggtgccgggactacagagtggccttcaagatcaacagcgtcatcaaccgcttcaacgtggaggaggacatgacagagcagatcaaggccctgaaccctgtgcgctggaaggtgttccagtgcctgctgattgaaggagagaactgtggagaagatgccctgcgggaggccgagagatttgtgattggagatgaggagtttgagcgcttcctggagcggcacaaggaggtgtcctgcctggtgcctgagagcaaccagaagatgaaggacagctacctgatcctggatgagtacatgaggttcctgaactgcaggaagggcaggaaggaccccagcaagagcatcctggatgtgggcgtggaggaggccatcaagttcagcggctttgatgagaagatgttcctgaagaggggcggcaagtacatctggagcaaggctgacctgaagctggactggtag

SEQ ID NO: 167035 - DNA, 1674 bp, Artificial Sequence
  Description of Artificial Sequence: Synthetic coding sequence
atgtacaagagaaatggcctgatggcctctgtgctggtgaccagcgccaccccccagggcagcagcagcagtgacagcctggagggccagagctgtgactatgccagcaagagctatgatgctgtggtgtttgatgtgctgaaggtgaccccagaggagtttgccagccagatcaccctgatggacatccctgtgttcaaggccatccagcctgaggagctggccagctgtggctggagcaagaaggagaagcacagcctggcccccaacgtggtggccttcacccggcgcttcaaccaggtgtccttctgggtggtgcgggagatcctgacagcccagaccctgaagatccgggcagagatcctgagccactttgtgaagatcgccaagaagctgctggagctgaacaacctgcacagcctgatgtctgtggtgtctgccctgcagagcgcccccatcttccggctgaccaagacctgggccctgctgaacaggaaggacaagaccacctttgagaagctggactacctgatgagcaaagaagacaactacaagaggacccgggagtacatccgcagcctgaagatggtgcccagcatcccctacctgggcatctacctgctggacctgatctacattgattctgcctacccagccagcggcagcatcatggagaatgagcagaggagcaaccagatgaacaacatcctgcgcatcatcgctgacctgcaggtgtcctgcagctatgaccacctgaccaccctgccccacgtgcagaagtacctgaagtctgtgcgctacatcgaggagctgcagaagtttgtggaggatgacaactacaagctgagcctgcgcatcgagcccggcagcagcagcccccggctggtgagcagcaaggaggacctggccggccccagcgctggcagcggcagcgcccgcttcagccggcggcccacctgcccagacacctctgtggccggcagcctgcccaccccacctgtgcccaggcacaggaagagccacagcctgggcaacaacatgatgtgccagctgtctgtggtggagagcaagagcgccaccttccccagcgagaaggcccggcacctgctggatgattctgtgctggagagccgcagcccccggcggggcctggccctgaccagcagcagcgctgtgaccaacggcctgagcctgggcagcagcgagagcagcgagttcagcgaggagatgagcagcggcctggagagccccaccggcccctgcatctgcagcctgggcaacagcgctgctgtgcccaccatggagggccccctgcggaggaagaccctgctgaaggagggcaggaagccagccctgagctcctggacccgctactgggtgatcctgagcggcagcaccctgctgtactacggggccaagagcctgcggggcacagacaggaagcactacaagagcaccccaggcaagaaggtgtccatcgtgggctggatggtgcagctgcctgatgatcctgagcacccagacatcttccagctgaacaacccagacaagggaaatgtgtacaagttccagacaggcagccgcttccacgccatcctgtggcacaagcacctggatgatgcctgcaagagcaaccggccccaggtgcctgccaacctgatgagctttgaatag

SEQ ID NO: 167036 - DNA, 522 bp, Artificial Sequence
  Description of Artificial Sequence: Synthetic coding sequence
atgtacaagagaaatggcctgatggcctctgtgctggtgaccagcgccaccccccagggcagcagcagcagtgacagcctggagggccagagctgtgactatgccagcaagagctatgatgctgtggtgtttgatgtgctgaaggtgaccccagaggagtttgccagccagatcaccctgatggacatccctgtgttcaaggccatccagcctgaggagctggccagctgtggctggagcaagaaggagaagcacagcctggcccccaacgtggtggccttcacccggcgcttcaaccagaagctgctggagctgaacaacctgcacagcctgatgtctgtggtgtctgccctgcagagcgcccccatcttccggctgaccaagacctgggccctgctgaacaggaaggacaagaccacctttgagaagctggactacctgatgagcaaagaagacaactacaagaggacccgggagtacatccgcagcctgaagatggtgcccagcatcccctacctgtag

SEQ ID NO: 167037 - DNA, 1590 bp, Artificial Sequence
  Description of Artificial Sequence: Synthetic coding sequence
atgtacaagagaaatggcctgatggcctctgtgctggtgaccagcgccaccccccagggcagcagcagcagtgacagcctggagggccagagctgtgactatgccagcaagagctatgatgctgtggtgtttgatgtgctgaaggtgaccccagaggagtttgccagccagatcaccctgatggacatccctgtgttcaaggccatccagcctgaggagctggccagctgtggctggagcaagaaggagaagcacagcctggcccccaacgtggtggccttcacccggcgcttcaaccaggtgtccttctgggtggtgcgggagatcctgacagcccagaccctgaagatccgggcagagatcctgagccactttgtgaagatcgccaagaagctgctggagctgaacaacctgcacagcctgatgtctgtggtgtctgccctgcagagcgcccccatcttccggctgaccaagacctgggccctgctgaacaggaaggacaagaccacctttgagaagctggactacctgatgagcaaagaagacaactacaagaggacccgggagtacatccgcagcctgaagatggtgcccagcatcccctacctgggcatctacctgctggacctgatctacattgattctgcctacccagccagcggcagcatcatggagaatgagcagaggagcaaccagatgaacaacatcctgcgcatcatcgctgacctgcaggtgtcctgcagctatgaccacctgaccaccctgccccacgtgcagaagtacctgaagtctgtgcgctacatcgaggagctgcagaagtttgtggaggatgacaactacaagctgagcctgcgcatcgagcccggcagcagcagcccccggctggtgagcagcaaggaggacctggccggccccagcgctggcagcggcagcgcccgcttcagccggcggcccacctgcccagacacctctgtggccggcagcctgcccaccccacctgtgcccaggcacaggaagagccacagcctgggcaacaacagaggccgcctgtatgccaccctgggccccaactggagggtgcctgtgaggaacagccccaggaccaggagctgtgtgtacagccccaccggcccctgcatctgcagcctgggcaacagcgctgctgtgcccaccatggagggccccctgcggaggaagaccctgctgaaggagggcaggaagccagccctgagctcctggacccgctactgggtgatcctgagcggcagcaccctgctgtactacggggccaagagcctgcggggcacagacaggaagcacgtgtccatcgtgggctggatggtgcagctgcctgatgatcctgagcacccagacatcttccagctgaacaacccagacaagggaaatgtgtacaagttccagacaggcagccgcttccacgccatcctgtggcacaagcacctggatgatgcctgcaagagcaaccggccccaggaggccggggccgcccctggccccactggaacagacagccatgaggtggaccacctggagggcggggccggcaaggaggccggcccctgtgcctag

SEQ ID NO: 167038 - DNA, 918 bp, Artificial Sequence
  Description of Artificial Sequence: Synthetic coding sequence
atgtacaagagaaatggcctgatggcctctgtgctggtgaccagcgccaccccccagggcagcagcagcagtgacagcctggagggccagagctgtgactatgccagcaagagctatgatgctgtggtgtttgatgtgctgaaggtgaccccagaggagtttgccagccagatcaccctgatggacatccctgtgttcaaggccatccagcctgaggagctggccagctgtggctggagcaagaaggagaagcacagcctggcccccaacgtggtggccttcacccggcgcttcaaccaggtgtccttctgggtggtgcgggagatcctgacagcccagaccctgaagatccgggcagagatcctgagccactttgtgaagatcgccaagaagctgctggagctgaacaacctgcacagcctgatgtctgtggtgtctgccctgcagagcgcccccatcttccggctgaccaagacctgggccctgctgaacaggaaggacaagaccacctttgagaagctggactacctgatgagcaaagaagacaactacaagaggacccgggagtacatccgcagcctgaagatggtgcccagcatcccctacctgggcatctacctgctggacctgatctacattgattctgcctacccagccagcggcagcatcatggagaatgagcagaggagcaaccagatgaacaacatcctgcgcatcatcgctgacctgcaggtgtcctgcagctatgaccacctgaccaccctgccccacgtgcagaagtacctgaagtctgtgcgctacatcgaggagctgcagaagtttgtggaggatgacaactacaagctgagcctgcgcatcgagcccggcagcagcagcccccggctggtgagcagcaaggaggacctggccgccatgtag

SEQ ID NO: 167039 - DNA, 642 bp, Artificial Sequence
  Description of Artificial Sequence: Synthetic coding sequence
atgtacaagagaaatggcctgatggcctctgtgctggtgaccagcgccaccccccagggcagcagcagcagtgacagcctggagggccagagctgtgactatgccagcaagagctatgatgctgtggtgtttgatgtgctgaaggtgaccccagaggagtttgccagccagatcaccctgatggacatccctgtgttcaaggccatccagcctgaggagctggccagctgtggctggagcaagaaggagaagcacagcctggcccccaacgtggtggccttcacccggcgcttcaaccaggtgtccttctgggtggtgcgggagatcctgacagcccagaccctgaagatccgggcagagatcctgagccactttgtgaagatcgccaagaagctgctggagctgaacaacctgcacagcctgatgtctgtggtgtctgccctgcagagcgcccccatcttccggctgaccaagacctgggccctgctgaacaggaaggacaagaccacctttgagaagctggactacctgatgagcaaagaagacaactacaagaggacccgggagtacatccgcagcctgaagatggtgcccagcatcccctacctgggccgcagcctgaactggctgatcttcttctag

SEQ ID NO: 167040 - DNA, 327 bp, Artificial Sequence
  Description of Artificial Sequence: Synthetic coding sequence
atgtacaagagaaatggcctgatggcctctgtgctggtgaccagcgccaccccccagggcagcagcagcagtgacagcctggagggccagagctgtgactatgccagcaagagctatgatgctgtggtgtttgatgtgctgaaggtgaccccagaggagtttgccagccagatcaccctgatggacatccctgtgttcaaggccatccagcctgagaagggctggccagccaggatggaggacagcctgcagaagagcacagtgagcagccggccccatgacaccctgcagttcaggaagaccctgcctgtgggccctggcacctag

SEQ ID NO: 167041 - DNA, 1155 bp, Artificial Sequence
  Description of Artificial Sequence: Synthetic coding sequence
atgtacaagagaaatggcctgatggcctctgtgctggtgaccagcgccaccccccagggcagcagcagcagtgacagcctggagggccagagctgtgactatgccagcaagagctatgatgctgtggtgtttgatgtgctgaaggtgaccccagaggagtttgccagccagatcaccctgatggacatccctgtgttcaaggccatccagcctgaggagctggccagctgtggctggagcaagaaggagaagcacagcctggcccccaacgtggtggccttcacccggcgcttcaaccaggtgtccttctgggtggtgcgggagatcctgacagcccagaccctgaagatccgggcagagatcctgagccactttgtgaagatcgccaagaagctgctggagctgaacaacctgcacagcctgatgtctgtggtgtctgccctgcagagcgcccccatcttccggctgaccaagacctgggccctgctgaacaggaaggacaagaccacctttgagaagctggactacctgatgagcaaagaagacaactacaagaggacccgggagtacatccgcagcctgaagatggtgcccagcatcccctacctgggcatctacctgctggacctgatctacattgattctgcctacccagccagcggcagcatcatggagaatgagcagaggagcaaccagatgaacaacatcctgcgcatcatcgctgacctgcaggtgtcctgcagctatgaccacctgaccaccctgccccacgtgcagaagtacctgaagtctgtgcgctacatcgaggagctgcagaagtttgtggaggatgacaactacaagctgagcctgcgcatcgagcccggcagcagcagcccccggctggtgagcagcaaggaggacctggccgtgagccacctgagcagcctgagccaccagggccaggccgaggaggcccggctgaagcccaccagcggccagcacccagcctggatgtggcccagcagcagccgggtgcctgctgcccccccagccagcgctgcccccaggagcccctggcccaggaacctgagaaatgaccagggccagcccggggctgtggccctgacctgcaaccccagcaccctgggcagccgcagccgccgcatcacctag

SEQ ID NO: 167042 - DNA, 1614 bp, Artificial Sequence
  Description of Artificial Sequence: Synthetic coding sequence
atgtacaagagaaatggcctgatggcctctgtgctggtgaccagcgccaccccccagggcagcagcagcagtgacagcctggagggccagagctgtgactatgccagcaagagctatgatgctgtggtgtttgatgtgctgaaggtgaccccagaggagtttgccagccagatcaccctgatggacatccctgtgttcaaggccatccagcctgaggagctggccagctgtggctggagcaagaaggagaagcacagcctggcccccaacgtggtggccttcacccggcgcttcaaccaggtgtccttctgggtggtgcgggagatcctgacagcccagaccctgaagatccgggcagagatcctgagccactttgtgaagatcgccaagaagctgctggagctgaacaacctgcacagcctgatgtctgtggtgtctgccctgcagagcgcccccatcttccggctgaccaagacctgggccctgctgaacaggaaggacaagaccacctttgagaagctggactacctgatgagcaaagaagacaactacaagaggacccgggagtacatccgcagcctgaagatggtgcccagcatcccctacctgggcatctacctgctggacctgatctacattgattctgcctacccagccagcggcagcatcatggagaatgagcagaggagcaaccagatgaacaacatcctgcgcatcatcgctgacctgcaggtgtcctgcagctatgaccacctgaccaccctgccccacgtgcagaagtacctgaagtctgtgcgctacatcgaggagctgcagaagtttgtggaggatgacaactacaagctgagcctgcgcatcgagcccggcagcagcagcccccggctggtgagcagcaaggaggacctggccggccccagcgctggcagcggcagcgcccgcttcagccggcggcccacctgcccagacacctctgtggccggcagcctgcccaccccacctgtgcccaggcacaggaagagccacagcctgggcaacaacagaggccgcctgtatgccaccctgggccccaactggagggtgcctgtgaggaacagccccaggaccaggagctgtgtgtacagccccaccggcccctgcatctgcagcctgggcaacagcgctgctgtgcccaccatggagggccccctgcggaggaagaccctgctgaaggagggcaggaagccagccctgagctcctggacccgctactgggtgatcctgagcggcagcaccctgctgtactacggggccaagagcctgcggggcacagacaggaagcactacaagagcaccccaggcaagaaggtgtccatcgtgggctggatggtgcagctgcctgatgatcctgagcacccagacatcttccagctgaacaacccagacaagggaaatgtgtacaagttccagacaggcagccgcttccacgccatcctgtggcacaagcacctggatgatgcctgcaagagcaaccggccccaggaggccggggccgcccctggccccactggaacagacagccatgaggtggaccacctggagggcggggccggcaaggaggccggcccctgtgcctag

SEQ ID NO: 167043 - DNA, 462 bp, Artificial Sequence
  Description of Artificial Sequence: Synthetic coding sequence
tgaaacagccccaggaccaggagctgtgtgtacagccccaccggcccctgcatctgcagcctgggcaacagcgctgctgtgcccaccatggagggccccctgcggaggaagaccctgctgaaggagggcaggaagccagccctgagctcctggacccgctactgggtgatcctgagcggcagcaccctgctgtactacggggccaagagcctgcggggcacagacaggaagcactacaagagcaccccaggcaagaaggtgtccatcgtgggctggatggtgcagctgcctgatgatcctgagcacccagacatcttccagctgaacaacccagacaagggaaatgtgtacaagttccagacaggcagccgcttccacgccatcctgtggcacaagcacctggatgatgcctgcaagagcaaccggccccaggtgcctgccaacctgatgagctttgaatag

SEQ ID NO: 167044 - DNA, 6252 bp, Artificial Sequence
  Description of Artificial Sequence: Synthetic coding sequence
atgttcagcaagaagccccatggagatgtgaagaagagcacccagaaggtgctggacaccaagaaggatgccctgacccggctgaagcacctgagaattgtgattgaaaatgctgagagcattgacctgaagcagttctttgaccagcacttcagccacatctactacgtgttctttgagaactttgtgaccatcgaggccagcctgaagcagaagggccacaagagccagcgggaggagctggatgccatcctcttcatctttgagaagatcctgcagctgctgcctgagcgcatccaccagcgctggcagttccacagcatcggcctcatcctgaagaagctgctgcacacaggcaacagcctgaagatcagaagagagggcgtgcggctcttcctgctgtggctgcaggccctgcagaacaactgcagcaaggagcagctgtggatgttcagctgcctgatccctggcttcagcgccccccagagcgagcacggccccaggaccctggacaacctgatcaacccccccctgaacctgcaggagacccaggtgaccatcgaggagatcacccccctggtgcccccccagagcggggacaagggccaggaggacctgaccagctacttcctggaggccctgctgaagtacatcgtcatccaggtgaagagcctggagtggaagaacaaggagaaccaggagcggggcttctccttcctgttcagccacttcaagaagtactacctgccctacatcttccccaacatctgcaaggagaacagcctgtaccaccccatcctggacatcccccagatgaggcccaagccccactacgtggtgatcaagaaggatgctgagaccaatgaggccatctactgcaccaaggagcccttcatcaaggcccgggtcatcgtcatccgctggctggtgtccttctggctggagcccaagccccacacaggcccccacatccctggcatggagggggaggtgctgcccaagaacatccagagagctgctgccagcctggtgtcccgggaggagagcaagaatgacaatgctgacaagacagacaggaccacagagcctgagcagagccacagcaacaccagcaccctgacagagcgggagcccagcagcagcagcctgtgcagcattgatgaggagcacctgacagacatcgagatcgtgcggcgggtcttcagcagcaagaggagcaatgtgaactttgtgacagagatcttccggcaggccttcctgctgcccatctgtgaggccgccgccatgaggaaggtggtgaaggtgtaccaggagtggatccagcaggaggagaagcccctcttcatgcaggagcctgaggagatcgtcatcaccagcagtgacctgccctgcattgaaaatgtgacagaccatgacatctccatggaggagggggagaagcgggaggaggagaatggcaccaacacagctgaccacgtgaggaacagctcctgggccaagaatggcagctaccagggcgccctgcacaatgccagcgaggaggccacagagcagaacatccgggccggcacccaggccgtgctgcaggtgttcatcatcaacagcagcaacatcttcctgctggagcccgccaatgagatcaagaacctgctggatgagcacacagacatgtgcaagaggatcctgaacatctaccgctacatggtggtgcaggtgtccatggacaagaagacctgggagcagatgctgctggtgctgctgcgggtgacagagagcgtgctgaagatgcccagccaggccttcctgcagttccagggcaagaagaacatgaccctggccggccgcctggccggccccctcttccagaccctgattgtggcctggatcaaggccaacctgaatgtgtacatcagccgggagctgtgggatgacctgctgtctgtgctgagcagcctgacctactgggaggagctggccacagagtggagcctgaccatggagaccctgaccaaggtgctggccaggaacctgtacagcctggacctgagtgacctgcccctggacaagctgtctgagcagaagcagaagaagcacaagggcaaaggagtgggccacgagttccagaaggtgtctgtggacaagagcttcagccggggctggagccgggaccagcccggccaggcccccatgaggcagaggtctgccaccaccaccggcagccctggaacagagaaggcccggagcatcgtgcggcagaagacagtggccatgaggagccgcagcatcggggagtgtgccctgcccagcgcctacatccgcagcgccaagagcgcccctgtgctgatccacaccagcaagcccttcctgcctgacatcgtgctgacccccctgagtgatgagctgagtgacattgatgatgcccagatcctgcccaggagcaccagggtgcgccacttcagccagagcgaggagactggaaatgaggtgtttggagccctgaatgaggagcagcccctgcccaggagcagcagcaccagtgacatcctggagcccttcaccgtggagcgggccaaggtgaacaaggaggacatgagccagaagctgccccccctgaacagcgacattggaggcagcagcgccaacgtgcctgacctgatggatgagttcatcgccgagcggctgcggtctggaaatgccagcaccatgacccggcggggcagcagccctggcagcctggagatccccaaggacctgcctgacatcctgaacaagcagaaccagatgaggcccattgatgaccccggggtgcccagcgagtggaccagccctgccagcgctggcagcagtgacctgatcagcagtgacagccacagcgacagcttcagcgccttccagtatgatggcaggaagtttgacaactttggcttcggcacagacaccggggtgaccagcagcgcagatgtggacagcggcagcggccaccaccagagcgctgaggagcaggaggtggccagcctgaccaccctgcacattgattctgagaccagcagcctgaaccagcaggccttctctgctgaggtggccaccatcactggaagtgaaagtgccagccctgtgcacagccccctgggcagccgcagccagacccccagccccagcaccctgaacatcgaccacatggagcagaaggacctgcagctggatgagaagctgcaccacagcgtgctgcagaccccagatgacctggagatcagcgagttccccagcgagtgctgcagcgtgatggccggcggcaccctgaccggctggcatgctgatgtggccaccgtgatgtggaggaggatgctgggcatcctgggagatgtgaacagcatcatggaccctgagatccacgcccaggtgtttgactacctgtgtgagctgtggcagaacctggccaagatccgggacaacctgggcatcagcacagacaacctgaccagccccagcccccctgtgctgatcccccccctgcgcatcctgaccccctggctgttcaaggccaccatgctgacagacaagtacaagcagggcaagctgcacgcctacaagctgatctgcaacaccatgaagaggcggcaggatgtgagccccaacagagacttcctgacccacttctacaacatcatgcactgcggcctgctgcacatcgaccaggacatcgtgaacaccatcatcaagcactgcagcccccagttcttcagcctgggcctgcccggggccaccatgctgatcatggacttcatcgtggccgccggccgggtggccagcagcgccttcctgaatgccccccgggtggaggcccaggtgctgctgggcagcctggtgtgcttccccaacctgtactgtgagctgcccagcctgcaccccaacatcccagatgtggccgtgtcccagttcacagatgtgaaggagctgatcatcaagacagtgctgagcagcgccagagatgagcccagcggccctgcccgctgtgtggccctgtgcagcctgggcatctggatctgtgaggagctggtgcatgagagccaccacccccagatcaaggaggccctgaatgtcatctgtgtgtccctgaagttcaccaacaagacagtggcccacgtggcctgcaacatgctgcacatgctggtgcactacgtgccccggctgcagatctaccagcctgacagccccctgaagatcatccagatcctgattgccaccatcacccacctgctgcccagcacagaggccagcagctatgagatggacaagaggctggtggtgtccctgctgctgtgcctgctggactggatcatggccctgcccctgaagaccctgctgcagcccttccacgccactggagctgagagtgacaagacagagaagtctgtgctgaactgcatctacaaggtgctgcacggctgtgtgtatggagcccagtgcttcagcaacccccgctacttccccatgagcctgagtgacctggcctctgtggactatgaccccttcatgcacctggagagcctgaaggagcctgagcccctgcacagcccagacagcgagaggagcagcaagctgcagcctgtgacagaggtgaagacccagatgcagcacggcctcatcagcattgctgccaggacagtcatcacccacctggtgaaccacctgggccactaccccatgtctgggggccctgccatgctgaccagccaggtgtgtgagaaccacgacaaccactacagcgagagcacagagctgagccctgagctgtttgagagccccaacatccagttctttgtgctgaacaacaccaccctggtgtcctgcatccagatccgctctgaggagaacatgcctgggggcggcctgtctgctggcctggccagcgccaacagcaatgtgcgcatcatcgtgcgggacctgagcggcaagtacagctgggacagcgccatcctgtatggccccccacctgtgtctggcctgtctgagcccaccagcttcatgctgagcctgagccaccaggagaagccagaggagccccccaccagcaatgaatgtctggaggacatcaccgtgaaggatggcctgagcctgcagttcaagcgcttccgggagaccgtgcccacctgggacaccatcagagatgaagaagatgtgctggatgagctgctgcagtacctgggcgtgaccagcccagaatgtctgcagaggacaggcatcagcctgaacatcccagccccccagcctgtgtgcatcagcgagaagcaggagaatgatgtgatcaatgccatcctgaagcagcacacagaggagaaggagtttgtggagaagcacttcaatgacctgaacatgaaggctgtggagcaggatgagcccatcccccagaagccccagagcgccttctactactgccgcctgctgctgagcatcctgggcatgaacagctgggacaagagaagaagcttccacctgctgaagaagaatgagaagctgctgcgggagctgaggaacctggacagccggcagtgccgggagacccacaagattgctgtgttctacgtggccgagggccaggaggacaagcacagcatcctgaccaacacaggaggcagccaggcctatgaagattttgtggccggcctgggctgggaggtgaacctgaccaaccactgcggcttcatgggcggcctgcagaagaacaagagcacaggcctgaccaccccctactttgccaccagcacagtggaggtgatcttccacgtgtccaccaggatgcccagcgacagtgatgacagcctgaccaagaagctgcggcacctgggcaatgatgaggtgcacatcgtgtggagcgagcacacccgggactacagaagaggcatcatccccacagaatttggagatgtgctgattgtcatctaccccatgaagaaccacatgttcagcatccagatcatgaagaagccagaggtgcccttcttcggccccctgtttgatggagccatcgtgaatggcaaggtgctgcccatcatggtgcgggccacagccatcaatgccagccgggccctgaagagcctcatccccctgtaccagaacttctatgaggagcgggcccgctacctgcagaccatcgtgcagcaccacctggagcccaccacctttgaggactttgctgcccaggtgttctccccagccccctaccaccacctgcccagtgatgctgaccactag

SEQ ID NO: 167045 - DNA, 6252 bp, Artificial Sequence
  Description of Artificial Sequence: Synthetic coding sequence
atgttcagcaagaagccccatggagatgtgaagaagagcacccagaaggtgctggacaccaagaaggatgccctgacccggctgaagcacctgagaattgtgattgaaaatgctgagagcattgacctgaagcagttctttgaccagcacttcagccacatctactacgtgttctttgagaactttgtgaccatcgaggccagcctgaagcagaagggccacaagagccagcgggaggagctggatgccatcctcttcatctttgagaagatcctgcagctgctgcctgagcgcatccaccagcgctggcagttccacagcatcggcctcatcctgaagaagctgctgcacacaggcaacagcctgaagatcagaagagagggcgtgcggctcttcctgctgtggctgcaggccctgcagaacaactgcagcaaggagcagctgtggatgttcagctgcctgatccctggcttcagcgccccccagagcgagcacggccccaggaccctggacaacctgatcaacccccccctgaacctgcaggagacccaggtgaccatcgaggagatcacccccctggtgcccccccagagcggggacaagggccaggaggacctgaccagctacttcctggaggccctgctgaagtacatcgtcatccaggtgaagagcctggagtggaagaacaaggagaaccaggagcggggcttctccttcctgttcagccacttcaagaagtactacctgccctacatcttccccaacatctgcaaggagaacagcctgtaccaccccatcctggacatcccccagatgaggcccaagccccactacgtggtgatcaagaaggatgctgagaccaatgaggccatctactgcaccaaggagcccttcatcaaggcccgggtcatcgtcatccgctggctggtgtccttctggctggagcccaagccccacacaggcccccacatccctggcatggagggggaggtgctgcccaagaacatccagagagctgctgccagcctggtgtcccgggaggagagcaagaatgacaatgctgacaagacagacaggaccacagagcctgagcagagccacagcaacaccagcaccctgacagagcgggagcccagcagcagcagcctgtgcagcattgatgaggagcacctgacagacatcgagatcgtgcggcgggtcttcagcagcaagaggagcaatgtgaactttgtgacagagatcttccggcaggccttcctgctgcccatctgtgaggccgccgccatgaggaaggtggtgaaggtgtaccaggagtggatccagcaggaggagaagcccctcttcatgcaggagcctgaggagatcgtcatcaccagcagtgacctgccctgcattgaaaatgtgacagaccatgacatctccatggaggagggggagaagcgggaggaggagaatggcaccaacacagctgaccacgtgaggaacagctcctgggccaagaatggcagctaccagggcgccctgcacaatgccagcgaggaggccacagagcagaacatccgggccggcacccaggccgtgctgcaggtgttcatcatcaacagcagcaacatcttcctgctggagcccgccaatgagatcaagaacctgctggatgagcacacagacatgtgcaagaggatcctgaacatctaccgctacatggtggtgcaggtgtccatggacaagaagacctgggagcagatgctgctggtgctgctgcgggtgacagagagcgtgctgaagatgcccagccaggccttcctgcagttccagggcaagaagaacatgaccctggccggccgcctggccggccccctcttccagaccctgattgtggcctggatcaaggccaacctgaatgtgtacatcagccgggagctgtgggatgacctgctgtctgtgctgagcagcctgacctactgggaggagctggccacagagtggagcctgaccatggagaccctgaccaaggtgctggccaggaacctgtacagcctggacctgagtgacctgcccctggacaagctgtctgagcagaagcagaagaagcacaagggcaaaggagtgggccacgagttccagaaggtgtctgtggacaagagcttcagccggggctggagccgggaccagcccggccaggcccccatgaggcagaggtctgccaccaccaccggcagccctggaacagagaaggcccggagcatcgtgcggcagaagacagtggacattgatgatgcccagatcctgcccaggagcaccagggtgcgccacttcagccagagcgaggagactggaaatgaggtgtttggagccctgaatgaggagcagcccctgcccaggagcagcagcaccagtgacatcctggagcccttcaccgtggagcgggccaaggtgaacaaggaggacatgagccagaagctgccccccctgaacagcgacatcggcggcagcagcgccaacgtgcctgacctgatggatgagttcatcgccgagcggctgcggtctggaaatgccagcaccatgacccggcggggcagcagccctggcagcctggagatccccaaggacctgcctgacatcctgaacaagcagaaccagatgaggcccattgatgatcctggggtgcccagcgagtggaccagccctgccagcgctggcagcagtgacctgatcagcagtgacagccacagcgacagcttcagcgccttccagtatgatggcaggaagtttgacaactttggatttggaacagacacaggagtgaccagcagcgcagatgtggacagcggcagcggccaccaccagagcgctgaggagcaggaggtggccagcctgaccaccctgcacatcgacagcgagaccagcagcctgaaccagcaggccttctctgctgaggtggccaccatcaccggcagcgagagcgccagccctgtgcacagccccctgggcagccgcagccagacccccagccccagcaccctgaacatcgaccacatggagcagaaggacctgcagctggatgagaagctgcaccacagcgtgctgcagaccccagatgacctggagatcagcgagttccccagcgagtgctgcagcgtgatggccggcggcaccctgaccggctggcacgcagatgtggccaccgtgatgtggaggaggatgctgggcatcctgggagatgtgaacagcatcatggaccctgagatccacgcccaggtgtttgactacctgtgtgagctgtggcagaacctggccaagatccgggacaacctgggcatcagcacagacaacctgaccagccccagcccccctgtgctgatcccccccctgcgcatcctgaccccctggctgttcaaggccaccatgctgacagacaagtacaagcagggcaagctgcacgcctacaagctgatctgcaacaccatgaagaggcggcaggatgtgagccccaacagagacttcctgacccacttctacaacatcatgcactgcggcctgctgcacatcgaccaggacatcgtgaacaccatcatcaagcactgcagcccccagttcttcagcctgggcctgcccggggccaccatgctgatcatggacttcatcgtggccgccggccgggtggccagcagcgccttcctgaatgccccccgggtggaggcccaggtgctgctgggcagcctggtgtgcttccccaacctgtactgtgagctgcccagcctgcaccccaacatcccagatgtggccgtgtcccagttcacagatgtgaaggagctgatcatcaagacagtgctgagcagcgccagagatgagcccagcggccctgcccgctgtgtggccctgtgcagcctgggcatctggatctgtgaggagctggtgcatgagagccaccacccccagatcaaggaggccctgaatgtcatctgtgtgtccctgaagttcaccaacaagacagtggcccacgtggcctgcaacatgctgcacatgctggtgcactacgtgccccggctgcagatctaccagcctgacagccccctgaagatcatccagatcctgattgccaccatcacccacctgctgcccagcacagaggccagcagctatgagatggacaagaggctggtggtgtccctgctgctgtgcctgctggactggatcatggccctgcccctgaagaccctgctgcagcccttccacgccaccggggctgagagtgacaagacagagaagtctgtgctgaactgcatctacaaggtgctgcacggctgtgtgtatggagcccagtgcttcagcaacccccgctacttccccatgagcctgagtgacctggcctctgtggactatgaccccttcatgcacctggagagcctgaaggagcctgagcccctgcacagcccagattctgagaggagcagcaagctgcagcctgtgacagaggtgaagacccagatgcagcacggcctcatcagcattgctgccaggacagtcatcacccacctggtgaaccacctgggccactaccccatgtctgggggccctgccatgctgaccagccaggtgtgtgaaaatcatgacaaccactacagcgagagcacagagctgagccctgagctgtttgagagccccaacatccagttctttgtgctgaacaacaccaccctggtgtcctgcatccagatccgctctgaggagaacatgcctgggggcggcctgtctgctggcctggccagcgccaacagcaatgtgcgcatcatcgtgcgggacctgagcggcaagtacagctgggacagcgccatcctgtatggccccccacctgtgtctggcctgtctgagcccaccagcttcatgctgagcctgagccaccaggagaagccagaggagccccccaccagcaatgaatgtctggaggacatcaccgtgaaggatggcctgagcctgcagttcaagcgcttccgggagaccgtgcccacctgggacaccatcagagatgaggaggatgtgctggatgagctgctgcagtacctgggcgtgaccagccctgagtgcctgcagaggacaggcatcagcctgaacatcccagccccccagcctgtgtgcatcagcgagaagcaggagaatgatgtgatcaatgccatcctgaagcagcacacagaggagaaggagtttgtggagaagcacttcaatgacctgaacatgaaggctgtggagcaggatgagcccatcccccagaagccccagagcgccttctactactgccgcctgctgctgagcatcctgggcatgaacagctgggacaagaggaggagcttccacctgctgaagaagaatgagaagctgctgcgggagctgaggaacctggacagccggcagtgccgggagacccacaagattgctgtgttctacgtggccgagggccaggaggacaagcacagcatcctgaccaacacaggaggcagccaggcctatgaggactttgtggccggcctgggctgggaggtgaacctgaccaaccactgcggcttcatgggcggcctgcagaagaacaagagcacaggcctgaccaccccctactttgccaccagcacagtggaggtgatcttccacgtgtccaccaggatgcccagcgacagtgatgacagcctgaccaagaagctgcggcacctgggcaatgatgaggtgcacatcgtgtggagcgagcacacccgggactaccgccggggcatcatccccacagaatttggagatgtgctgattgtcatctaccccatgaagaaccacatgttcagcatccagatcatgaagaagccagaggtgcccttcttcggccccctgtttgatggagccatcgtgaatggcaaggtgctgcccatcatggtgcgggccacagccatcaatgccagccgggccctgaagagcctcatccccctgtaccagaacttctatgaggagcgggcccgctacctgcagaccatcgtgcagcaccacctggagcccaccacctttgaagattttgctgcccaggtgttcagccctgccccctaccaccacctgcccagtgatgctggcagctacccagagatcctgcccagcgagacccccacagccacccaggtggatggagctgacctggccagccccatgagccccaggaccagcaagagcaggatgtccatgaagctgcggcgcagcagcggcagcgccaacaagagctag

SEQ ID NO: 167046 - DNA, 6222 bp, Artificial Sequence
  Description of Artificial Sequence: Synthetic coding sequence
atgttcagcaagaagccccatggagatgtgaagaagagcacccagaaggtgctggacaccaagaaggatgccctgacccggctgaagcacctgagaattgtgattgaaaatgctgagagcattgacctgaagcagttctttgaccagcacttcagccacatctactacgtgttctttgagaactttgtgaccatcgaggccagcctgaagcagaagggccacaagagccagcgggaggagctggatgccatcctcttcatctttgagaagatcctgcagctgctgcctgagcgcatccaccagcgctggcagttccacagcatcggcctcatcctgaagaagctgctgcacacaggcaacagcctgaagatcagaagagagggcgtgcggctcttcctgctgtggctgcaggccctgcagaacaactgcagcaaggagcagctgtggatgttcagctgcctgatccctggcttcagcgccccccagagcgagcacggccccaggaccctggacaacctgatcaacccccccctgaacctgcaggagacccaggtgaccatcgaggagatcacccccctggtgcccccccagagcggggacaagggccaggaggacctgaccagctacttcctggaggccctgctgaagtacatcgtcatccaggtgaagagcctggagtggaagaacaaggagaaccaggagcggggcttctccttcctgttcagccacttcaagaagtactacctgccctacatcttccccaacatctgcaaggagaacagcctgtaccaccccatcctggacatcccccagatgaggcccaagccccactacgtggtgatcaagaaggatgctgagaccaatgaggccatctactgcaccaaggagcccttcatcaaggcccgggtcatcgtcatccgctggctggtgtccttctggctggagcccaagccccacacaggcccccacatccctggcatggagggggaggtgctgcccaagaacatccagagagctgctgccagcctggtgtcccgggaggagagcaagaatgacaatgctgacaagacagacaggaccacagagcctgagcagagccacagcaacaccagcaccctgacagagcgggagcccagcagcagcagcctgtgcagcattgatgaggagcacctgacagacatcgagatcgtgcggcgggtcttcagcagcaagaggagcaatgtgaactttgtgacagagatcttccggcaggccttcctgctgcccatctgtgaggccgccgccatgaggaaggtggtgaaggtgtaccaggagtggatccagcaggaggagaagcccctcttcatgcaggagcctgaggagatcgtcatcaccagcagtgacctgccctgcattgaaaatgtgacagaccatgacatctccatggaggagggggagaagcgggaggaggagaatggcaccaacacagctgaccacgtgaggaacagctcctgggccaagaatggcagctaccagggcgccctgcacaatgccagcgaggaggccacagagcagaacatccgggccggcacccaggccgtgctgcaggtgttcatcatcaacagcagcaacatcttcctgctggagcccgccaatgagatcaagaacctgctggatgagcacacagacatgtgcaagaggatcctgaacatctaccgctacatggtggtgcaggtgtccatggacaagaagacctgggagcagatgctgctggtgctgctgcgggtgacagagagcgtgctgaagatgcccagccaggccttcctgcagttccagggcaagaagaacatgaccctggccggccgcctggccggccccctcttccagaccctgattgtggcctggatcaaggccaacctgaatgtgtacatcagccgggagctgtgggatgacctgctgtctgtgctgagcagcctgacctactgggaggagctggccacagagtggagcctgaccatggagaccctgaccaaggtgctggccaggaacctgtacagcctggacctgagtgacctgcccctggacaagctgtctgagcagaagcagaagaagcacaagggcaaaggagtgggccacgagttccagaaggtgtctgtggacaagagcttcagccggggctggagccgggaccagcccggccaggcccccatgaggcagaggtctgccaccaccaccggcagccctggaacagagaaggcccggagcatcgtgcggcagaagacagtggacattgatgatgcccagatcctgcccaggagcaccagggtgcgccacttcagccagagcgaggagactggaaatgaggtgtttggagccctgaatgaggagcagcccctgcccaggagcagcagcaccagtgacatcctggagcccttcaccgtggagcgggccaaggtgaacaaggaggacatgagccagaagctgccccccctgaacagcgacatcggcggcagcagcgccaacgtgcctgacctgatggatgagttcatcgccgagcggctgcggtctggaaatgccagcaccatgacccggcggggcagcagccctggcagcctggagatccccaaggacctgcctgacatcctgaacaagcagaaccagatgaggcccattgatgatcctggggtgcccagcgagtggaccagccctgccagcgctggcagcagtgacctgatcagcagtgacagccacagcgacagcttcagcgccttccagtatgatggcaggaagtttgacaactttggatttggaacagacacaggagtgaccagcagcgcagatgtggacagcggcagcggccaccaccagagcgctgaggagcaggaggtggccagcctgaccaccctgcacatcgacagcgagaccagcagcctgaaccagcaggccttctctgctgaggtggccaccatcaccggcagcgagagcgccagccctgtgcacagccccctgggcagccgcagccagacccccagccccagcaccctgaacatcgaccacatggagcagaaggacctgcagctggatgagaagctgcaccacagcgtgctgcagaccccagatgacctggagatcagcgagttccccagcgagtgctgcagcgtgatggccggcggcaccctgaccggctggcacgcagatgtggccaccgtgatgtggaggaggatgctgggcatcctgggagatgtgaacagcatcatggaccctgagatccacgcccaggtgtttgactacctgtgtgagctgtggcagaacctggccaagatccgggacaacctgggcatcagcacagacaacctgaccagccccagcccccctgtgctgatcccccccctgcgcatcctgaccccctggctgttcaaggccaccatgctgacagacaagtacaagcagggcaagctgcacgcctacaagctgatctgcaacaccatgaagaggcggcaggatgtgagccccaacagagacttcctgacccacttctacaacatcatgcactgcggcctgctgcacatcgaccaggacatcgtgaacaccatcatcaagcactgcagcccccagttcttcagcctgggcctgcccggggccaccatgctgatcatggacttcatcgtggccgccggccgggtggccagcagcgccttcctgaatgccccccgggtggaggcccaggtgctgctgggcagcctggtgtgcttccccaacctgtactgtgagctgcccagcctgcaccccaacatcccagatgtggccgtgtcccagttcacagatgtgaaggagctgatcatcaagacagtgctgagcagcgccagagatgagcccagcggccctgcccgctgtgtggccctgtgcagcctgggcatctggatctgtgaggagctggtgcatgagagccaccacccccagatcaaggaggccctgaatgtcatctgtgtgtccctgaagttcaccaacaagacagtggcccacgtggcctgcaacatgctgcacatgctggtgcactacgtgccccggctgcagatctaccagcctgacagccccctgaagatcatccagatcctgattgccaccatcacccacctgctgcccagcacagaggccagcagctatgagatggacaagaggctggtggtgtccctgctgctgtgcctgctggactggatcatggccctgcccctgaagaccctgctgcagcccttccacgccaccggggctgagagtgacaagacagagaagtctgtgctgaactgcatctacaaggtgctgcacggctgtgtgtatggagcccagtgcttcagcaacccccgctacttccccatgagcctgagtgacctggcctctgtggactatgaccccttcatgcacctggagagcctgaaggagcctgagcccctgcacagcccagattctgagaggagcagcaagctgcagcctgtgacagaggtgaagacccagatgcagcacggcctcatcagcattgctgccaggacagtcatcacccacctggtgaaccacctgggccactaccccatgtctgggggccctgccatgctgaccagccaggtgtgtgaaaatcatgacaaccactacagcgagagcacagagctgagccctgagctgtttgagagccccaacatccagttctttgtgctgaacaacaccaccctggtgtcctgcatccagatccgctctgaggagaacatgcctgggggcggcctgtctgctggcctggccagcgccaacagcaatgtgcgcatcatcgtgcgggacctgagcggcaagtacagctgggacagcgccatcctgtatggccccccacctgtgtctggcctgtctgagcccaccagcttcatgctgagcctgagccaccaggagaagccagaggagccccccaccagcaatgaatgtctggaggacatcaccgtgaaggatggcctgagcctgcagttcaagcgcttccgggagaccgtgcccacctgggacaccatcagagatgaggaggatgtgctggatgagctgctgcagtacctgggcgtgaccagccctgagtgcctgcagaggacaggcatcagcctgaacatcccagccccccagcctgtgtgcatcagcgagaagcaggagaatgatgtgatcaatgccatcctgaagcagcacacagaggagaaggagtttgtggagaagcacttcaatgacctgaacatgaaggctgtggagcaggatgagcccatcccccagaagccccagagcgccttctactactgccgcctgctgctgagcatcctgggcatgaacagctgggacaagaggaggagcttccacctgctgaagaagaatgagaagctgctgcgggagctgaggaacctggacagccggcagtgccgggagacccacaagattgctgtgttctacgtggccgagggccaggaggacaagcacagcatcctgaccaacacaggaggcagccaggcctatgaggactttgtggccggcctgggctgggaggtgaacctgaccaaccactgcggcttcatgggcggcctgcagaagaacaagagcacaggcctgaccaccccctactttgccaccagcacagtggaggtgatcttccacgtgtccaccaggatgcccagcgacagtgatgacagcctgaccaagaagctgcggcacctgggcaatgatgaggtgcacatcgtgtggagcgagcacacccgggactaccgccggggcatcatccccacagaatttggagatgtgctgattgtcatctaccccatgaagaaccacatgttcagcatccagatcatgaagaagccagaggtgcccttcttcggccccctgtttgatggagccatcgtgaatggcaaggtgctgcccatcatggtgcgggccacagccatcaatgccagccgggccctgaagagcctcatccccctgtaccagaacttctatgaggagcgggcccgctacctgcagaccatcgtgcagcaccacctggagcccaccacctttgaagattttgctgcccaggtgttcagccctgccccctaccaccacctgcccagtgatgctgaggagagaaatgctgtgattgtgctcttcctgcccaagccacccctggagaacatcggccacctgaaggcccccacccagcgcttctaccctgtgaagctgccccagcagaggaggtag

SEQ ID NO: 167047 - DNA, 6150 bp, Artificial Sequence
  Description of Artificial Sequence: Synthetic coding sequence
atgttcagcaagaagccccatggagatgtgaagaagagcacccagaaggtgctggacaccaagaaggatgccctgacccggctgaagcacctgagaattgtgattgaaaatgctgagagcattgacctgaagcagttctttgaccagcacttcagccacatctactacgtgttctttgagaactttgtgaccatcgaggccagcctgaagcagaagggccacaagagccagcgggaggagctggatgccatcctcttcatctttgagaagatcctgcagctgctgcctgagcgcatccaccagcgctggcagttccacagcatcggcctcatcctgaagaagctgctgcacacaggcaacagcctgaagatcagaagagagggcgtgcggctcttcctgctgtggctgcaggccctgcagaacaactgcagcaaggagcagctgtggatgttcagctgcctgatccctggcttcagcgccccccagagcgagcacggccccaggaccctggacaacctgatcaacccccccctgaacctgcaggagacccaggtgaccatcgaggagatcacccccctggtgcccccccagagcggggacaagggccaggaggacctgaccagctacttcctggaggccctgctgaagtacatcgtcatccaggtgaagagcctggagtggaagaacaaggagaaccaggagcggggcttctccttcctgttcagccacttcaagaagtactacctgccctacatcttccccaacatctgcaaggagaacagcctgtaccaccccatcctggacatcccccagatgaggcccaagccccactacgtggtgatcaagaaggatgctgagaccaatgaggccatctactgcaccaaggagcccttcatcaaggcccgggtcatcgtcatccgctggctggtgtccttctggctggagcccaagccccacacaggcccccacatccctggcatggagggggaggtgctgcccaagaacatccagagagctgctgccagcctggtgtcccgggaggagagcaagaatgacaatgctgacaagacagacaggaccacagagcctgagcagagccacagcaacaccagcaccctgacagagcgggagcccagcagcagcagcctgtgcagcattgatgaggagcacctgacagacatcgagatcgtgcggcgggtcttcagcagcaagaggagcaatgtgaactttgtgacagagatcttccggcaggccttcctgctgcccatctgtgaggccgccgccatgaggaaggtggtgaaggtgtaccaggagtggatccagcaggaggagaagcccctcttcatgcaggagcctgaggagatcgtcatcaccagcagtgacctgccctgcattgaaaatgtgacagaccatgacatctccatggaggagggggagaagcgggaggaggagaatggcaccaacacagctgaccacgtgaggaacagctcctgggccaagaatggcagctaccagggcgccctgcacaatgccagcgaggaggccacagagcagaacatccgggccggcacccaggccgtgctgcaggtgttcatcatcaacagcagcaacatcttcctgctggagcccgccaatgagatcaagaacctgctggatgagcacacagacatgtgcaagaggatcctgaacatctaccgctacatggtggtgcaggtgtccatggacaagaagacctgggagcagatgctgctggtgctgctgcgggtgacagagagcgtgctgaagatgcccagccaggccttcctgcagttccagggcaagaagaacatgaccctggccggccgcctggccggccccctcttccagaccctgattgtggcctggatcaaggccaacctgaatgtgtacatcagccgggagctgtgggatgacctgctgtctgtgctgagcagcctgacctactgggaggagctggccacagagtggagcctgaccatggagaccctgaccaaggtgctggccaggaacctgtacagcctggacctgagtgacctgcccctggacaagctgtctgagcagaagcagaagaagcacaagggcaaaggagtgggccacgagttccagaaggtgtctgtggacaagagcttcagccggggctggagccgggaccagcccggccaggcccccatgaggcagaggtctgccaccaccaccggcagccctggaacagagaaggcccggagcatcgtgcggcagaagacagtggacattgatgatgcccagatcctgcccaggagcaccagggtgcgccacttcagccagagcgaggagactggaaatgaggtgtttggagccctgaatgaggagcagcccctgcccaggagcagcagcaccagtgacatcctggagcccttcaccgtggagcgggccaaggaggccgagcagaatgccacccggggcagcacagagggctctgtgcagagctgcaatggcctcttctggaaggagagctgcagcgacattggaggcagcagcgccaacgtgcctgacctgatggatgagttcatcgccgagcggctgcggtctggaaatgccagcaccatgacccggcggggcagcagccctggcagcctggagatccccaaggacctgcctgacatcctgaacaagcagaaccagatgaggcccattgatgaccccggggtgcccagcgagtggaccagccctgccagcgctggcagcagtgacctgatcagcagtgacagccacagcgacagcttcagcgccttccagtatgatggcaggaagtttgacaactttggcttcggcacagacaccggggtgaccagcagcgcagatgtggacagcggcagcggccaccaccagagcgctgaggagcaggaggtggccagcctgaccaccctgcacattgattctgagaccagcagcctgaaccagcaggccttctctgctgaggtggccaccatcactggaagtgaaagtgccagccctgtgcacagccccctgggcagccgcagccagacccccagccccagcaccctgaacatcgaccacatggagcagaaggacctgcagctggatgagaagctgcaccacagcgtgctgcagaccccagatgacctggagatcagcgagttccccagcgagtgctgcagcgtgatggccggcggcaccctgaccggctggcatgctgatgtggccaccgtgatgtggaggaggatgctgggcatcctgggagatgtgaacagcatcatggaccctgagatccacgcccaggtgtttgactacctgtgtgagctgtggcagaacctggccaagatccgggacaacctgggcatcagcacagacaacctgaccagccccagcccccctgtgctgatcccccccctgcgcatcctgaccccctggctgttcaaggccaccatgctgacagacaagtacaagcagggcaagctgcacgcctacaagctgatctgcaacaccatgaagaggcggcaggatgtgagccccaacagagacttcctgacccacttctacaacatcatgcactgcggcctgctgcacatcgaccaggacatcgtgaacaccatcatcaagcactgcagcccccagttcttcagcctgggcctgcccggggccaccatgctgatcatggacttcatcgtggccgccggccgggtggccagcagcgccttcctgaatgccccccgggtggaggcccaggtgctgctgggcagcctggtgtgcttccccaacctgtactgtgagctgcccagcctgcaccccaacatcccagatgtggccgtgtcccagttcacagatgtgaaggagctgatcatcaagacagtgctgagcagcgccagagatgagcccagcggccctgcccgctgtgtggccctgtgcagcctgggcatctggatctgtgaggagctggtgcatgagagccaccacccccagatcaaggaggccctgaatgtcatctgtgtgtccctgaagttcaccaacaagacagtggcccacgtggcctgcaacatgctgcacatgctggtgcactacgtgccccggctgcagatctaccagcctgacagccccctgaagatcatccagatcctgattgccaccatcacccacctgctgcccagcacagaggccagcagctatgagatggacaagaggctggtggtgtccctgctgctgtgcctgctggactggatcatggccctgcccctgaagaccctgctgcagcccttccacgccactggagctgagagtgacaagacagagaagtctgtgctgaactgcatctacaaggtgctgcacggctgtgtgtatggagcccagtgcttcagcaacccccgctacttccccatgagcctgagtgacctggcctctgtggactatgaccccttcatgcacctggagagcctgaaggagcctgagcccctgcacagcccagacagcgagaggagcagcaagctgcagcctgtgacagaggtgaagacccagatgcagcacggcctcatcagcattgctgccaggacagtcatcacccacctggtgaaccacctgggccactaccccatgtctgggggccctgccatgctgaccagccaggtgtgtgagaaccacgacaaccactacagcgagagcacagagctgagccctgagctgtttgagagccccaacatccagttctttgtgctgaacaacaccaccctggtgtcctgcatccagatccgctctgaggagaacatgcctgggggcggcctgtctgctggcctggccagcgccaacagcaatgtgcgcatcatcgtgcgggacctgagcggcaagtacagctgggacagcgccatcctgtatggccccccacctgtgtctggcctgtctgagcccaccagcttcatgctgagcctgagccaccaggagaagccagaggagccccccaccagcaatgaatgtctggaggacatcaccgtgaaggatggcctgagcctgcagttcaagcgcttccgggagaccgtgcccacctgggacaccatcagagatgaagaagatgtgctggatgagctgctgcagtacctgggcgtgaccagcccagaatgtctgcagaggacaggcatcagcctgaacatcccagccccccagcctgtgtgcatcagcgagaagcaggagaatgatgtgatcaatgccatcctgaagcagcacacagaggagaaggagtttgtggagaagcacttcaatgacctgaacatgaaggctgtggagcaggatgagcccatcccccagaagccccagagcgccttctactactgccgcctgctgctgagcatcctgggcatgaacagctgggacaagagaagaagcttccacctgctgaagaagaatgagaagctgctgcgggagctgaggaacctggacagccggcagtgccgggagacccacaagattgctgtgttctacgtggccgagggccaggaggacaagcacagcatcctgaccaacacaggaggcagccaggcctatgaagattttgtggccggcctgggctgggaggtgaacctgaccaaccactgcggcttcatgggcggcctgcagaagaacaagagcacaggcctgaccaccccctactttgccaccagcacagtggaggtgatcttccacgtgtccaccaggatgcccagcgacagtgatgacagcctgaccaagaagctgcggcacctgggcaatgatgaggtgcacatcgtgtggagcgagcacacccgggactacagaagaggcatcatccccacagaatttggagatgtgctgattgtcatctaccccatgaagaaccacatgttcagcatccagatcatgaagaagccagaggtgcccttcttcggccccctgtttgatggagccatcgtgaatggcaaggtgctgcccatcatggtgcgggccacagccatcaatgccagccgggccctgaagagcctcatccccctgtaccagaacttctatgaggagcgggcccgctacctgcagaccatcgtgcagcaccacctggagcccaccacctttgaggactttgctgcccaggtgttctccccagccccctaccaccacctgcccagtgatgctgaccactag

SEQ ID NO: 167048 - DNA, 6111 bp, Artificial Sequence
  Description of Artificial Sequence: Synthetic coding sequence
atgttcagcaagaagccccatggagatgtgaagaagagcacccagaaggtgctggacaccaagaaggatgccctgacccggctgaagcacctgagaattgtgattgaaaatgctgagagcattgacctgaagcagttctttgaccagcacttcagccacatctactacgtgttctttgagaactttgtgaccatcgaggccagcctgaagcagaagggccacaagagccagcgggaggagctggatgccatcctcttcatctttgagaagatcctgcagctgctgcctgagcgcatccaccagcgctggcagttccacagcatcggcctcatcctgaagaagctgctgcacacaggcaacagcctgaagatcagaagagagggcgtgcggctcttcctgctgtggctgcaggccctgcagaacaactgcagcaaggagcagctgtggatgttcagctgcctgatccctggcttcagcgccccccagagcgagcacggccccaggaccctggacaacctgatcaacccccccctgaacctgcaggagacccaggtgaccatcgaggagatcacccccctggtgcccccccagagcggggacaagggccaggaggacctgaccagctacttcctggaggccctgctgaagtacatcgtcatccaggtgaagagcctggagtggaagaacaaggagaaccaggagcggggcttctccttcctgttcagccacttcaagaagtactacctgccctacatcttccccaacatctgcaaggagaacagcctgtaccaccccatcctggacatcccccagatgaggcccaagccccactacgtggtgatcaagaaggatgctgagaccaatgaggccatctactgcaccaaggagcccttcatcaaggcccgggtcatcgtcatccgctggctggtgtccttctggctggagcccaagccccacacaggcccccacatccctggcatggagggggaggtgctgcccaagaacatccagagagctgctgccagcctggtgtcccgggaggagagcaagaatgacaatgctgacaagacagacaggaccacagagcctgagcagagccacagcaacaccagcaccctgacagagcgggagcccagcagcagcagcctgtgcagcattgatgaggagcacctgacagacatcgagatcgtgcggcgggtcttcagcagcaagaggagcaatgtgaactttgtgacagagatcttccggcaggccttcctgctgcccatctgtgaggccgccgccatgaggaaggtggtgaaggtgtaccaggagtggatccagcaggaggagaagcccctcttcatgcaggagcctgaggagatcgtcatcaccagcagtgacctgccctgcattgaaaatgtgacagaccatgacatctccatggaggagggggagaagcgggaggaggagaatggcaccaacacagctgaccacgtgaggaacagctcctgggccaagaatggcagctaccagggcgccctgcacaatgccagcgaggaggccacagagcagaacatccgggccggcacccaggccgtgctgcaggtgttcatcatcaacagcagcaacatcttcctgctggagcccgccaatgagatcaagaacctgctggatgagcacacagacatgtgcaagaggatcctgaacatctaccgctacatggtggtgcaggtgtccatggacaagaagacctgggagcagatgctgctggtgctgctgcgggtgacagagagcgtgctgaagatgcccagccaggccttcctgcagttccagggcaagaagaacatgaccctggccggccgcctggccggccccctcttccagaccctgattgtggcctggatcaaggccaacctgaatgtgtacatcagccgggagctgtgggatgacctgctgtctgtgctgagcagcctgacctactgggaggagctggccacagagtggagcctgaccatggagaccctgaccaaggtgctggccaggaacctgtacagcctggacctgagtgacctgcccctggacaagctgtctgagcagaagcagaagaagcacaagggcaaaggagtgggccacgagttccagaaggtgtctgtggacaagagcttcagccggggctggagccgggaccagcccggccaggcccccatgaggcagaggtctgccaccaccaccggcagccctggaacagagaaggcccggagcatcgtgcggcagaagacagtggacattgatgatgcccagatcctgcccaggagcaccagggtgcgccacttcagccagagcgaggagactggaaatgaggtgtttggagccctgaatgaggagcagcccctgcccaggagcagcagcaccagtgacatcctggagcccttcaccgtggagcgggccaaggtgaacaaggaggacatgagccagaagctgccccccctgaacagcgacatcggcggcagcagcgccaacgtgcctgacctgatggatgagttcatcgccgagcggctgcggtctggaaatgccagcaccatgacccggcggggcagcagccctggcagcctggagatccccaaggacctgcctgacatcctgaacaagcagaaccagatgaggcccattgatgatcctggggtgcccagcgagtggaccagccctgccagcgctggcagcagtgacctgatcagcagtgacagccacagcgacagcttcagcgccttccagtatgatggcaggaagtttgacaactttggatttggaacagacacaggagtgaccagcagcgcagatgtggacagcggcagcggccaccaccagagcgctgaggagcaggaggtggccagcctgaccaccctgcacatcgacagcgagaccagcagcctgaaccagcaggccttctctgctgaggtggccaccatcaccggcagcgagagcgccagccctgtgcacagccccctgggcagccgcagccagacccccagccccagcaccctgaacatcgaccacatggagcagaaggacctgcagctggatgagaagctgcaccacagcgtgctgcagaccccagatgacctggagatcagcgagttccccagcgagtgctgcagcgtgatggccggcggcaccctgaccggctggcacgcagatgtggccaccgtgatgtggaggaggatgctgggcatcctgggagatgtgaacagcatcatggaccctgagatccacgcccaggtgtttgactacctgtgtgagctgtggcagaacctggccaagatccgggacaacctgggcatcagcacagacaacctgaccagccccagcccccctgtgctgatcccccccctgcgcatcctgaccccctggctgttcaaggccaccatgctgacagacaagtacaagcagggcaagctgcacgcctacaagctgatctgcaacaccatgaagaggcggcaggatgtgagccccaacagagacttcctgacccacttctacaacatcatgcactgcggcctgctgcacatcgaccaggacatcgtgaacaccatcatcaagcactgcagcccccagttcttcagcctgggcctgcccggggccaccatgctgatcatggacttcatcgtggccgccggccgggtggccagcagcgccttcctgaatgccccccgggtggaggcccaggtgctgctgggcagcctggtgtgcttccccaacctgtactgtgagctgcccagcctgcaccccaacatcccagatgtggccgtgtcccagttcacagatgtgaaggagctgatcatcaagacagtgctgagcagcgccagagatgagcccagcggccctgcccgctgtgtggccctgtgcagcctgggcatctggatctgtgaggagctggtgcatgagagccaccacccccagatcaaggaggccctgaatgtcatctgtgtgtccctgaagttcaccaacaagacagtggcccacgtggcctgcaacatgctgcacatgctggtgcactacgtgccccggctgcagatctaccagcctgacagccccctgaagatcatccagatcctgattgccaccatcacccacctgctgcccagcacagaggccagcagctatgagatggacaagaggctggtggtgtccctgctgctgtgcctgctggactggatcatggccctgcccctgaagaccctgctgcagcccttccacgccaccggggctgagagtgacaagacagagaagtctgtgctgaactgcatctacaaggtgctgcacggctgtgtgtatggagcccagtgcttcagcaacccccgctacttccccatgagcctgagtgacctggcctctgtggactatgaccccttcatgcacctggagagcctgaaggagcctgagcccctgcacagcccagattctgagaggagcagcaagctgcagcctgtgacagaggtgaagacccagatgcagcacggcctcatcagcattgctgccaggacagtcatcacccacctggtgaaccacctgggccactaccccatgtctgggggccctgccatgctgaccagccaggtgtgtgaaaatcatgacaaccactacagcgagagcacagagctgagccctgagctgtttgagagccccaacatccagttctttgtgctgaacaacaccaccctggtgtcctgcatccagatccgctctgaggagaacatgcctgggggcggcctgtctgctggcctggccagcgccaacagcaatgtgcgcatcatcgtgcgggacctgagcggcaagtacagctgggacagcgccatcctgtatggccccccacctgtgtctggcctgtctgagcccaccagcttcatgctgagcctgagccaccaggagaagccagaggagccccccaccagcaatgaatgtctggaggacatcaccgtgaaggatggcctgagcctgcagttcaagcgcttccgggagaccgtgcccacctgggacaccatcagagatgaggaggatgtgctggatgagctgctgcagtacctgggcgtgaccagccctgagtgcctgcagaggacaggcatcagcctgaacatcccagccccccagcctgtgtgcatcagcgagaagcaggagaatgatgtgatcaatgccatcctgaagcagcacacagaggagaaggagtttgtggagaagcacttcaatgacctgaacatgaaggctgtggagcaggatgagcccatcccccagaagccccagagcgccttctactactgccgcctgctgctgagcatcctgggcatgaacagctgggacaagaggaggagcttccacctgctgaagaagaatgagaagctgctgcgggagctgaggaacctggacagccggcagtgccgggagacccacaagattgctgtgttctacgtggccgagggccaggaggacaagcacagcatcctgaccaacacaggaggcagccaggcctatgaggactttgtggccggcctgggctgggaggtgaacctgaccaaccactgcggcttcatgggcggcctgcagaagaacaagagcacaggcctgaccaccccctactttgccaccagcacagtggaggtgatcttccacgtgtccaccaggatgcccagcgacagtgatgacagcctgaccaagaagctgcggcacctgggcaatgatgaggtgcacatcgtgtggagcgagcacacccgggactaccgccggggcatcatccccacagaatttggagatgtgctgattgtcatctaccccatgaagaaccacatgttcagcatccagatcatgaagaagccagaggtgcccttcttcggccccctgtttgatggagccatcgtgaatggcaaggtgctgcccatcatggtgcgggccacagccatcaatgccagccgggccctgaagagcctcatccccctgtaccagaacttctatgaggagcgggcccgctacctgcagaccatcgtgcagcaccacctggagcccaccacctttgaagattttgctgcccaggtgttcagccctgccccctaccaccacctgcccagtgatgctgaccactag

SEQ ID NO: 167049 - DNA, 6252 bp, Artificial Sequence; identical to SEQ ID NO: 167044
  Description of Artificial Sequence: Synthetic coding sequence

SEQ ID NO: 167050 - DNA, 2169 bp, Artificial Sequence
  Description of Artificial Sequence: Synthetic coding sequence
cagatcctgattgccaccatcacccacctgctgcccagcacagaggccagcagctatgagatggacaagaggctggtggtgtccctgctgctgtgcctgctggactggatcatggccctgcccctgaagaccctgctgcagcccttccacgccaccggggctgagagtgacaagacagagaagtctgtgctgaactgcatctacaaggtgctgcacggctgtgtgtatggagcccagtgcttcagcaacccccgctacttccccatgagcctgagtgacctggcctctgtggactatgaccccttcatgcacctggagagcctgaaggagcctgagcccctgcacagcccagattctgagaggagcagcaagctgcagcctgtgacagaggtgaagacccagatgcagcacggcctcatcagcattgctgccaggacagtcatcacccacctggtgaaccacctgggccactaccccatgtctgggggccctgccatgctgaccagccaggtgtgtgaaaatcatgacaaccactacagcgagagcacagagctgagccctgagctgtttgagagccccaacatccagttctttgtgctgaacaacaccaccctggtgtcctgcatccagatccgctctgaggagaacatgcctgggggcggcctgtctgctggcctggccagcgccaacagcaatgtgcgcatcatcgtgcgggacctgagcggcaagtacagctgggacagcgccatcctgtatggccccccacctgtgtctggcctgtctgagcccaccagcttcatgctgagcctgagccaccaggagaagccagaggagccccccaccagcaatgaatgtctggaggacatcaccgtgaaggatggcctgagcctgcagttcaagcgcttccgggagaccgtgcccacctgggacaccatcagagatgaggaggatgtgctggatgagctgctgcagtacctgggcgtgaccagccctgagtgcctgcagaggacaggcatcagcctgaacatcccagccccccagcctgtgtgcatcagcgagaagcaggagaatgatgtgatcaatgccatcctgaagcagcacacagaggagaaggagtttgtggagaagcacttcaatgacctgaacatgaaggctgtggagcaggatgagcccatcccccagaagccccagagcgccttctactactgccgcctgctgctgagcatcctgggcatgaacagctgggacaagaggaggagcttccacctgctgaagaagaatgagaagctgctgcgggagctgaggaacctggacagccggcagtgccgggagacccacaagattgctgtgttctacgtggccgagggccaggaggacaagcacagcatcctgaccaacacaggaggcagccaggcctatgaggactttgtggccggcctgggctgggaggtgaacctgaccaaccactgcggcttcatgggcggcctgcagaagaacaagagcacaggcctgaccaccccctactttgccaccagcacagtggaggtgatcttccacgtgtccaccaggatgcccagcgacagtgatgacagcctgaccaagaagctgcggcacctgggcaatgatgaggtgcacatcgtgtggagcgagcacacccgggactaccgccggggcatcatccccacagaatttggagatgtgctgattgtcatctaccccatgaagaaccacatgttcagcatccagatcatgaagaagccagaggtgcccttcttcggccccctgtttgatggagccatcgtgaatggcaaggtgctgcccatcatggtgcgggccacagccatcaatgccagccgggccctgaagagcctcatccccctgtaccagaacttctatgaggagcgggcccgctacctgcagaccatcgtgcagcaccacctggagcccaccacctttgaagattttgctgcccaggtgttcagccctgccccctaccaccacctgcccagtgatgctgtgggcagctacccagagatcctgcccagcgagacccccacagccacccaggtggatggagctgacctggccagccccatgagccccaggaccagcaagagcaggatgtccatgaagctgcggcgcagcagcggcagcgccaacaagagctag

SEQ ID NO: 167051 - DNA, 2709 bp, Artificial Sequence
  Description of Artificial Sequence: Synthetic coding sequence
atggtgcagaggatgtgggccgaggccgccggccctgctggaggagctgagcccctcttccctggcagccgccgcagccgctctgtgtgggatgctgtgcggctggaggtgggcgtgcctgacagctgccctgtggtgctgcacagcttcacccagctggaccctgacctgcccaggcctgagagcagcacccaggagattggagaggagctgatcaatggagtcatctacagcatcagcctgaggaaggtgcagctgcaccacggcggcaacaagggccagcgctggctgggctatgaaaatgaaagtgccctgaacctgtatgagacctgcaaggtgaggacagtgaaggccggcaccctggagaagctggtggagcacctggtgcctgccttccagggcagtgacctgtcctatgtgaccatcttcctgtgcacctaccgggccttcaccaccacccagcaggtgctggacctgctcttcaagagatatggctgcatcctgccctacagtgatgaagatggcggcccccaggaccagctgaagaatgccatcagcagcatcctgggcacctggctggaccagtacagcgaggacttctgccagcccccagacttcccctgcctgaagcagctggtggcctacgtgcagctgaacatgcctggcagtgacctggagcggcgggcccacctgctgctggcccagctggagcacagcgagcccatcgaggccgagcctgaggccctgagccctgtgcctgccctgaagcccaccccagagctggagctggccctgaccccagcccgggcccccagccctgtgcctgccccagcccctgagcctgagcccgcccccaccccagcccctggcagcgagctggaggtggccccagccccagcccctgagctgcagcaggcccctgagcctgctgtgggcctggagagcgccccagccccagccctggagctggagcccgcccctgagcaggaccctgcccccagccagaccctggagctggagcccgccccagcccctgtgcccagcctgcagcccagctggcccagccctgtggtggccgagaatggcctgtctgaggagaagccccacctgctggtgttccccccagacctggtggccgagcagttcaccctgatggatgctgagctgttcaagaaggtggtgccctaccactgcctgggcagcatctggagccagagggacaagaagggcaaggagcacctggcccccaccatccgggccaccgtgacccagttcaacagcgtggccaactgtgtgatcaccacctgcctgggcaacagaagcaccaaggccccagaccgggcccgggtggtggagcactggattgaggtggcccgggagtgccgcatcctgaagaacttcagcagcctgtatgccatcctgagcgccctgcagagcaacagcatccaccggctgaagaagacctgggaggatgtgtcccgggacagcttccgcatcttccagaagctgtctgagatcttcagtgatgagaacaactacagcctgagccgggagctgctgatcaaggagggcaccagcaagtttgccaccctggagatgaaccccaagagggcccagaagaggcccaaggagaccggcatcatccagggcaccgtgccctacctgggcaccttcctgacagacctggtgatgctggacacagccatgaaggactacctgtatggccgcctcatcaactttgagaagaggaggaaggagtttgaagtcatcgcccagatcaagctgctgcagagcgcctgcaacaactacagcatcgccccagatgagcagtttggagcctggttccgggctgtggagcggctgtctgaaacagagagctacaacctgagctgtgagctggagcccccatctgagagcgccagcaacaccctgcggaccaagaagaacacagccatcgtgaagcgctggagcgaccggcaggcccccagcacagagctgagcaccagcggcagcagccacagcaagagctgtgaccagctgcgctgtggcccctacctgagcagcggggacattgctgatgccctgtctgtgcacagcgctggcagcagcagcagtgatgtggaggagatcaacatcagctttgtgcctgagagcccagatggccaggagaagaagttctgggagagcgccagccagagcagccctgagaccagcggcatcagcagcgccagcagcagcaccagcagcagcagcgccagcaccacccctgtggccgccaccaggacccacaagaggtctgtgtctggcctgtgcaacagcagcagcgccctgcccctgtacaaccagcaggtgggggactgctgcatcatccgggtgtccctggatgtggacaatggaaacatgtacaagagcatcctggtgaccagccaggacaaggccccagctgtgatcaggaaggccatggacaagcacaacctggaggaggaggagcctgaggactatgagctgctgcagatcctgagtgatgacaggaagctgaagatcccagaaaatgccaacgtgttctacgccatgaacagcacagccaactatgactttgtgctgaagaagaggaccttcaccaagggcgtgaaggtgaagcatggagccagcagcaccctgcccaggatgaagcagaagggcctgaagatcgccaagggcatcttctag

SEQ ID NO: 167052 - DNA, 2745 bp, Artificial Sequence
  Description of Artificial Sequence: Synthetic coding sequence
atggtgcagaggatgtgggccgaggccgccggccctgctggaggagctgagcccctcttccctggcagccgccgcagccgctctgtgtgggatgctgtgcggctggaggtgggcgtgcctgacagctgccctgtggtgctgcacagcttcacccagctggaccctgacctgcccaggcctgagagcagcacccaggagattggagaggagctgatcaatggagtcatctacagcatcagcctgaggaaggtgcagctgcaccacggcggcaacaagggccagcgctggctgggctatgaaaatgaaagtgccctgaacctgtatgagacctgcaaggtgaggacagtgaaggccggcaccctggagaagctggtggagcacctggtgcctgccttccagggcagtgacctgtcctatgtgaccatcttcctgtgcacctaccgggccttcaccaccacccagcaggtgctggacctgctcttcaagagatatggccgctgtgatgccctgacagccagcagccgctatggctgcatcctgccctacagtgatgaagatggcggcccccaggaccagctgaagaatgccatcagcagcatcctgggcacctggctggaccagtacagcgaggacttctgccagcccccagacttcccctgcctgaagcagctggtggcctacgtgcagctgaacatgcctggcagtgacctggagcggcgggcccacctgctgctggcccagctggagcacagcgagcccatcgaggccgagcctgaggccctgagccctgtgcctgccctgaagcccaccccagagctggagctggccctgaccccagcccgggcccccagccctgtgcctgccccagcccctgagcctgagcccgcccccaccccagcccctggcagcgagctggaggtggccccagccccagcccctgagctgcagcaggcccctgagcctgctgtgggcctggagagcgccccagccccagccctggagctggagcccgcccctgagcaggaccctgcccccagccagaccctggagctggagcccgccccagcccctgtgcccagcctgcagcccagctggcccagccctgtggtggccgagaatggcctgtctgaggagaagccccacctgctggtgttccccccagacctggtggccgagcagttcaccctgatggatgctgagctgttcaagaaggtggtgccctaccactgcctgggcagcatctggagccagagggacaagaagggcaaggagcacctggcccccaccatccgggccaccgtgacccagttcaacagcgtggccaactgtgtgatcaccacctgcctgggcaacagaagcaccaaggccccagaccgggcccgggtggtggagcactggattgaggtggcccgggagtgccgcatcctgaagaacttcagcagcctgtatgccatcctgagcgccctgcagagcaacagcatccaccggctgaagaagacctgggaggatgtgtcccgggacagcttccgcatcttccagaagctgtctgagatcttcagtgatgagaacaactacagcctgagccgggagctgctgatcaaggagggcaccagcaagtttgccaccctggagatgaaccccaagagggcccagaagaggcccaaggagaccggcatcatccagggcaccgtgccctacctgggcaccttcctgacagacctggtgatgctggacacagccatgaaggactacctgtatggccgcctcatcaactttgagaagaggaggaaggagtttgaagtcatcgcccagatcaagctgctgcagagcgcctgcaacaactacagcatcgccccagatgagcagtttggagcctggttccgggctgtggagcggctgtctgaaacagagagctacaacctgagctgtgagctggagcccccatctgagagcgccagcaacaccctgcggaccaagaagaacacagccatcgtgaagcgctggagcgaccggcaggcccccagcacagagctgagcaccagcggcagcagccacagcaagagctgtgaccagctgcgctgtggcccctacctgagcagcggggacattgctgatgccctgtctgtgcacagcgctggcagcagcagcagtgatgtggaggagatcaacatcagctttgtgcctgagagcccagatggccaggagaagaagttctgggagagcgccagccagagcagccctgagaccagcggcatcagcagcgccagcagcagcaccagcagcagcagcgccagcaccacccctgtggccgccaccaggacccacaagaggtctgtgtctggcctgtgcaacagcagcagcgccctgcccctgtacaaccagcaggtgggggactgctgcatcatccgggtgtccctggatgtggacaatggaaacatgtacaagagcatcctggtgaccagccaggacaaggccccagctgtgatcaggaaggccatggacaagcacaacctggaggaggaggagcctgaggactatgagctgctgcagatcctgagtgatgacaggaagctgaagatcccagaaaatgccaacgtgttctacgccatgaacagcacagccaactatgactttgtgctgaagaagaggaccttcaccaagggcgtgaaggtgaagcatggagccagcagcaccctgcccaggatgaagcagaagggcctgaagatcgccaagggcatcttctag

SEQ ID NO: 167053 - DNA, 1341 bp, Artificial Sequence
  Description of Artificial Sequence: Synthetic coding sequence
atgcctggcagtgacctggagcggcgggcccacctgctgctggcccagctggagcacagcgagcccattgaagctgagcctgaggccctgagccctgtgcctgccctgaagcccaccccagagctggagctggccctgaccccagcccgggcccccagccctgtgcctgccccagcccctgagcctgagcccgcccccaccccagcccctggcagcgagctggaggtggccccagccccagcccctgagctgcagcaggcccctgagcctgctgtgggcctggagagcgccccagccccagccctggagctggagcccgcccctgagcaggaccctgcccccagccagaccctggagctggagcccgccccagcccctgtgcccagcctgcagcccagctggcccagccctgtggtggctgaaaatggcctgtctgaggagaagccccacctgctggtgtttcctccagacctggtggccgagcagttcaccctgatggatgctgaatgtcgcatcctgaagaacttcagcagcctgtatgccatcctgagcgccctgcagagcaacagcatccaccggctgaagaagacctgggaggatgtgtcccgggacagcttccgcatcttccagaagctgtctgagatcttcagtgatgagaacaactacagcctgagccgggagctgctgatcaaggagggcaccagcaagtttgccaccctggagatgaaccccaagagggcccagaagaggcccaaggagaccggcatcatccagggcaccgtgccctacctgggcaccttcctgacagacctggtgatgctggacacagccatgaaggactacctgtatggccgcctcatcaactttgagaagaggaggaaggagtttgaggtgattgcccagatcaagctgctgcagagcgcctgcaacaactacagcatcgccccagatgagcagtttggagcctggttccgggctgtggagcggctgtctgaaacagagagctacaacctgagctgtgagctggagccccccagcgagagcgccagcaacaccctgcggaccaagaagaacacagccatcgtgaagcgctggagcgaccggcaggcccccagcacagagctgagcaccagcggcagcagccacagcaagagctgtgaccagctgcgctgtggcccctacctgagcagcggggacattgctgatgccctgtctgtgcacagcgctggcagcagcagcagtgatgtggaggagatcaacatcagctttgtgcctgagagcccagatggccaggagaagaagttctgggagagcgccagccagagcagccctgagacctag

SEQ ID NO: 167054 - DNA, 2658 bp, Artificial Sequence
  Description of Artificial Sequence: Synthetic coding sequence
atgtgcctgtggggccacagcacagccccagcccacaccctgagcagcccccccctgctcttctgcagcctgccctgtgccctgcacctgcagcccggcaccggccaccccccaggccaggtgcccaggaagagcagcacccaggagatcggggaggagctgatcaacggggtcatctacagcatcagcctgaggaaggtgcagctgcaccacggcggcaacaagggccagcgctggctgggctatgaaaatgaaagtgccctgaacctgtatgagacctgcaaggtgaggacagtgaaggccggcaccctggagaagctggtggagcacctggtgcctgccttccagggcagtgacctgtcctatgtgaccatcttcctgtgcacctaccgggccttcaccaccacccagcaggtgctggacctgctcttcaagagatatggctgcatcctgccctacagtgatgaagatggcggcccccaggaccagctgaagaatgccatcagcagcatcctgggcacctggctggaccagtacagcgaggacttctgccagcccccagacttcccctgcctgaagcagctggtggcctacgtgcagctgaacatgcctggcagtgacctggagcggcgggcccacctgctgctggcccagctggagcacagcgagcccattgaagctgagcctgaggccctgagccctgtgcctgccctgaagcccaccccagagctggagctggccctgaccccagcccgggcccccagccctgtgcctgccccagcccctgagcctgagcccgcccccaccccagcccctggcagcgagctggaggtggccccagccccagcccctgagctgcagcaggcccctgagcctgctgtgggcctggagagcgccccagccccagccctggagctggagcccgcccctgagcaggaccctgcccccagccagaccctggagctggagcccgccccagcccctgtgcccagcctgcagcccagctggcccagccctgtggtggctgaaaatggcctgtctgaggagaagccccacctgctggtgtttcctccagacctggtggccgagcagttcaccctgatggatgctgagctgttcaagaaggtggtgccctaccactgcctgggcagcatctggagccagagggacaagaagggcaaggagcacctggcccccaccatccgggccaccgtgacccagttcaacagcgtggccaactgtgtgatcaccacctgcctgggcaacagaagcaccaaggccccagaccgggcccgggtggtggagcactggattgaggtggccagagaatgtcgcatcctgaagaacttcagcagcctgtatgccatcctgagcgccctgcagagcaacagcatccaccggctgaagaagacctgggaggatgtgtcccgggacagcttccgcatcttccagaagctgtctgagatcttcagtgatgagaacaactacagcctgagccgggagctgctgatcaaggagggcaccagcaagtttgccaccctggagatgaaccccaagagggcccagaagaggcccaaggagaccggcatcatccagggcaccgtgccctacctgggcaccttcctgacagacctggtgatgctggacacagccatgaaggactacctgtatggccgcctcatcaactttgagaagaggaggaaggagtttgaggtgattgcccagatcaagctgctgcagagcgcctgcaacaactacagcatcgccccagatgagcagtttggagcctggttccgggctgtggagcggctgtctgaaacagagagctacaacctgagctgtgagctggagccccccagcgagagcgccagcaacaccctgcggaccaagaagaacacagccatcgtgaagcgctggagcgaccggcaggcccccagcacagagctgagcaccagcggcagcagccacagcaagagctgtgaccagctgcgctgtggcccctacctgagcagcggggacattgctgatgccctgtctgtgcacagcgctggcagcagcagcagtgatgtggaggagatcaacatcagctttgtgcctgagagcccagatggccaggagaagaagttctgggagagcgccagccagagcagccctgagaccagcggcatcagcagcgccagcagcagcaccagcagcagcagcgccagcaccacccctgtggccgccaccaggacccacaagaggtctgtgtctggcctgtgcaacagcagcagcgccctgcccctgtacaaccagcaggtgggggactgctgcatcatccgggtgtccctggatgtggacaatggaaacatgtacaagagcatcctggtgaccagccaggacaaggccccagctgtgatcaggaaggccatggacaagcacaacctggaggaggaggagccagaagattatgagctgctgcagatcctgagtgatgacaggaagctgaagatcccagaaaatgccaacgtgttctacgccatgaacagcacagccaactatgactttgtgctgaagaagaggaccttcaccaagggcgtgaaggtgaagcacggggccagcagcaccctgcccaggatgaagcagaagggcctgaagatcgccaagggcatcttctag

SEQ ID NO: 167055 - DNA, 2742 bp, Artificial Sequence
  Description of Artificial Sequence: Synthetic coding sequence
atggcccgggaggccggccaggtgtgtgcccggcctgctgtgccccggggcaggaaaggatctgtgttctttgcctgtgtgtctgtggtgacagcccggcggcgggctgtggccaggagagctgccctgcagagccccaccccctggctggcccccctgcctgccccagccaccacagagagcagcacccaggagatcggggaggagctgatcaacggggtcatctacagcatcagcctgaggaaggtgcagctgcaccacggcggcaacaagggccagcgctggctgggctatgaaaatgaaagtgccctgaacctgtatgagacctgcaaggtgaggacagtgaaggccggcaccctggagaagctggtggagcacctggtgcctgccttccagggcagtgacctgtcctatgtgaccatcttcctgtgcacctaccgggccttcaccaccacccagcaggtgctggacctgctcttcaagagatatggccgctgtgatgccctgacagccagcagccgctatggctgcatcctgccctacagtgatgaagatggcggcccccaggaccagctgaagaatgccatcagcagcatcctgggcacctggctggaccagtacagcgaggacttctgccagcccccagacttcccctgcctgaagcagctggtggcctacgtgcagctgaacatgcctggcagtgacctggagcggcgggcccacctgctgctggcccagctggagcacagcgagcccattgaagctgagcctgaggccctgagccctgtgcctgccctgaagcccaccccagagctggagctggccctgaccccagcccgggcccccagccctgtgcctgccccagcccctgagcctgagcccgcccccaccccagcccctggcagcgagctggaggtggccccagccccagcccctgagctgcagcaggcccctgagcctgctgtgggcctggagagcgccccagccccagccctggagctggagcccgcccctgagcaggaccctgcccccagccagaccctggagctggagcccgccccagcccctgtgcccagcctgcagcccagctggcccagccctgtggtggctgaaaatggcctgtctgaggagaagccccacctgctggtgtttcctccagacctggtggccgagcagttcaccctgatggatgctgagctgttcaagaaggtggtgccctaccactgcctgggcagcatctggagccagagggacaagaagggcaaggagcacctggcccccaccatccgggccaccgtgacccagttcaacagcgtggccaactgtgtgatcaccacctgcctgggcaacagaagcaccaaggccccagaccgggcccgggtggtggagcactggattgaggtggccagagaatgtcgcatcctgaagaacttcagcagcctgtatgccatcctgagcgccctgcagagcaacagcatccaccggctgaagaagacctgggaggatgtgtcccgggacagcttccgcatcttccagaagctgtctgagatcttcagtgatgagaacaactacagcctgagccgggagctgctgatcaaggagggcaccagcaagtttgccaccctggagatgaaccccaagagggcccagaagaggcccaaggagaccggcatcatccagggcaccgtgccctacctgggcaccttcctgacagacctggtgatgctggacacagccatgaaggactacctgtatggccgcctcatcaactttgagaagaggaggaaggagtttgaggtgattgcccagatcaagctgctgcagagcgcctgcaacaactacagcatcgccccagatgagcagtttggagcctggttccgggctgtggagcggctgtctgaaacagagagctacaacctgagctgtgagctggagccccccagcgagagcgccagcaacaccctgcggaccaagaagaacacagccatcgtgaagcgctggagcgaccggcaggcccccagcacagagctgagcaccagcggcagcagccacagcaagagctgtgaccagctgcgctgtggcccctacctgagcagcggggacattgctgatgccctgtctgtgcacagcgctggcagcagcagcagtgatgtggaggagatcaacatcagctttgtgcctgagagcccagatggccaggagaagaagttctgggagagcgccagccagagcagccctgagaccagcggcatcagcagcgccagcagcagcaccagcagcagcagcgccagcaccacccctgtggccgccaccaggacccacaagaggtctgtgtctggcctgtgcaacagcagcagcgccctgcccctgtacaaccagcaggtgggggactgctgcatcatccgggtgtccctggatgtggacaatggaaacatgtacaagagcatcctggtgaccagccaggacaaggccccagctgtgatcaggaaggccatggacaagcacaacctggaggaggaggagccagaagattatgagctgctgcagatcctgagtgatgacaggaagctgaagatcccagaaaatgccaacgtgttctacgccatgaacagcacagccaactatgactttgtgctgaagaagaggaccttcaccaagggcgtgaaggtgaagcacggggccagcagcaccctgcccaggatgaagcagaagggcctgaagatcgccaagggcatcttctag

SEQ ID NO: 167056 - DNA, 2580 bp, Artificial Sequence
  Description of Artificial Sequence: Synthetic coding sequence
atgatggtggactgccagagcagcacccaggagatcggggaggagctgatcaacggggtcatctacagcatcagcctgaggaaggtgcagctgcaccacggcggcaacaagggccagcgctggctgggctatgaaaatgaaagtgccctgaacctgtatgagacctgcaaggtgaggacagtgaaggccggcaccctggagaagctggtggagcacctggtgcctgccttccagggcagtgacctgtcctatgtgaccatcttcctgtgcacctaccgggccttcaccaccacccagcaggtgctggacctgctcttcaagagatatggccgctgtgatgccctgacagccagcagccgctatggctgcatcctgccctacagtgatgaagatggcggcccccaggaccagctgaagaatgccatcagcagcatcctgggcacctggctggaccagtacagcgaggacttctgccagcccccagacttcccctgcctgaagcagctggtggcctacgtgcagctgaacatgcctggcagtgacctggagcggcgggcccacctgctgctggcccagctggagcacagcgagcccattgaagctgagcctgaggccctgagccctgtgcctgccctgaagcccaccccagagctggagctggccctgaccccagcccgggcccccagccctgtgcctgccccagcccctgagcctgagcccgcccccaccccagcccctggcagcgagctggaggtggccccagccccagcccctgagctgcagcaggcccctgagcctgctgtgggcctggagagcgccccagccccagccctggagctggagcccgcccctgagcaggaccctgcccccagccagaccctggagctggagcccgccccagcccctgtgcccagcctgcagcccagctggcccagccctgtggtggctgaaaatggcctgtctgaggagaagccccacctgctggtgtttcctccagacctggtggccgagcagttcaccctgatggatgctgagctgttcaagaaggtggtgccctaccactgcctgggcagcatctggagccagagggacaagaagggcaaggagcacctggcccccaccatccgggccaccgtgacccagttcaacagcgtggccaactgtgtgatcaccacctgcctgggcaacagaagcaccaaggccccagaccgggcccgggtggtggagcactggattgaggtggccagagaatgtcgcatcctgaagaacttcagcagcctgtatgccatcctgagcgccctgcagagcaacagcatccaccggctgaagaagacctgggaggatgtgtcccgggacagcttccgcatcttccagaagctgtctgagatcttcagtgatgagaacaactacagcctgagccgggagctgctgatcaaggagggcaccagcaagtttgccaccctggagatgaaccccaagagggcccagaagaggcccaaggagaccggcatcatccagggcaccgtgccctacctgggcaccttcctgacagacctggtgatgctggacacagccatgaaggactacctgtatggccgcctcatcaactttgagaagaggaggaaggagtttgaggtgattgcccagatcaagctgctgcagagcgcctgcaacaactacagcatcgccccagatgagcagtttggagcctggttccgggctgtggagcggctgtctgaaacagagagctacaacctgagctgtgagctggagccccccagcgagagcgccagcaacaccctgcggaccaagaagaacacagccatcgtgaagcgctggagcgaccggcaggcccccagcacagagctgagcaccagcggcagcagccacagcaagagctgtgaccagctgcgctgtggcccctacctgagcagcggggacattgctgatgccctgtctgtgcacagcgctggcagcagcagcagtgatgtggaggagatcaacatcagctttgtgcctgagagcccagatggccaggagaagaagttctgggagagcgccagccagagcagccctgagaccagcggcatcagcagcgccagcagcagcaccagcagcagcagcgccagcaccacccctgtggccgccaccaggacccacaagaggtctgtgtctggcctgtgcaacagcagcagcgccctgcccctgtacaaccagcaggtgggggactgctgcatcatccgggtgtccctggatgtggacaatggaaacatgtacaagagcatcctggtgaccagccaggacaaggccccagctgtgatcaggaaggccatggacaagcacaacctggaggaggaggagccagaagattatgagctgctgcagatcctgagtgatgacaggaagctgaagatcccagaaaatgccaacgtgttctacgccatgaacagcacagccaactatgactttgtgctgaagaagaggaccttcaccaagggcgtgaaggtgaagcacggggccagcagcaccctgcccaggatgaagcagaagggcctgaagatcgccaagggcatcttctag

SEQ ID NO: 167057 - DNA, 930 bp, Artificial Sequence
  Description of Artificial Sequence: Synthetic coding sequence
gtggtggccgagaatggcctgtctgaggagaagccccacctgctggtgttccccccagacctggtggccgagcagttcaccctgatggatgctgagtgccgcatcctgaagaacttcagcagcctgtatgccatcctgagcgccctgcagagcaacagcatccaccggctgaagaagacctgggaggatgtgtcccgggacagcttccgcatcttccagaagctgtctgagatcttcagtgatgagaacaactacagcctgagccgggagctgctgatcaaggagggcaccagcaagtttgccaccctggagatgaaccccaagagggcccagaagaggcccaaggagaccggcatcatccagggcaccgtgccctacctgggcaccttcctgacagacctggtgatgctggacacagccatgaaggactacctgtatggccgcctcatcaactttgagaagaggaggaaggagtttgaagtcatcgcccagatcaagctgctgcagagcgcctgcaacaactacagcatcgccccagatgagcagtttggagcctggttccgggctgtggagcggctgtctgaaacagagagctacaacctgagctgtgagctggagcccccatctgagagcgccagcaacaccctgcggaccaagaagaacacagccatcgtgaagcgctggagcgaccggcaggcccccagcacagagctgagcaccagcggcagcagccacagcaagagctgtgaccagctgcgctgtggcccctacctgagcagcggggacattgctgatgccctgtctgtgcacagcgctggcagcagcagcagtgatgtggaggagatcaacatcagctttgtgcctgagagcccagatggccaggagaagaagttctgggagagcgccagccagagcagccctgagacctag

SEQ ID NO: 167058 - DNA, 2958 bp, Artificial Sequence
  Description of Artificial Sequence: Synthetic coding sequence
atgcacagaagaaggctggccctgggcctgggcttctgcctgctggccggcaccagcctgtctgtgctgtgggtgtacctggagaactggctgcctgtgtcctatgtgccctactacctgccctgcccagagatcctgcccatgatgatggccctgagctgcctgtgccaccagcagcacgaggccgccctgcaggagggggaggccaccccagcccggggcatggtgacagtgcccagcgcccaggccgccggggcccaggcccacacagctgctgacacccacaccctggtgggcgcccaccggctgcggggcaacctgcagccccgggccagcgctgcccacctgcctgccacagagccagaccactggggccacggcgtgtgccgcggggagagcagcacccaggagatcggggaggagctgatcaacggggtcatctacagcatcagcctgaggaaggtgcagctgcaccacggcggcaacaagggccagcgctggctgggctatgaaaatgaaagtgccctgaacctgtatgagacctgcaaggtgaggacagtgaaggccggcaccctggagaagctggtggagcacctggtgcctgccttccagggcagtgacctgtcctatgtgaccatcttcctgtgcacctaccgggccttcaccaccacccagcaggtgctggacctgctcttcaagagatatggccgctgtgatgccctgacagccagcagccgctatggctgcatcctgccctacagtgatgaagatggcggcccccaggaccagctgaagaatgccatcagcagcatcctgggcacctggctggaccagtacagcgaggacttctgccagcccccagacttcccctgcctgaagcagctggtggcctacgtgcagctgaacatgcctggcagtgacctggagcggcgggcccacctgctgctggcccagctggagcacagcgagcccattgaagctgagcctgaggccctgagccctgtgcctgccctgaagcccaccccagagctggagctggccctgaccccagcccgggcccccagccctgtgcctgccccagcccctgagcctgagcccgcccccaccccagcccctggcagcgagctggaggtggccccagccccagcccctgagctgcagcaggcccctgagcctgctgtgggcctggagagcgccccagccccagccctggagctggagcccgcccctgagcaggaccctgcccccagccagaccctggagctggagcccgccccagcccctgtgcccagcctgcagcccagctggcccagccctgtggtggctgaaaatggcctgtctgaggagaagccccacctgctggtgtttcctccagacctggtggccgagcagttcaccctgatggatgctgagctgttcaagaaggtggtgccctaccactgcctgggcagcatctggagccagagggacaagaagggcaaggagcacctggcccccaccatccgggccaccgtgacccagttcaacagcgtggccaactgtgtgatcaccacctgcctgggcaacagaagcaccaaggccccagaccgggcccgggtggtggagcactggattgaggtggccagagaatgtcgcatcctgaagaacttcagcagcctgtatgccatcctgagcgccctgcagagcaacagcatccaccggctgaagaagacctgggaggatgtgtcccgggacagcttccgcatcttccagaagctgtctgagatcttcagtgatgagaacaactacagcctgagccgggagctgctgatcaaggagggcaccagcaagtttgccaccctggagatgaaccccaagagggcccagaagaggcccaaggagaccggcatcatccagggcaccgtgccctacctgggcaccttcctgacagacctggtgatgctggacacagccatgaaggactacctgtatggccgcctcatcaactttgagaagaggaggaaggagtttgaggtgattgcccagatcaagctgctgcagagcgcctgcaacaactacagcatcgccccagatgagcagtttggagcctggttccgggctgtggagcggctgtctgaaacagagagctacaacctgagctgtgagctggagccccccagcgagagcgccagcaacaccctgcggaccaagaagaacacagccatcgtgaagcgctggagcgaccggcaggcccccagcacagagctgagcaccagcggcagcagccacagcaagagctgtgaccagctgcgctgtggcccctacctgagcagcggggacattgctgatgccctgtctgtgcacagcgctggcagcagcagcagtgatgtggaggagatcaacatcagctttgtgcctgagagcccagatggccaggagaagaagttctgggagagcgccagccagagcagccctgagaccagcggcatcagcagcgccagcagcagcaccagcagcagcagcgccagcaccacccctgtggccgccaccaggacccacaagaggtctgtgtctggcctgtgcaacagcagcagcgccctgcccctgtacaaccagcaggtgggggactgctgcatcatccgggtgtccctggatgtggacaatggaaacatgtacaagagcatcctggtgaccagccaggacaaggccccagctgtgatcaggaaggccatggacaagcacaacctggaggaggaggagccagaagattatgagctgctgcagatcctgagtgatgacaggaagctgaagatcccagaaaatgccaacgtgttctacgccatgaacagcacagccaactatgactttgtgctgaagaagaggaccttcaccaagggcgtgaaggtgaagcacggggccagcagcaccctgcccaggatgaagcagaagggcctgaagatcgccaagggcatcttctag

SEQ ID NO: 167059 - DNA, 2412 bp, Artificial Sequence
  Description of Artificial Sequence: Synthetic coding sequence
atggaggtgaagcctgtgggggagcccacccaggaggtgtccaagttcaagctgagcaccaaggtggagagcacaggccactggctggtggaggaccacgtgcgcatctgggaggtgctgaagacagaggagagcagcatccaggactggggcgaggaggtggaggagggcgctgtgtaccacgtgaccctgaagagggtgcagatccagcaggccgccaacaagggggcccgctggctgggcgtggagggggaccagctgcccccaggccacacagtgtcccagtatgagacctgcaagatccgcaccatcaaggccggcaccctggagaagctggtggagaacctgctgacagccttcggggacaatgacttcacctacatcagcatcttcctgagcacctaccggggctttgccagcaccaaggaggtgctggagctgctgctggacagatatggcaacctgaccagccccaactgtgaggaggatggcagccagagcagcagcgagagcaagatggtgatcagaaatgccatcgccagcatcctgcgggcctggctggaccagtgtgccgaggacttccgggagcccccccacttcccctgcctgcagaagctgctggactacctgaccaggatgatgcctggcagtgaccctgagcggcgggcccagaacctgctggagcagttccagaagcaggaggtggagacagacaatggcctgcccaacaccatctccttcagcctggaggaggaggaggagctggagggcggggagagcgctgagttcacctgcttcagcgaggacctggtggccgagcagctgacctacatggatgcccagctgttcaagaaggtggtgccccaccactgcctgggctgcatctggagccggcgggacaagaaggagaacaagcacctggcccccaccatccgggccaccatcagccagttcaacaccctgaccaagtgtgtggtgtccaccatcctgggcggcaaggagctgaagacccagcagagggccaagatcatcgagaagtggatcaacatcgcccatgaatgtcggctgctgaagaacttcagcagcctgcgggccatcgtgtctgccctgcagagcaacagcatctaccgcctgaagaagacctgggccgctgtgccccgggacaggatgctgatgtttgaggagctgagtgacatcttcagtgaccacaacaaccacctgaccagccgggagctgctgatgaaggagggcaccagcaagtttgccaacctggacagctctgtgaaggagaaccagaagaggacccagaggcggctgcagctgcagaaggacatgggcgtgatgcagggcaccgtgccctacctgggcaccttcctgacagacctgaccatgctggacacagccctgcaggactacattgaaggaggcctcatcaactttgagaagagaagaagagaatttgaagtcatcgcccagatcaagctgctgcagagcgcctgcaacagctactgcatgaccccagaccagaagttcatccagtggttccagaggcagcagctgctgacagaggaggagagctatgccctgagctgtgaaattgaagctgctgctgatgccagcaccaccagccccaagcccaggaagtccatggtgaagaggctgagcctgctcttcctgggcagtgacatgatcaccagccccacccccaccaaggagcagcccaagagcacagccagcggcagcagcggggagagcatggacagcgtgtctgtgagcagctgtgagagcaaccacagcgaggccgaggagggcagcatcacccccatggacaccccagatgagccccagaagaagctgtctgagagcagcagcagctgcagcagcatccacagcatggacaccaacagcagcggcatgagcagcctcatcaaccccctgagcagcccccccagctgcaacaacaaccccaagatccacaagaggtctgtgtctgtgaccagcatcaccagcacagtgctgccccctgtgtacaaccagcagaatgaagacacctgcatcatccgcatctctgtggaggacaacaatggaaacatgtacaagagcatcatgctgaccagccaggacaagaccccagctgtgatccagagggccatgctgaagcacaacctggacagcgaccctgctgaggagtatgagctggtgcaggtgatcagcgaggacaaggagctggtgatcccagacagcgccaacgtgttctacgccatgaacagccaggtgaactttgacttcatcctgaggaagaagaacagcatggaggagcaggtgaagctgcggagcaggaccagcctgaccctgcccaggacagccaagaggggctgctggagcaacagacacagcaagatcaccctgtag

SEQ ID NO: 167060 - DNA, 2307 bp, Artificial Sequence
  Description of Artificial Sequence: Synthetic coding sequence
atgaagctgctgtggcaggccaagatgagcagcatccaggactggggcgaggaggtggaggagggcgctgtgtaccacgtgaccctgaagagggtgcagatccagcaggccgccaacaagggggcccgctggctgggcgtggagggggaccagctgcccccaggccacacagtgtcccagtatgagacctgcaagatccgcaccatcaaggccggcaccctggagaagctggtggagaacctgctgacagcctttggagacaatgacttcacctacatcagcatcttcctgagcacctaccggggctttgccagcaccaaggaggtgctggagctgctgctggacagatatggcaacctgaccagccccaactgtgaagaagatggcagccagagcagcagcgagagcaagatggtgatcagaaatgccatcgccagcatcctgcgggcctggctggaccagtgtgccgaggacttccgggagcccccccacttcccctgcctgcagaagctgctggactacctgaccaggatgatgcctggcagtgaccctgagcggcgggcccagaacctgctggagcagttccagaagcaggaggtggagacagacaatggcctgcccaacaccatctccttcagcctggaggaggaggaggagctggagggcggggagagcgctgagttcacctgcttcagcgaggacctggtggccgagcagctgacctacatggatgcccagctgttcaagaaggtggtgccccaccactgcctgggctgcatctggagcagaagagacaagaaggagaacaagcacctggcccccaccatccgggccaccatcagccagttcaacaccctgaccaagtgtgtggtgtccaccatcctgggcggcaaggagctgaagacccagcagagggccaagatcatcgagaagtggatcaacatcgcccacgagtgccgcctgctgaagaacttcagcagcctgcgggccatcgtgtctgccctgcagagcaacagcatctaccgcctgaagaagacctgggccgctgtgccccgggacaggatgctgatgtttgaggagctgagtgacatcttcagtgaccacaacaaccacctgaccagccgggagctgctgatgaaggagggcaccagcaagtttgccaacctggacagctctgtgaaggagaaccagaagaggacccagaggcggctgcagctgcagaaggacatgggcgtgatgcagggcaccgtgccctacctgggcaccttcctgacagacctgaccatgctggacacagccctgcaggactacatcgagggcggcctcatcaactttgagaagagaagaagagaatttgaggtgattgcccagatcaagctgctgcagagcgcctgcaacagctactgcatgaccccagaccagaagttcatccagtggttccagaggcagcagctgctgacagaggaggagagctatgccctgagctgtgaaattgaggccgctgctgatgccagcaccaccagccccaagcccaggaagtccatggtgaagaggctgagcctgctcttcctgggcagtgacatgatcaccagccccacccccaccaaggagcagcccaagagcacagccagcggcagcagtggagagagcatggattctgtgtctgtgagcagctgtgagagcaaccacagcgaggccgaggagggcagcatcacccccatggacaccccagatgagccccagaagaagctgtctgagagcagcagcagctgcagcagcatccacagcatggacaccaacagcagcggcatgagcagcctcatcaaccccctgagcagcccccccagctgcaacaacaaccccaagatccacaagaggtctgtgtctgtgaccagcatcaccagcacagtgctgccccctgtgtacaaccagcagaatgaagacacctgcatcatccgcatctctgtggaggacaacaacggcaacatgtacaagagcatcatgctgaccagccaggacaagaccccagctgtgatccagagggccatgctgaagcacaacctggacagcgaccctgctgaggagtatgagctggtgcaggtgatcagcgaggacaaggagctggtgatcccagattctgccaacgtgttctacgccatgaacagccaggtgaactttgacttcatcctgaggaagaagaacagcatggaggagcaggtgaagctgcggagcaggaccagcctgaccctgcccaggacagccaagaggggctgctggagcaacagacacagcaagatcaccctgtag

SEQ ID NO: 167061 - DNA, 2412 bp, Artificial Sequence; identical to SEQ ID NO: 167059
  Description of Artificial Sequence: Synthetic coding sequence

SEQ ID NO: 167062 - DNA, 2301 bp, Artificial Sequence
  Description of Artificial Sequence: Synthetic coding sequence
atggaggtgaagcctgtgggggagcccacccaggaggtgtccaagttcaagctgagcaccaaggtggagagcacaggccactggctggtggaggaccacgtgcgcatctgggaggtgctgaagacagaggaggtggagggggaccagctgcccccaggccacacagtgtcccagtatgagacctgcaagatccgcaccatcaaggccggcaccctggagaagctggtggagaacctgctgacagcctttggagacaatgacttcacctacatcagcatcttcctgagcacctaccggggctttgccagcaccaaggaggtgctggagctgctgctggacagatatggcaacctgaccagccccaactgtgaagaagatggcagccagagcagcagcgagagcaagatggtgatcagaaatgccatcgccagcatcctgcgggcctggctggaccagtgtgccgaggacttccgggagcccccccacttcccctgcctgcagaagctgctggactacctgaccaggatgatgcctggcagtgaccctgagcggcgggcccagaacctgctggagcagttccagaagcaggaggtggagacagacaatggcctgcccaacaccatctccttcagcctggaggaggaggaggagctggagggcggggagagcgctgagttcacctgcttcagcgaggacctggtggccgagcagctgacctacatggatgcccagctgttcaagaaggtggtgccccaccactgcctgggctgcatctggagcagaagagacaagaaggagaacaagcacctggcccccaccatccgggccaccatcagccagttcaacaccctgaccaagtgtgtggtgtccaccatcctgggcggcaaggagctgaagacccagcagagggccaagatcatcgagaagtggatcaacatcgcccacgagtgccgcctgctgaagaacttcagcagcctgcgggccatcgtgtctgccctgcagagcaacagcatctaccgcctgaagaagacctgggccgctgtgccccgggacaggatgctgatgtttgaggagctgagtgacatcttcagtgaccacaacaaccacctgaccagccgggagctgctgatgaaggagggcaccagcaagtttgccaacctggacagctctgtgaaggagaaccagaagaggacccagaggcggctgcagctgcagaaggacatgggcgtgatgcagggcaccgtgccctacctgggcaccttcctgacagacctgaccatgctggacacagccctgcaggactacatcgagggcggcctcatcaactttgagaagagaagaagagaatttgaggtgattgcccagatcaagctgctgcagagcgcctgcaacagctactgcatgaccccagaccagaagttcatccagtggttccagaggcagcagctgctgacagaggaggagagctatgccctgagctgtgaaattgaggccgctgctgatgccagcaccaccagccccaagcccaggaagtccatggtgaagaggctgagcctgctcttcctgggcagtgacatgatcaccagccccacccccaccaaggagcagcccaagagcacagccagcggcagcagtggagagagcatggattctgtgtctgtgagcagctgtgagagcaaccacagcgaggccgaggagggcagcatcacccccatggacaccccagatgagccccagaagaagctgtctgagagcagcagcagctgcagcagcatccacagcatggacaccaacagcagcggcatgagcagcctcatcaaccccctgagcagcccccccagctgcaacaacaaccccaagatccacaagaggtctgtgtctgtgaccagcatcaccagcacagtgctgccccctgtgtacaaccagcagaatgaagacacctgcatcatccgcatctctgtggaggacaacaacggcaacatgtacaagagcatcatgctgaccagccaggacaagaccccagctgtgatccagagggccatgctgaagcacaacctggacagcgaccctgctgaggagtatgagctggtgcaggtgatcagcgaggacaaggagctggtgatcccagattctgccaacgtgttctacgccatgaacagccaggtgaactttgacttcatcctgaggaagaagaacagcatggaggagcaggtgaagctgcggagcaggaccagcctgaccctgcccaggacagccaagaggggctgctggagcaacagacacagcaagatcaccctgtag

SEQ ID NO: 167063 - DNA, 2220 bp, Artificial Sequence
  Description of Artificial Sequence: Synthetic coding sequence
atgaagctgctgtggcaggccaagatgagcagcatccaggactggggcgaggaggtggaggagggcgctgtgtaccacgtgaccctgaagagggtgcagatccagcaggccgccaacaagggggcccgctggctgggcgtggagggggaccagctgcccccaggccacacagtgtcccagtatgagacctgcaagatccgcaccatcaaggccggcaccctggagaagctggtggagaacctgctgacagcctttggagacaatgacttcacctacatcagcatcttcctgagcacctaccggggctttgccagcaccaaggaggtgctggagctgctgctggacagatatggcaacctgaccagccccaactgtgaagaagatggcagccagagcagcagcgagagcaagatggtgatcagaaatgccatcgccagcatcctgcgggcctggctggaccagtgtgccgaggacttccgggagcccccccacttcccctgcctgcagaagctgctggactacctgaccaggatgatgcctggcagtgaccctgagcggcgggcccagaacctgctggagcagttccagaagcaggaggtggagacagacaatggcctgcccaacaccatctccttcagcctggaggaggaggaggagctggagggcggggagagcgctgagttcacctgcttcagcgaggacctggtggccgagcagctgacctacatggatgcccagctgttcaagaaggtggtgccccaccactgcctgggctgcatctggagcagaagagacaagaaggagaacaagcacctggcccccaccatccgggccaccatcagccagttcaacaccctgaccaagtgtgtggtgtccaccatcctgggcggcaaggagctgaagacccagcagagggccaagatcatcgagaagtggatcaacatcgcccacgagtgccgcctgctgaagaacttcagcagcctgcgggccatcgtgtctgccctgcagagcaacagcatctaccgcctgaagaagacctgggccgctgtgccccgggacaggatgctgatgtttgaggagctgagtgacatcttcagtgaccacaacaaccacctgaccagccgggagctgctgatgaaggagggcaccagcaagtttgccaacctggacagctctgtgaaggagaaccagaagaggacccagaggcggctgcagctgcagaaggacatgggcggcctcatcaactttgagaagagaagaagagaatttgaagtcatcgcccagatcaagctgctgcagagcgcctgcaacagctactgcatgaccccagaccagaagttcatccagtggttccagaggcagcagctgctgacagaggaggagagctatgccctgagctgtgaaattgaagctgctgctgatgccagcaccaccagccccaagcccaggaagtccatggtgaagaggctgagcctgctcttcctgggcagtgacatgatcaccagccccacccccaccaaggagcagcccaagagcacagccagcggcagcagcggggagagcatggacagcgtgtctgtgagcagctgtgagagcaaccacagcgaggccgaggagggcagcatcacccccatggacaccccagatgagccccagaagaagctgtctgagagcagcagcagctgcagcagcatccacagcatggacaccaacagcagcggcatgagcagcctcatcaaccccctgagcagcccccccagctgcaacaacaaccccaagatccacaagaggtctgtgtctgtgaccagcatcaccagcacagtgctgccccctgtgtacaaccagcagaatgaagacacctgcatcatccgcatctctgtggaggacaacaatggaaacatgtacaagagcatcatgctgaccagccaggacaagaccccagctgtgatccagagggccatgctgaagcacaacctggacagcgaccctgctgaggagtatgagctggtgcaggtgatcagcgaggacaaggagctggtgatcccagacagcgccaacgtgttctacgccatgaacagccaggtgaactttgacttcatcctgaggaagaagaacagcatggaggagcaggtgaagctgcggagcaggaccagcctgaccctgcccaggacagccaagaggggctgctggagcaacagacacagcaagatcaccctgtag

SEQ ID NO: 167064 - DNA, 1173 bp, Artificial Sequence
  Description of Artificial Sequence: Synthetic coding sequence
atgggcagcttcaaggacagaggagatggcctgcccaacaccatctccttcagcctggaggaggaggaggagctggagggcggggagagcgctgagttcacctgcttcagcgaggacctggtggccgagcagctgacctacatggatgcccagctgttcaagaaggtggtgccccaccactgcctgggctgcatctggagccggcgggacaagaaggagaacaagcacctggcccccaccatccgggccaccatcagccagttcaacaccctgaccaagtgtgtggtgtccaccatcctgggcggcaaggagctgaagacccagcagagggccaagatcatcgagaagtggatcaacatcgcccatgaatgtcggctgctgaagaacttcagcagcctgcgggccatcgtgtctgccctgcagagcaacagcatctaccgcctgaagaagacctgggccgctgtgccccgggacaggatgctgatgtttgaggagctgagtgacatcttcagtgaccacaacaaccacctgaccagccgggagctgctgatgaaggagggcaccagcaagtttgccaacctggacagctctgtgaaggagaaccagaagaggacccagaggcggctgcagctgcagaaggacatgggcgtgatgcagggcaccgtgccctacctgggcaccttcctgacagacctgaccatgctggacacagccctgcaggactacattgaaggaggcctcatcaactttgagaagagaagaagagaatttgaagtcatcgcccagatcaagctgctgcagagcgcctgcaacagctactgcatgaccccagaccagaagttcatccagtggttccagaggcagcagctgctgacagaggaggagagctatgccctgagctgtgaaattgaagctgctgctgatgccagcaccaccagccccaagcccaggaagtccatggtgaagaggctgagcctgctcttcctgggcagtgacatgatcaccagccccacccccaccaaggagcagcccaagagcacagccagcggcagcagcggggagagcatggacagcgtgtctgtgagcagctgtgagagcaaccacagcgaggccgaggagggcagcatcacccccatggacaccccagatgagccccagaagaaggccctgtag

SEQ ID NO: 167065 - DNA, 1422 bp, Artificial Sequence
  Description of Artificial Sequence: Synthetic coding sequence
atgaggaagctgctgaccaacctgcctgctgctgctgtgctgagcgcccaggtgtacagcgctgtgctgcagggcctgtgggaggagaatgtgtgtggcaccccaggccgcaccagggtgtgcacagccctgctgtatggccaggtgtgccccttccaggacagcacagatggcctgcggaccatcaccagcatcctcttcaactggcccccagagaacacctctgtgtactaccagcccccccagaggagcagcttccgcatcaagctggccttcaggaacctgtcctggccaggcctgggcctggaggaccaccaggagatcgtgctgggccagctggtgctgcctgagcccaatgaggccaagccagatgatcctgccccccggcccggccagcacgccctgaccatgcctgccctggagcccgccccacccctgctggccgacctgggccctgccctggagcctgagagccctgctgccctgggccccccaggctacctgcacagcgcccctggccctgccccagcccctggagagggccccccacctggcaccgtgctggagccccagagcgcccctgagagcagctgcccctgccggggctctgtgaagaaccagcccagcgaggagctgcctgacatgaccaccttccccccccggctgctggccgagcagctgaccctgatggatgctgagctgttcaagaaggtggtgctgcacgagtgcctgggctgcatctggggccagggccacctgaagggaaatgagcacatggcccccaccgtgcgggccaccatcgcccacttcaaccggctgaccaactgcatcaccaccagctgcctgggggaccacagcatgagggcccgggaccgggcccgggtggtggagcactggatcaaggtggccagagaatgtctgagcctgaacaacttcagctctgtgcacgtgattgtgtctgccctgtgcagcaaccccatcggccagctgcacaagacctgggccggcgtgagcagcaagtccatgaaggagctgaaggagctgtgcaagaaggacacagctgtgaagagggacctgctgatcaaggccggcagcttcaaggtggccacccaggagaggaacccccagagggtgcagatgaggctgcggcggcagaagaagggcgtggtgcccttcctgggggacttcctgacagagctgcagaggctggacagcgccatcccagatgacctggatggcaacaccaacaagaggagcaaggaggtgcgggtgctgcaggagatgcagctgctgcaggtggccgccatgaactaccgcctgcggcccctggagaagtttgtgacctacttcaccaggatggagcagctgagtgacaaggagagctacaagctgagctgccagctggagcctgagaacccctag

SEQ ID NO: 167066 - DNA, 1743 bp, Artificial Sequence
  Description of Artificial Sequence: Synthetic coding sequence
atgaggaagctgctgaccaacctgcctgctgctgctgtgctgagcgcccaggtgtacagcgctgtgctgcagggcctgtgggaggagaatgtgtgtggcaccccaggccgcaccagggtgtgcacagccctgctgtatggccaggtgtgccccttccaggacagcacagatggcctgcggaccatcaccagcatcctcttcaactggcccccagagaacacctctgtgtactaccagcccccccagaggagcagcttccgcatcaagctggccttcaggaacctgtcctggccaggcctgggcctggaggaccaccaggagatcgtgctgggccagctggtgctgcctgagcccaatgaggccaagccagatgatcctgccccccggcccggccagcacgccctgaccatgcctgccctggagcccgccccacccctgctggccgacctgggccctgccctggagcctgagagccctgctgccctgggccccccaggctacctgcacagcgcccctggccctgccccagcccctggagagggccccccacctggcaccgtgctggagccccagagcgcccctgagagcagctgcccctgccggggctctgtgaagaaccagcccagcgaggagctgcctgacatgaccaccttccccccccggctgctggccgagcagctgaccctgatggatgctgagctgttcaagaaggtggtgctgcacgagtgcctgggctgcatctggggccagggccacctgaagggaaatgagcacatggcccccaccgtgcgggccaccatcgcccacttcaaccggctgaccaactgcatcaccaccagctgcctgggggaccacagcatgagggcccgggaccgggcccgggtggtggagcactggatcaaggtggccagagaatgtctgagcctgaacaacttcagctctgtgcacgtgattgtgtctgccctgtgcagcaaccccatcggccagctgcacaagacctgggccggcgtgagcagcaagtccatgaaggagctgaaggagctgtgcaagaaggacacagctgtgaagagggacctgctgatcaaggccggcagcttcaaggtggccacccaggagaggaacccccagagggtgcagatgaggctgcggcggcagaagaagggcgtggtgcccttcctgggggacttcctgacagagctgcagaggctggacagcgccatcccagatgacctggatggcaacaccaacaagaggagcaaggaggtgcgggtgctgcaggagatgcagctgctgcaggtggccgccatgaactaccgcctgcggcccctggagaagtttgtgacctacttcaccaggatggagcagctgagtgacaaggagcgctggggcttcaccatgatgagccgcatcgtgagcaacagctggccccaggccatccaccccccccagccccccaaggtgctgaccctgcagctgcaggccgtgctgcctgctggggccaggaagcctgtgggctggcagcaccctgctgtggccggcaaccccccaggctgctggccagagcaccggctgtgcaccatcccccacccagaccggcggcaccagggcaccaccagccggcggctggccgcccagctgcacctggccctggacccccaccaccagctgctgctgctggcccgcatccggccctgggacttctgtgagagcggcggccggcccttctacgtgtacttcctgtag

SEQ ID NO: 167067 - DNA, 1968 bp, Artificial Sequence
  Description of Artificial Sequence: Synthetic coding sequence
atgacagagtgcttcctgccccccaccagcagccccagcgagcaccggcgggtggagcacggcagcggcctgaccaggacccccagcagcgaggagatcagccccaccaagtttcctggcctgtacagaactggagagcccagcccccctcatgacatcctgcacgagcccccagatgtggtgtctgatgatgagaaggaccacggcaagaagaagggcaagttcaagaagaaggagaagaggacagagggctacgccgccttccaggaggacagcagtggagatgaagctgagagccccagcaagatgaagaggagcaagggcatccacgtgttcaagaagcccagcttcagcaagaagaaggagaaggacttcaagatcaaggagaagcccaaggaggagaagcacaaggaggagaagcacaaggaggagaagcacaaggagaagaagagcaaggacctgacagctgctgatgtggtgaagcagtggaaggagaagaagaagaagaagaagcccatccaggagcctgaggtgccccagattgatgtgcccaacctgaagcccatcttcggcatccccctggctgatgctgtggagaggaccatgatgtatgatggcatccggctgcctgctgtgttcagagaatgtattgattatgtggagaagtatggcatgaagtgtgagggcatctacagagtgtctggcatcaagagcaaggtggatgagctgaaggccgcctatgaccgggaggagagcaccaacctggaggactatgagcccaacacagtggccagcctgctgaagcagtacctgcgggacctgcctgagaacctgctgaccaaggagctgatgcccaggtttgaggaggcctgtggccgcaccacagaaacagagaaggtgcaggagttccagaggctgctgaaggagctgcctgagtgcaactacctgctgatctcctggctgattgtgcacatggaccacgtgattgccaaggagctggagaccaagatgaacatccagaacatcagcatcgtgctgagccccaccgtgcagatcagcaacagagtgctgtatgtgttcttcacccacgtgcaggagctgtttggaaatgtggtgctgaagcaggtgatgaagcccctgcgctggagcaacatggccaccatgcccaccctgcctgagacccaggccggcatcaaggaggagatccggcggcaggagttcctgctgaactgcctgcaccgggacctgcagggcggcatcaaggacctgagcaaggaggagcggctgtgggaggtgcagaggatcctgacagccctgaagaggaagctgcgggaggccaagaggcaggagtgtgagaccaagatcgcccaggagatcgccagcctgagcaaagaagatgtgtccaaggaggagatgaatgaaaatgaggaggtgatcaacatcctgctggcccaggagaatgagatcctgacagagcaggaggagctgctggccatggagcagttcctgcggcggcagatcgccagcgagaaggaggagattgaaaggctgcgggcagaaattgctgagatccagagccggcagcagcacggccgctcagaaacagaggagtacagcagcgagagcgagagcgagagtgaagatgaggaggagctgcagatcatcctggaggacctgcagaggcagaatgaggagctggagatcaagaacaaccacctgaaccaggccatccacgaggagcgggaggccatcatcgagctgcgggtgcagctgcggctgctgcagatgcagagggccaaggccgagcagcaggcccaggaggatgaggagcctgagtggaggggcggcgctgtgcagcccccaagagatggagtgctggagcccaaggccgccaaggagcagcccaaggccggcaaggagcccgccaagcccagccccagccgggacaggaaggagaccagcatctag

SEQ ID NO: 167068 - DNA, 1968 bp, Artificial Sequence; identical to SEQ ID NO: 167067
  Description of Artificial Sequence: Synthetic coding sequence

SEQ ID NO: 167069 - DNA, 1044 bp, Artificial Sequence
  Description of Artificial Sequence: Synthetic coding sequence
atgacagagtgcttcctgccccccaccagcagccccagcgagcaccggcgggtggagcacggcagcggcctgaccaggacccccagcagcgaggagatcagccccaccaagtttcctggcctgtacagaactggagagcccagcccccctcatgacatcctgcacgagcccccagatgtggtgtctgatgatgagaaggaccacggcaagaagaagggcaagttcaagaagaaggagaagaggacagagggctacgccgccttccaggaggacagcagtggagatgaagctgagagccccagcaagatgaagaggagcaagggcatccacgtgttcaagaagcccagcttcagcaagaagaaggagaaggacttcaagatcaaggagaagcccaaggaggagaagcacaaggaggagaagcacaaggaggagaagcacaaggagaagaagagcaaggacctgacagctgctgatgtggtgaagcagtggaaggagaagaagaagaagaagaagcccatccaggagcctgaggtgccccagattgatgtgcccaacctgaagcccatcttcggcatccccctggctgatgctgtggagaggaccatgatgtatgatggcatccggctgcctgctgtgttcagagaatgtattgattatgtggagaagtatggcatgaagtgtgagggcatctacagagtgtctggcatcaagagcaaggtggatgagctgaaggccgcctatgaccgggaggagagcaccaacctggaggactatgagcccaacacagtggccagcctgctgaagcagtacctgcgggacctgcctgagaacctgctgaccaaggagctgatgcccaggtttgaggaggcctgtggccgcaccacagaaacagagaaggtgcagagcagtggagaggaggccgcccggagctgccagttcctgacagctggcaccagcaagggcctgctgaccggcctggtgaagggcagccacctgggcctggtgcacccccagaggatgctgttcaagccagagatcttctag

SEQ ID NO: 167070 - DNA, 1980 bp, Artificial Sequence
  Description of Artificial Sequence: Synthetic coding sequence
atggaggccgctgctgctgctgctgctgctgctgctgctgctgctgctgctgggggcggctgcggcagcggccccccacccctgctgctgtctgagggggagcagcagtgctacagcgagctgtttgcccgctgtgccggggctgctgggggcggccctggcagcggccccccagaggccgcccgggtggcccctggaacagccacagctgctgctggccctgtggccgacctcttccgggccagccagctgcctgctgagaccctgcaccagatcacagagctgtgtggggccaagagggtgggctacttcggccccacccagttctacatcgccctgaagctgattgctgctgcccagagcggcctgcctgtgagaattgagagcatcaagtgtgagctgcccctgccccgcttcatgatgagcaagaatgatggagagatccgcttcggcaacccagctgagctgcacggcaccaaggtgcagatcccctacctgaccacagagaagaacagcttcaagaggatggatgatgaggacaagcaggagacccagagccccaccatgagccccctggccagcccccccagcagccccccccactaccagagggtgcccctgagccacggctacagcaagctgcggagcagcgctgagcagatgcacccagccccctatgaggcccggcagcccctggtgcagcctgagggcagcagcagcggcggccctggcaccaagcccctgcggcaccaggccagcctcatccgctccttctctgtggagcgggagctgcaggacaacagcagctacccagatgagccctggaggatcacagaggagcagcgggagtactacgtgaaccagttccgcagcctgcagcctgaccccagcagcttcatcagcggctctgtggccaagaacttcttcaccaagagcaagctgagcatccctgagctgagctacatctgggagctgagtgatgctgactgtgatggagccctgaccctgcctgagttctgtgccgccttccacctgattgtggccaggaagaatggctaccccctgcctgagggcctgccccccaccctgcagcctgagtacctgcaggccgccttccccaagcccaagtgggactgccagctgtttgacagctacagcgagagcctgcctgccaaccagcagccccgggacctgaacaggatggagaagacctctgtgaaggacatggctgacctgcctgtgcccaaccaggatgtgaccagtgatgacaagcaggccctgaagagcaccatcaatgaggccctgcccaaggatgtgtctgaagatcctgccacccccaaggacagcaacagcctgaaggcccggcccaggagccgcagctacagcagcaccagcattgaggaggccatgaagagaggagaggacccccccaccccaccaccccggccccagaagacccacagccgggccagcagcctggacctgaacaaggtgttccagcccagcgtgcctgccaccaagagcggcctgctgcccccacctccagccctgcccccccggccctgccccagccagagcgagcaggtgtctgaggccgagctgctgccccagctgagccgggcccccagccaggccgctgagagcagccctgccaagaaggatgtgctgtacagccagccccccagcaagcccatccggaggaagttccggcctgagaaccaggccacagagaaccaggagcccagcacagctgccagcggccctgccagcgctgccaccatgaagccccaccccaccgtgcagaagcagagcagcaagcagaagaaggccatccagacagccatcaggaagaacaaggaggccaatgctgtgctggcccggctgaacagcgagctgcagcagcagctgaaggaggtgcaccaggagcgcatcgccctggagaaccagctggagcagctgcggcctgtgacagtgctgtag

SEQ ID NO: 167071 - DNA, 1983 bp, Artificial Sequence
  Description of Artificial Sequence: Synthetic coding sequence
atggaggccgctgctgctgctgctgctgctgctgctgctgctgctgctgctgggggcggctgcggcagcggccccccacccctgctgctgtctgagggggagcagcagtgctacagcgagctgtttgcccgctgtgccggggctgctgggggcggccctggcagcggccccccagaggccgcccgggtggcccctggaacagccacagctgctgctggccctgtggccgacctcttccgggccagccagctgcctgctgagaccctgcaccagatcacagagctgtgtggggccaagagggtgggctacttcggccccacccagttctacatcgccctgaagctgattgctgctgcccagagcggcctgcctgtgagaattgagagcatcaagtgtgagctgcccctgccccgcttcatgatgagcaagaatgatggagagatccgcttcggcaacccagctgagctgcacggcaccaaggtgcagatcccctacctgaccacagagaagaacagcttcaagaggatggatgatgaggacaagcagcaggagacccagagccccaccatgagccccctggccagcccccccagcagccccccccactaccagagggtgcccctgagccacggctacagcaagctgcggagcagcgctgagcagatgcacccagccccctatgaggcccggcagcccctggtgcagcctgagggcagcagcagcggcggccctggcaccaagcccctgcggcaccaggccagcctcatccgctccttctctgtggagcgggagctgcaggacaacagcagctacccagatgagccctggaggatcacagaggagcagcgggagtactacgtgaaccagttccgcagcctgcagcctgaccccagcagcttcatcagcggctctgtggccaagaacttcttcaccaagagcaagctgagcatccctgagctgagctacatctgggagctgagtgatgctgactgtgatggagccctgaccctgcctgagttctgtgccgccttccacctgattgtggccaggaagaatggctaccccctgcctgagggcctgccccccaccctgcagcctgagtacctgcaggccgccttccccaagcccaagtgggactgccagctgtttgacagctacagcgagagcctgcctgccaaccagcagccccgggacctgaacaggatggagaagacctctgtgaaggacatggctgacctgcctgtgcccaaccaggatgtgaccagtgatgacaagcaggccctgaagagcaccatcaatgaggccctgcccaaggatgtgtctgaggaccctgccacccccaaggacagcaacagcctgaaggcccggcccaggagccgcagctacagcagcaccagcattgaggaggccatgaagagaggagaagatcctcccaccccaccaccccggccccagaagacccacagccgggccagcagcctggacctgaacaaggtgttccagcccagcgtgcctgccaccaagagcggcctgctgcccccacctccagccctgcccccccggccctgccccagccagagcgagcaggtgtctgaggccgagctgctgccccagctgagccgggcccccagccaggccgctgagagcagccctgccaagaaggatgtgctgtacagccagccccccagcaagcccatccggaggaagttccggcctgagaaccaggccacagagaaccaggagcccagcacagctgccagcggccctgccagcgctgccaccatgaagccccaccccaccgtgcagaagcagagcagcaagcagaagaaggccatccagacagccatcaggaagaacaaggaggccaatgctgtgctggcccggctgaacagcgagctgcagcagcagctgaaggaggtgcaccaggagagaattgccctggagaaccagctggagcagctgcggcctgtgacagtgctgtag

SEQ ID NO: 167072 - DNA, 1824 bp, Artificial Sequence
  Description of Artificial Sequence: Synthetic coding sequence
atggaggccgctgctgctgctgctgctgctgctgctgctgctgctgctgctgggggcggctgcggcagcggccccccacccctgctgctgtctgagggggagcagcagtgctacagcgagctgtttgcccgctgtgccggggctgctgggggcggccctggcagcggccccccagaggccgcccgggtggcccctggaacagccacagctgctgctggccctgtggccgacctcttccgggccagccagctgcctgctgagaccctgcaccagatcacagagctgtgtggggccaagagggtgggctacttcggccccacccagttctacatcgccctgaagctgattgctgctgcccagagcggcctgcctgtgagaattgagagcatcaagtgtgagctgcccctgccccgcttcatgatgagcaagaatgatggagagatccgcttcggcaacccagctgagctgcacggcaccaaggtgcagatcccctacctgaccacagagaagaacagcttcaagaggatggatgatgaggacaagcagcaggagacccagagccccaccatgagccccctggccagcccccccagcagccccccccactaccagagggtgcccctgagccacggctacagcaagctgcggagcagcgctgagcagatgcacccagccccctatgaggcccggcagcccctggtgcagcctgagggcagcagcagcggcggccctggcaccaagcccctgcggcaccaggccagcctcatccgctccttctctgtggagcgggagctgcaggacaacagcagctacccagatgagccctggaggatcacagaggagcagcgggagtactacgtgaaccagttccgcagcctgcagcctgaccccagcagcttcatcagcggctctgtggccaagaacttcttcaccaagagcaagctgagcatccctgagctgagctacatctgggagctgagtgatgctgactgtgatggagccctgaccctgcctgagttctgtgccgccttccacctgattgtggccaggaagaatggctaccccctgcctgagggcctgccccccaccctgcagcctgagtacctgcaggccgccttccccaagcccaagtgggactgccagctgtttgacagctacagcgagagcctgcctgccaaccagcagccccgggacctgaacaggatggagaagacctctgtgaaggacatggctgacctgcctgtgcccaaccaggatgtgaccagtgatgacaagcaggccctgaagagcaccatcaatgaggccctgcccaaggatgtgtctgaggaccctgccacccccaaggacagcaacagcctgaaggcccggcccaggagccgcagctacagcagcaccagcattgaggaggccatgaagagaggagaagatcctcccaccccaccaccccggccccagaagacccacagccgggccagcagcctggacctgaacaaggtgttccagcccagcgtgcctgccaccaagagcggcctgctgcccccacctccagccctgcccccccggccctgccccagccagagcgagcaggtgtctgaggccgagctgctgccccagctgagccgggcccccagccaggccgctgagagcagccctgccaagaaggatgtgctgtacagccagccccccagcaagcccatccggaggaagttccggcctgtgtgtggcatccagcccctcatcagcattgagctgcgggccttccgcaccagccgccacctgttcaacgtgtccctggtgcactggcaggccctgagcatcgcctag

SEQ ID NO: 167073 - DNA, 1380 bp, Artificial Sequence
  Description of Artificial Sequence: Synthetic coding sequence
atgatgagcaagaatgatggagagatccgctttggaaatcctgctgagctgcacggcaccaaggtgcagatcccctacctgaccacagagaagaacagcttcaagaggatggatgatgaggacaagcaggagacccagagccccaccatgagccccctggccagcccccccagcagccccccccactaccagagggtgcccctgagccacggctacagcaagctgcggagcagcgctgagcagatgcacccagccccctatgaggcccggcagcccctggtgcagcctgagggcagcagcagcggcggccctggcaccaagcccctgcggcaccaggccagcctcatccgctccttctctgtggagcgggagctgcaggacaacagcagctacccagatgagccctggaggatcacagaggagcagcgggagtactacgtgaaccagttccgcagcctgcagcctgaccccagcagcttcatcagcggctctgtggccaagaacttcttcaccaagagcaagctgagcatccctgagctgagctacatctgggagctgagtgatgctgactgtgatggagccctgaccctgcctgagttctgtgccgccttccacctgattgtggccaggaagaatggctaccccctgcctgagggcctgccccccaccctgcagcctgagtacctgcaggccgccttccccaagcccaagtgggactgccagctgtttgacagctacagcgagagcctgcctgccaaccagcagccccgggacctgaacaggatggagaagacctctgtgaaggacatggctgacctgcctgtgcccaaccaggatgtgaccagtgatgacaagcaggccctgaagagcaccatcaatgaggccctgcccaaggatgtgtctgaggaccctgccaccaagagcggcctgctgcccccacctccagccctgcccccccggccctgccccagccagagcgagcaggtgtctgaggccgagctgctgccccagctgagccgggcccccagccaggccgctgagagcagccctgccaagaaggatgtgctgtacagccagccccccagcaagcccatccggaggaagttccggcctgagaaccaggccacagagaaccaggagcccagcacagctgccagcggccctgccagcgctgccaccatgaagccccaccccaccgtgcagaagcagagcagcaagcagaagaaggccatccagacagccatcaggaagaacaaggaggccaatgctgtgctggcccggctgaacagcgagctgcagcagcagctgaaggaggtgcaccaggagcgcatcgccctggagaaccagctggagcagctgcggcctgtgacagtgctgtag

SEQ ID NO: 167074 - DNA, 1863 bp, Artificial Sequence
  Description of Artificial Sequence: Synthetic coding sequence
atggctgctgccacagctgaccccggggccggcaacccccagcccggggacagcagcggcggcggggccggcggcggcctgcccagccctggagagcaggagctgagccggcggctgcagaggctgtacccagctgtgaaccagcaggagacccccctgcccaggtcctggagccccaaggacaagtacaactacatcggcctgagccagggcaacctgcgggtgcactacaagggccacggcaagaaccacaaggatgctgcctctgtgcgggccacccaccccatcccagctgcctgtggcatctactactttgaggtgaagatcgtgtccaagggcagagatggctacatgggcatcggcctgagcgcccagggcgtgaacatgaaccggctgcccggctgggacaagcacagctatggctaccatggagatgatggccacagcttctgcagcagcggcaccggccagccctacggccccaccttcaccactggagatgtgattggctgctgcgtgaacctgatcaatggcacctgcttctacaccaagaatggccacagcctgggcatcgccttcacagacctgcctgccaacctgtaccccaccgtgggcctgcagaccccaggagagatcgtggatgccaactttggccagcagcccttcctgtttgatattgaggactacatgagggagtggagggccaaggtgcagggcaccgtgcactgcttccccatcagcgcccggctgggggagtggcaggccgtgctgcagaacatggtgtcctcctacctggtgcaccacggctactgtgccacagccacagcctttgccaggatgacagagacccccatccaggaggagcaggccagcatcaagaaccggcagaagatccagaagctggtgctggagggccgggtgggggaggccatcgagaccacccagcgcttctacccaggcctgctggagcacaaccccaacctgctcttcatgctgaagtgccggcagtttgtggagatggtgaatggaacagacagcgaggtgcgcagcctgagcagccgcagccccaagagccaggacagctacccaggcagccccagcctgagccccaggcatggccccagcagcagccacatgcacaacacaggagctgacagccccagctgcagcaatggagtggccagcaccaagagcaagcagaaccacagcaagtacccagcccccagcagcagcagcagcagcagcagcagcagcagcagcagcagccccagctctgtgaactacagcgagagcaacagcacagacagcaccaagagccagcaccacagcagcaccagcaaccaggagaccagtgacagcgagatggagatggaggccgagcactaccccaacggggtgctgggctccatgagcacccgcatcgtgaatggagcctacaagcatgaggacctgcagacagatgagagctccatggatgacagacacccccggcggcagctgtgtggcggcaaccaggccgccacagagcgcatcatcctgtttggccgggagctgcaggccctgtctgagcagctgggccgggagtatggcaagaacctggcccacacagagatgctgcaggatgccttcagcctgctggcctacagcgacccctggagctgccctgtgggccagcagctggaccccatccagcgggagcctgtgtgtgccgccctgaacagcgccatcctggagagccagaacctgcccaagcagccccccctgatgctggccctgggccaggcctctgaatgtctgcggctgatggcccgggccggcctgggcagctgcagctttgcccgggtggatgactacctgcactag

SEQ ID NO: 167075 - DNA, 1602 bp, Artificial Sequence
  Description of Artificial Sequence: Synthetic coding sequence
atgggcatcggcctgagcgcccagggcgtgaacatgaaccggctgcccggctgggacaagcacagctatggctaccatggagatgatggccacagcttctgcagcagcggcaccggccagccctacggccccaccttcaccactggagatgtgattggctgctgcgtgaacctgatcaatggcacctgcttctacaccaagaatggccacagcctgggcatcgccttcacagacctgcctgccaacctgtaccccaccgtgggcctgcagaccccaggagaaattgtggatgccaactttggccagcagcccttcctgtttgatattgaggactacatgagggagtggagggccaaggtgcagggcaccgtgcactgcttccccatcagcgcccggctgggggagtggcaggccgtgctgcagaacatggtgagcagctacctggtgcaccacggctactgtgccacagccacagcctttgccaggatgacagagacccccatccaggaggagcaggccagcatcaagaaccggcagaagatccagaagctggtgctggagggccgggtgggggaggccatcgagaccacccagcgcttctacccaggcctgctggagcacaaccccaacctgctcttcatgctgaagtgccggcagtttgtggagatggtgaatggaacagattctgaggtgcgcagcctgagcagccgcagccccaagagccaggacagctacccaggcagccccagcctgagccccaggcatggccccagcagcagccacatgcacaacacaggagctgacagccccagctgcagcaatggagtggccagcaccaagagcaagcagaaccacagcaagtacccagcccccagcagcagcagcagcagcagcagcagcagcagcagcagcagccccagctctgtgaactacagcgagagcaacagcacagacagcaccaagagccagcaccacagcagcaccagcaaccaggagaccagcaacccctggctgcagctggagcggcggcccaaccaggccgcccccaccaccccacctggccccacccccaccagcaccccaccccacagcgacagcgagatggagatggaggccgagcactacccaaatggagtgctgggctccatgagcaccagaattgtgaatggagcctacaagcatgaggacctgcagacagatgagagctccatggatgacagacacccccggcggcagctgtgtggcggcaaccaggccgccacagagcgcatcatcctgtttggccgggagctgcaggccctgtctgagcagctgggccgggagtatggcaagaacctggcccacacagagatgctgcaggatgccttcagcctgctggcctacagcgacccctggagctgccctgtgggccagcagctggaccccatccagcgggagcctgtgtgtgccgccctgaacagcgccatcctggagagccagaacctgcccaagcagccccccctgatgctggccctgggccaggccagcgagtgcctgcggctgatggcccgggccggcctgggcagctgcagctttgcccgggtggatgactacctgcactag

SEQ ID NO: 167076 - DNA, 540 bp, Artificial Sequence
  Description of Artificial Sequence: Synthetic coding sequence
atgggctgggacaagcacagctatggctaccatggagatgatggccacagcttctgcagcagcggcaccggccagccctacggccccaccttcaccactggagatgtgattggctgctgcgtgaacctgatcaatggcacctgcttctacaccaagaatggccacagcctgggcatcgccttcacagacctgcctgccaacctgtaccccaccgtgggcctgcagaccccaggagagatcgtggatgccaactttggccagcagcccttcctgtttgatattgaggactacatgagggagtggagggccaaggtgcagggcaccgtgcactgcttccccatcagcgcccggctgggggagtggcaggccgtgctgcagaacatggtgtcctcctacctggtgcaccacggctactgtgccacagccacagcctttgccaggatgacagagacccccatccaggaggagcaggccagcatcaagaaccggcagagcaaggtgtacagcaccttccccttccccttcctgacctgcccctag

SEQ ID NO: 167077 - DNA, 1785 bp, Artificial Sequence
  Description of Artificial Sequence: Synthetic coding sequence
atggctgctgccacagctgaccccggggccggcaacccccagcccggggacagcagcggcggcggggccggcggcggcctgcccagccctggagagcaggagctgagccggcggctgcagaggctgtacccagctgtgaaccagcaggagacccccctgcccaggtcctggagccccaaggacaagtacaactacatcggcctgagccagggcaacctgcgggtgcactacaagggccacggcaagaaccacaaggatgctgcctctgtgcgggccacccaccccatcccagctgcctgtggcatctactactttgaggtgaagatcgtgtccaagggcagagatggctacatgggcatcggcctgagcgcccagggcgtgaacatgaaccggctgcccggcatcgccttcacagacctgcctgccaacctgtaccccaccgtgggcctgcagaccccaggagagatcgtggatgccaactttggccagcagcccttcctgtttgatattgaggactacatgagggagtggagggccaaggtgcagggcaccgtgcactgcttccccatcagcgcccggctgggggagtggcaggccgtgctgcagaacatggtgtcctcctacctggtgcaccacggctactgtgccacagccacagcctttgccaggatgacagagacccccatccaggaggagcaggccagcatcaagaaccggcagaagatccagaagctggtgctggagggccgggtgggggaggccatcgagaccacccagcgcttctacccaggcctgctggagcacaaccccaacctgctcttcatgctgaagtgccggcagtttgtggagatggtgaatggaacagacagcgaggtgcgcagcctgagcagccgcagccccaagagccaggacagctacccaggcagccccagcctgagccccaggcatggccccagcagcagccacatgcacaacacaggagctgacagccccagctgcagcaatggagtggccagcaccaagagcaagcagaaccacagcaagtacccagcccccagcagcagcagcagcagcagcagcagcagcagcagcagcagccccagctctgtgaactacagcgagagcaacagcacagacagcaccaagagccagcaccacagcagcaccagcaaccaggagaccagcaacccctggctgcagctggagcggcggcccaaccaggccgcccccaccaccccacctggccccacccccaccagcaccccaccccacagcgacagcgagatggagatggaggccgagcactaccccaacggggtgctgggctccatgagcacccgcatcgtgaatggagcctacaagcatgaggacctgcagacagatgagagctccatggatgacagacacccccggcggcagctgtgtggcggcaaccaggccgccacagagcgcatcatcctgtttggccgggagctgcaggccctgtctgagcagctgggccgggagtatggcaagaacctggcccacacagagatgctgcaggatgccttcagcctgctggcctacagcgacccctggagctgccctgtgggccagcagctggaccccatccagcgggagcctgtgtgtgccgccctgaacagcgccatcctggagagccagaacctgcccaagcagccccccctgatgctggccctgggccaggcctctgaatgtctgcggctgatggcccgggccggcctgggcagctgcagctttgcccgggtggatgactacctgcactag

SEQ ID NO: 167078 - DNA, 1176 bp, Artificial Sequence
  Description of Artificial Sequence: Synthetic coding sequence
atgagggagtggagggccaaggtgcagggcaccgtgcactgcttccccatcagcgcccggctgggggagtggcaggccgtgctgcagaacatggtgagcagctacctggtgcaccacggctactgtgccacagccacagcctttgccaggatgacagagacccccatccaggaggagcaggccagcatcaagaaccggcagaagatccagaagctggtgctggagggccgggtgggggaggccatcgagaccacccagcgcttctacccaggcctgctggagcacaaccccaacctgctcttcatgctgaagtgccggcagtttgtggagatggtgaatggaacagattctgaggtgcgcagcctgagcagccgcagccccaagagccaggacagctacccaggcagccccagcctgagccccaggcatggccccagcagcagccacatgcacaacacaggagctgacagccccagctgcagcaatggagtggccagcaccaagagcaagcagaaccacagcaagtacccagcccccagcagcagcagcagcagcagcagcagcagcagcagcagcagccccagctctgtgaactacagcgagagcaacagcacagacagcaccaagagccagcaccacagcagcaccagcaaccaggagaccagtgacagcgagatggagatggaggccgagcactacccaaatggagtgctgggctccatgagcaccagaattgtgaatggagcctacaagcatgaggacctgcagacagatgagagctccatggatgacagacacccccggcggcagctgtgtggcggcaaccaggccgccacagagcgcatcatcctgtttggccgggagctgcaggccctgtctgagcagctgggccgggagtatggcaagaacctggcccacacagagatgctgcaggatgccttcagcctgctggcctacagcgacccctggagctgccctgtgggccagcagctggaccccatccagcgggagcctgtgtgtgccgccctgaacagcgccatcctggagagccagaacctgcccaagcagccccccctgatgctggccctgggccaggccagcgagtgcctgcggctgatggcccgggccggcctgggcagctgcagctttgcccgggtggatgactacctgcactag

SEQ ID NO: 167079 - DNA, 3267 bp, Artificial Sequence
  Description of Artificial Sequence: Synthetic coding sequence
atggccctgcacttccagagcctggccgagctggaggtgctgtgcacccacctgtacatcggcacagacctgacccagagaattgaggccgagaaggccctgctggagctgattgacagccctgagtgcctgagcaagtgccagctgctgctggagcagggcaccaccagctatgcccagctgctggccgccacctgcctgagcaagctggtgtcccgggtgagccccctgcctgtggagcagaggatggacatccggaactacatcctgaactacgtggccagccagcccaagctggcccccttcgtcatccaggccctgatccaggtgattgccaagatcaccaagctgggctggtttgaggtgcagaaggaccagtttgtgttccgggagatcatcgcagatgtgaagaagttcctgcagggcaccgtggagcactgcatcattggagtcatcatcctgtctgagctgacccaggagatgaacctggtggactacagccggcccagcgccaagcacaggaagatcgccaccagcttccgggacaccagcctgaaggatgtgctggtgctggcctgcagcctgctgaaggaggtgtttgccaagcccctgaacctgcaggaccagtgccagcagaacctggtgatgcaggtgctgaagctggtgctgaactgcctgaactttgacttcatcggcagcagcgcagatgagagcgcagatgacctgtgcaccgtgcagatccccaccacctggaggaccatcttcctggagcctgagaccctggacctcttcttcaacctgtaccacagcctgccccccctgctgagccagctggccctgagctgcctggtgcagtttgccagcacccggcgcagcctcttcaacagccctgagcgggccaagtacctgggcaacctgatcaagggcgtgaagaggatcctggagaacccccagggcctgagtgaccccggcaactaccacgagttctgccgcttcctggcccggctgaagaccaactaccagctgggggagctggtgatggtgaaggagtacccagaggtgatccgcctcatcgccaacttcaccatcaccagcctgcagcactgggagtttgcccccaacagcgtgcactacctgctgaccctgtggcagaggatggtggcctctgtgccctttgtgaagagcacagagccccacctgctggacacctacgcccctgagatcaccaaggccttcatcaccagccggctggacagcgtggccatcgtggtgcgggaccacctggatgaccccctggatgacacagccaccgtcttccagcagctggagcagctgtgcaccgtgagccgctgtgaatatgagaagacctgtgccctgctggtgcagctgtttgaccagaatgcccagaactaccagaagctgctgcacccctacagcggcgtgacagtggacatcaccatccaggagggccgcctggcctggctggtgtacctggtgggcaccgtggtgggcggccgcctgacctacaccagcacagatgaacatgatgccatggatggagagctgagctgcagggtcttccagctgatcagcctgatggacaccggcctgccccgctgctgcaatgagaagattgagctggccatcctgtggttcctggaccagttcaggaagacctacgtgggggaccagctgcagaggaccagcaaggtgtatgccaggatgtctgaggtgctgggcatcacagatgacaaccacgtgctggagaccttcatgaccaagatcgtgaccaacctgaagtactggggccgctatgagcctgtgatcagcaggaccctgcagttcctgaatgacctgtctgtgggctacatcctgctgaagaagctggtgaagattgatgctgtgaagttcatgctgaagaaccacaccagcgagcacttccccttcctgggcatcagtgacaaccacagcctgagtgacttccgctgcaggaccaccttctacacagccctgacccggctgctgatggtggacctgggagaagatgaagatgaatttgagaacttcatgctgcccctgactgtggcctttgaaacagtgctgcagatcttcaacaacaacttcaagcaggaggatgtgaagaggatgctgattggcctggcccgggacctgcggggcatcgcctttgccctgaacaccaagaccagctacaccatgctgtttgactggatgtaccccacctacctgcccctgctgcagaatgctgtggagcgctggtacggggagcccacctgcaccacccccatcctgaagctgatggccgagctgatgcagaacagaagccagaggctgaactttgatgtgagcagccccaacggcatcctgctcttccgggaggccagcaagatggtgtgcacctacggcaaccagatcctgagcctgggcagcctgagcaaggaccagatctaccccatgaagctgaagggcatcagcatctgctacagcgccctgaagagcgccctgtgtggcaactacgtgtcctttggagtcttcaagctgtatggagacaaccactttgacaacgtgctgcaggcctttgtgaagatgctgctgtctgtgagccacagcgacctgctgcagtacaggaagctgagccagagctactaccccctgctggagtgcctgacccaggaccacatgtccttcatcatcaacctggagccccctgtgctgatgtatgtgctgaccagcatcagcgagggcctgaccaccctggacacagtggtgagcagcagctgctgcaccagcctggactacatcgtgacctacctgttcaagcacatcgccaaggagggcaagaagcccctgcgctgccgggaggccacccaggccggccagaggctgctgcacttcatgcagcagaacccagatgtgctgcagcagatgatgtctgtgctgatgaacaccatcgtgtttgaggactgcaggaaccagtggagcgtgtcccggcccctgctgggcctcatcctgctgaatgagaagtacttcagcgagctgcgggccagcctcatcaacagccagcccctgcccaagcaggaggtgctggcccagtgcttcaggaacctgatggagggcgtggagcagaacctgtctgtgaagaacagagaccgcttcacccagaacctgtctgtgttcagaagagatgtggccgaggccctgcggagtgatggcaacacagagccctgcagcctggacatgatgtcctag

SEQ ID NO: 167080 - DNA, 1557 bp, Artificial Sequence
  Description of Artificial Sequence: Synthetic coding sequence
gtgtatgccaggatgtctgaggtgctgggcatcacagatgacaaccacgtgctggagaccttcatgaccaagatcgtgaccaacctgaagtactggggccgctatgagcctgtgatcagcaggaccctgcagttcctgaatgacctgtctgtgggctacatcctgctgaagaagctggtgaagattgatgctgtgaagttcatgctgaagaaccacaccagcgagcacttccccttcctgggcatcagtgacaaccacagcctgagtgacttccgctgcaggaccaccttctacacagccctgacccggctgctgatggtggacctgggagaagatgaagatgaatttgagaacttcatgctgcccctgactgtggcctttgaaacagtgctgcagatcttcaacaacaacttcaagcaggaggatgtgaagaggatgctgattggcctggcccgggacctgcggggcatcgcctttgccctgaacaccaagaccagctacaccatgctgtttgactggatgtaccccacctacctgcccctgctgcagaatgctgtggagcgctggtacggggagcccacctgcaccacccccatcctgaagctgatggccgagctgatgcagaacagaagccagaggctgaactttgatgtgagcagccccaacggcatcctgctcttccgggaggccagcaagatggtgtgcacctacggcaaccagatcctgagcctgggcagcctgagcaaggaccagatctaccccatgaagctgaagggcatcagcatctgctacagcgccctgaagagcgccctgtgtggcaactacgtgtcctttggagtcttcaagctgtatggagacaaccactttgacaacgtgctgcaggcctttgtgaagatgctgctgtctgtgagccacagcgacctgctgcagtacaggaagctgagccagagctactaccccctgctggagtgcctgacccaggaccacatgtccttcatcatcaacctggagccccctgtgctgatgtatgtgctgaccagcatcagcgagggcctgaccaccctggacacagtggtgagcagcagctgctgcaccagcctggactacatcgtgacctacctgttcaagcacatcgccaaggagggcaagaagcccctgcgctgccgggaggccacccaggccggccagaggctgctgcacttcatgcagcagaacccagatgtgctgcagcagatgatgtctgtgctgatgaacaccatcgtgtttgaggactgcaggaaccagtggagcgtgtcccggcccctgctgggcctcatcctgctgaatgagaagtacttcagcgagctgcgggccagcctcatcaacagccagcccctgcccaagcaggaggtgctggcccagtgcttcaggaacctgatggagggcgtggagcagaacctgtctgtgaagaacagagaccgcttcacccagaacctgtctgtgttcagaagagatgtggccgaggccctgcggagtgatggcaacacagagccctgcagcctggacatgatgtcctag

SEQ ID NO: 167081 - DNA, 1419 bp, Artificial Sequence
  Description of Artificial Sequence: Synthetic coding sequence
atggacatccggaactacatcctgaactacgtggccagccagcccaagctggcccccttcgtcatccaggccctgatccaggtgattgccaagatcaccaagctgggctggtttgaggtgcagaaggaccagtttgtgttccgggagatcatcgcagatgtgaagaagttcctgcaggtggactacagccggcccagcgccaagcacaggaagatcgccaccagcttccgggacaccagcctgaaggatgtgctggtgctggcctgcagcctgctgaaggaggtgtttgccaagcccctgaacctgcaggaccagtgccagcagaacctggtgatgcaggtgctgaagctggtgctgaactgcctgaactttgacttcatcggcagcagcgcagatgagagcgcagatgacctgtgcaccgtgcagatccccaccacctggaggaccatcttcctggagcctgagaccctggacctcttcttcaacctgtaccacagcctgccccccctgctgagccagctggccctgagctgcctggtgcagtttgccagcacccggcgcagcctcttcaacagccctgagcgggccaagtacctgggcaacctgatcaagggcgtgaagaggatcctggagaacccccagggcctgagtgaccccggcaactaccacgagttctgccgcttcctggcccggctgaagaccaactaccagctgggggagctggtgatggtgaaggagtacccagaggtgatccgcctcatcgccaacttcaccatcaccagcctgcagcactgggagtttgcccccaacagcgtgcactacctgctgaccctgtggcagaggatggtggcctctgtgccctttgtgaagagcacagagccccacctgctggacacctacgcccctgagatcaccaaggccttcatcaccagccggctggacagcgtggccatcgtggtgcgggaccacctggatgaccccctggatgacacagccaccgtcttccagcagctggagcagctgtgcaccgtgagccgctgtgaatatgagaagacctgtgccctgctggtgcagctgtttgaccagaatgcccagaactaccagaagctgctgcacccctacagcggcgtgacagtggacatcaccatccaggagggccgcctggcctggctggtgtacctggtgggcaccgtggtgggcggccgcctgacctacaccagcacagatgaacatgatgccatggatggagagctgagctgcagggtcttccagctgatcagcctgatggacaccggcctgccccgctgctgcaatgagaagattgagctggccatcctgtggttcctggaccagttcaggaagacctacgtgggggaccagctgcagaggaccagcaagaagaccttcatctacctgtag

SEQ ID NO: 167082 - DNA, 9675 bp, Artificial Sequence
  Description of Artificial Sequence: Synthetic coding sequence
atgaggaggagcaaggcagatgtggagcgctacatcgcctctgtgcagggcagcacccccagcccccggcagaagtccatgaagggcttctactttgccaagctgtactatgaggccaaggagtatgacctggccaagaagtacatctgcacctacatcaacgtgcaggagcgggaccccaaggcccaccgcttcctgggcctgctgtatgagctggaggagaacacagacaaggctgtggagtgctaccgccgctctgtggagctgaaccccacccagaaggacctggtgctgaagattgctgagctgctgtgcaagaatgatgtgacagatggccgggccaagtactggctggagagagctgccaagctgtttcctggcagccctgccatctacaagctgaaggagcagctgctggactgtgagggggaggatggctggaacaagctgtttgacctgatccagagcgagctgtatgtgcggccagatgatgtgcacgtgaacatccggctggtggaggtgtaccgcagcaccaagaggctgaaggatgctgtggcccactgccatgaagctgagagaaatattgccctgcggagcagcctggagtggaacagctgtgtggtgcagaccctgaaggagtacctggagagcctgcagtgcctggagagtgacaagagtgactggagggccaccaacacagacctgctgctggcctatgccaacctgatgctgctgaccctgagcaccagagatgtgcaggagagccgggagctgctgcagagctttgacagcgccctgcagagcgtgaagagcctgggcggcaatgatgagctgagcgccaccttcctggagatgaagggccacttctacatgcatgctggcagcctgctgctgaagatgggccagcacagcagcaatgtgcagtggagggccctgtctgagctggccgccctgtgctacctgattgccttccaggtgccccggcccaagatcaagctgatcaagggggaggccggccagaacctgctggagatgatggcctgtgaccggctgagccagagcggccacatgctgctgaacctgagccggggcaagcaggacttcctgaaggagatcgtggagacctttgccaacaagagcggccagagcgccctgtatgatgccctcttcagcagccagagccccaaggacaccagcttcctgggcagtgatgacatcggcaacattgatgtgcgggagcctgagctggaggacctgaccaggtatgatgtgggcgccatccgggcccacaacggcagcctgcagcacctgacctggctgggcctgcagtggaacagcctgcctgccctgcccggcatcaggaagtggctgaagcagctgttccaccacctgccccatgagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccctgcctgtgtgcaagcagctgtgcacagagcggcagaagtcctggtgggatgctgtgtgcaccctcatccacaggaaggctgtgcctggaaatgtggccaagctgcggctgctggtgcagcacgagatcaacaccctgcgggcccaggagaagcacggcctgcagcctgccctgctggtgcactgggccgagtgcctgcagaagacaggcagcggcctgaacagcttctatgaccagcgggagtacatcggccgctctgtgcactactggaagaaggtgctgcccctgctgaagatcatcaagaagaagaacagcatccctgagcccatcgaccccctcttcaagcacttccacagcgtggacatccaggccagcgagatcgtggagtatgaggaggatgcccacatcacctttgccatcctggatgctgtgaatggaaatattgaagatgctgtgacagcctttgagagcatcaagtctgtggtgtcctactggaacctggccctgatcttccacaggaaggccgaggacattgaaaatgatgccctgagccctgaggagcaggaggagtgcaagaactacctgaggaagacccgggactacctgatcaagatcattgatgacagcgacagcaacctgtctgtggtgaagaagctgcctgtgcccctggagagcgtgaaggagatgctgaacagcgtgatgcaggagctggaggactacagcgagggcggccccctgtacaagaatggcagcctgagaaatgctgacagcgagatcaagcacagcacccccagccccacccgctacagcctgagccccagcaagagctacaagtacagccccaagaccccaccccgctgggccgaggaccagaacagcctgctgaagatgatctgccagcaggtggaggccatcaagaaggagatgcaggagctgaagctgaacagcagcaacagcgccagcccccaccgctggcccacagagaactacggccctgacagcgtgcctgatggctaccagggcagccagaccttccacggggcccccctgactgtggccaccaccggccccagcgtgtactacagccagagccctgcctacaacagccagtacctgctgcggcctgctgccaacgtgacccccaccaagggccctgtgtatggcatgaaccggctgcccccccagcagcacatctatgcctacccccagcagatgcacaccccacctgtgcagagcagcagcgcctgcatgttcagccaggagatgtatggccccccagccctgcgctttgagagccctgccaccggcatcctgagccccagaggagatgactacttcaactacaacgtgcagcagaccagcaccaacccccccctgcctgagcccggctacttcaccaagccacccatcgccgcccacgccagccgctctgctgagagcaagaccattgaatttgggaagaccaactttgtgcagcccatgcctggagagggcctgcggcccagcctgcccacccaggcccacaccacccagcccacccccttcaagttcaacagcaacttcaagagcaatgatggagacttcaccttcagcagcccccaggtggtgacccagcccccacctgctgcctacagcaacagcgagagcctgctgggcctgctgaccagtgacaagcccctgcagggagatggctacagcggggccaagcccatccctgggggccagaccatcggccccaggaacaccttcaactttggcagcaagaatgtgtctggcatctccttcacagagaacatgggcagcagccagcagaagaacagcggcttccgccgcagtgatgacatgttcaccttccacggccctgggaagtctgtgtttggcacccccaccctggagacagccaacaagaaccacgagacagatggcggcagcgcccatggagatgatgatgatgatggcccccactttgagcctgtggtgcccctgcctgacaagattgaggtgaagacaggagaagaagatgaggaggagttcttctgcaacagagccaagctgttccgctttgatgtggagagcaaggagtggaaggagcggggcattggaaatgtgaagatcctgcggcacaagaccagcggcaagatccggctgctgatgagaagagagcaggtgctgaagatctgtgccaaccactacatcagcccagacatgaagctgaccccaaatgccggcagtgacaggagctttgtgtggcacgccctggactatgcagatgagctgcccaagccagagcagctggccatccgcttcaagaccccagaggaggccgccctcttcaagtgcaagtttgaggaggcccagagcatcctgaaggcccctggcaccaacgtggccatggccagcaaccaggccgtgcgcatcgtgaaggagcccaccagccatgacaacaaggacatctgcaagagtgatgctggcaacctgaactttgagttccaggtggccaagaaggagggctcctggtggcactgcaacagctgcagcctgaagaatgccagcacagccaagaagtgtgtgtcctgccagaacctgaaccccagcaacaaggagctggtgggcccccccctggccgagaccgtcttcacccccaagaccagcccagaaaatgtgcaggacagatttgccctggtgacccccaagaaggagggccactgggactgcagcatctgcctggtgagaaatgagcccaccgtgagccgctgcatcgcctgccagaacaccaagagcgccaacaagagcggcagcagctttgtgcaccaggccagcttcaagtttggccagggcgacctgcccaagcccatcaacagcgacttccgcagcgtcttcagcaccaaggagggccagtgggactgcagcgcctgcctggtgcagaatgaaggcagcagcaccaagtgtgccgcctgccagaaccccaggaagcagagcctgcctgccaccagcatccccaccccagccagcttcaagtttggcaccagcgagaccagcaagaccctgaagagcggctttgaggacatgtttgccaagaaggagggccagtgggactgcagcagctgcctggtgagaaatgaggccaatgccacccgctgtgtggcctgccagaacccagacaagcccagccccagcacctctgtgcctgccccagccagcttcaagtttggcaccagcgagaccagcaaggcccccaagagcggctttgagggcatgttcaccaagaaggagggccagtgggactgcagcgtgtgcctggtgagaaatgaggccagcgccaccaagtgcatcgcctgccagaaccctgggaagcagaaccagaccaccagcgctgtgtccaccccagccagcagcgagaccagcaaggcccccaagagcggctttgagggcatgttcaccaagaaggagggccagtgggactgcagcgtgtgcctggtgagaaatgaggccagcgccaccaagtgcatcgcctgccagaaccctgggaagcagaaccagaccaccagcgctgtgtccaccccagccagcagcgagaccagcaaggcccccaagagcggctttgagggcatgttcaccaagaaggagggccagtgggactgcagcgtgtgcctggtgagaaatgaggccagcgccaccaagtgcatcgcctgccagtgccccagcaagcagaaccagaccacagccatcagcaccccagccagcagcgagatcagcaaggcccccaagagcggctttgagggcatgttcatcaggaagggccagtgggactgcagcgtgtgctgcgtgcagaatgaaagcagcagcctgaagtgtgtggcctgtgatgccagcaagcccacccacaagcccatcgccgaggcccccagcgccttcaccctgggcagcgagatgaagctgcatgacagcagcggcagccaggtgggcaccggcttcaagagcaacttcagcgagaaggccagcaagtttggaaacacagagcagggcttcaagtttggacatgtggaccaggagaacagccccagcttcatgttccagggcagcagcaacacagagttcaagagcaccaaggagggcttcagcatccctgtgtctgcagatggcttcaagtttggcatcagcgagcccggcaaccaggagaagaagtctgagaagcccctggagaatggcaccggcttccaggcccaggacatcagcggccagaagaatggccggggcgtcatcttcggccagaccagcagcaccttcacctttgctgacctggccaagagcaccagcggggagggcttccagtttgggaagaaggaccccaacttcaagggcttcagcggggccggggagaagctgttcagcagccagtatggcaagatggccaacaaggccaacaccagcggggactttgagaaggatgatgatgcctacaagacagaggacagtgatgacatccactttgagcctgtggtgcagatgcctgagaaggtggagctggtgactggagaggaggatgagaaggtgctgtacagccagagggtgaagctgttccgctttgatgctgaggtgtcccagtggaaggagcggggcctgggcaacctgaagatcctgaagaatgaggtgaatggcaagctgaggatgctgatgaggcgggagcaggtgctgaaggtgtgtgccaaccactggatcaccaccaccatgaacctgaagcccctgagcggcagtgaccgggcctggatgtggctggccagtgacttcagtgatggagatgccaagctggagcagctggccgccaagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcactggagctgctggggccagtgacaccaccatcaagcccaaccctgagaacacaggccccaccctggagtgggacaactatgacctgagagaagatgccctggatgattctgtgagcagcagctctgtgcacgccagccccctggccagcagccctgtgaggaagaacctcttccgctttggagagagcaccaccggcttcaacttctccttcaagagcgccctgagccccagcaagagccctgccaagctgaaccagagcggcacctctgtgggcacagatgaggagagtgatgtgacccaggaggaggagagagatggccagtactttgagcctgtggtgcccctgcctgacctggtggaggtgagcagcggggaggagaatgagcaggtggtgttcagccaccgggccaagctgtaccgctatgacaaggatgtgggccagtggaaggagcggggcatcggggacatcaagatcctgcagaactatgacaacaagcaggtgcgcatcgtgatgagaagagaccaggtgctgaagctgtgtgccaaccaccgcatcaccccagacatgaccctgcagaacatgaagggcacagagcgggtgtggctgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcaccccccacgtgagccgcagcagcaccccccgggagagcccctgtgggaagattgctgtggccgtgctggaggagaccacccgggagaggacagatgtgatccagggagatgatgtggctgatgccaccagcgaggtggaggtgagcagcaccagcgagaccacccccaaggctgtggtgtccccacccaagtttgtgtttggcagcgagagcgtgaagagcatcttcagcagcgagaagagcaagccctttgcctttggaaacagcagcgccaccggcagcctgtttggcttctccttcaatgcccccctgaagagcaacaacagcgagaccagctctgtggcccagagcggcagcgagagcaaggtggagcccaagaagtgtgagctgagcaagaacagcgacatcgagcagagcagtgacagcaaggtgaagaacctgtttgccagcttccccacagaggagagcagcatcaactacaccttcaagaccccagagaaggccaaggagaagaagaagccagaggacagccccagtgatgatgatgtgctgattgtgtatgagctgacccccacagctgagcagaaggccctggccaccaagctgaagctgccccccaccttcttctgctacaagaacagaccagactatgtgtctgaggaggaggaggatgatgaagattttgaaacagctgtgaagaagctgaatggcaagctgtacctggatggcagcgagaagtgccggcccctggaggagaacacagctgacaatgagaaggagtgcatcatcgtgtgggagaagaagcccaccgtggaggagaaggccaaggctgacaccctgaagctgccccccaccttcttctgtggggtgtgcagcgacacagatgaagataatggaaatggagaggacttccagagcgagctgcagaaggtgcaggaggcccagaagagccagacagaggagatcaccagcaccacagattctgtgtacacaggaggaacagaggtgatggtgcccagcttctgcaagtctgaggagccagacagcatcaccaagagcatcagcagccccagcgtgagcagcgagaccatggacaagcctgtggacctgagcaccaggaaggagattgacacagacagcaccagccagggcgagagcaagatcgtgtcctttggcttcggcagcagcacaggcctgagctttgctgacctggccagcagcaacagcggggactttgccttcggcagcaaggacaagaacttccagtgggccaacacaggagctgctgtgtttggcacccagagcgtgggcacccagagcgctgggaaggtgggagaagatgaagatggcagtgatgaggaggtggtgcacaatgaagacatccactttgagcccatcgtgtccctgcctgaggtggaggtgaagtctggagaggaggatgaggagatcctcttcaaggagcgggccaagctgtaccgctgggacagagatgtgtcccagtggaaggagcggggcgtgggggacatcaagatcctgtggcacaccatgaagaactactaccgcatcctgatgaggcgggaccaggtgttcaaggtgtgtgccaaccacgtgatcaccaagaccatggagctgaagcccctgaatgtgagcaacaatgccctggtgtggacagccagtgactatgcagatggagaggccaaggtggagcagctggccgtgcgcttcaagaccaaggaggtggccgactgcttcaagaagacctttgaggagtgccagcagaacctgatgaagctgcagaagggccacgtgtccctggccgctgagctgagcaaggagaccaaccctgtggtgttctttgatgtgtgtgctgatggagagcccctgggccgcatcaccatggagctgttcagcaacatcgtgcccaggacagctgagaacttccgggccctgtgcacaggagagaagggcttcggcttcaagaacagcatcttccacagggtcatcccagactttgtgtgccagggcggggacatcaccaagcatgatggcactggaggccagagcatctatggagacaagtttgaagatgagaactttgatgtgaagcacactggacctggcctgctgtccatggccaaccagggccagaacaccaacaacagccagtttgtgatcaccctgaagaaggccgagcacctggacttcaagcacgtggtgtttggatttgtgaaggatggcatggacacagtgaagaagattgagagctttggcagccccaagggctctgtgtgccgccgcatcaccatcacagaatgtggccagatctag

SEQ ID NO: 167083 - DNA, 1500 bp, Artificial Sequence
  Description of Artificial Sequence: Synthetic coding sequence
atggctgacctggccaatgaggagaagccagccatcgcccctcctgtgtttgtgttccagaaggacaagggccagaagaggtctgctgggggcagcagccctgagggcggggaggacagcgacagagaagatggcaactactgcccccctgtgaagcgggagaggaccagcagcctgacccagtttcctcccagccagagcgaggagaggagcagcggcttccggctgaagccacccaccctcatccacggccaggcccccagcgctggcctgcccagccagaagcccaaggagcagcagaggtctgtgctgcggcctgctgtgctgcaggccccccagcccaaggccctgagccagacagtgcccagcagcggcaccaatggagtgtccctgcctgctgactgcaccggggctgtgcctgctgccagcccagacacagctgcctggaggagccccagcgaggccgcagatgaggtgtgtgccctggaggagaaggagccccagaagaatgaaagcagcaatgccagcgaggaggaggcctgtgagaagaaggaccctgccacccagcaggcctttgtgtttggccagaacctgcgggacagagtgaagctgatcaatgaatctgtggatgaggccgacatggagaatgccggccaccccagcgctgacacccccacagccaccaactacttcctgcagtacatcagcagcagcctggagaacagcaccaacagcgcagatgccagcagcaacaagtttgtgtttggccagaacatgtctgagcgggtgctgagcccccccaagctgaatgaggtgtccagtgatgccaacagagaaaatgctgctgctgagagcggcagcgagagcagcagccaggaggccaccccagagaaggagagcctggccgagagcgctgctgcctacaccaaggccacagccaggaagtgcctgctggagaaggtggaggtgatcactggagaggaggccgagagcaatgtgctgcagatgcagtgcaagctgtttgtgtttgacaagaccagccagagctgggtggagcggggccggggcctgctgcggctgaatgacatggccagcacagatgatggcaccctgcagagccggctggtgatgaggacccagggcagcctgcggctcatcctgaacaccaagctgtgggcccagatgcagattgacaaggccagcgagaagagcatccgcatcacagccatggacacagaggaccagggcgtgaaggtgttcctgatcagcgccagcagcaaggacaccggccagctgtatgctgccctgcaccaccgcatcctggccctgcggagccgggtggagcaggagcaggaggccaagatgcctgcccctgagcccggggccgcccccagcaatgaggaggatgacagtgatgatgatgatgtgctggcccccagcggggccacagctgctggagctggagatgaaggagatggccagaccaccggcagcacctag

SEQ ID NO: 167084 - DNA, 1194 bp, Artificial Sequence
  Description of Artificial Sequence: Synthetic coding sequence
gctgatgtgaccaaggccgagaagccagccatcgcccctcctgtgtttgtgttccagaaggacaagggccagaagaggtctgctgggggcagcagccctgagggcggagaagattctgaccgggaggatggcaactactgcccccctgtgaagcgggagaggaccagcagcctgacccagttcccccccagccagagcgaggagaggagcagcggcttccggctgaagccacccaccctcatccacggccaggcccccagcgctggcctgcccagccagaagcccaaggagcagcagaggtctgtgctgcggcctgctgtgctgcaggccccccagcccaaggccctgagccagacagtgcccagcagcggcaccaacggggtgtccctgcctgctgactgcacaggagctgtgcctgctgccagcccagacacagctgcctggaggagccccagcgaggccgcagatgaggtgtgtgccctggaggagaaggagccccagaagaatgaaagcagcaatgccagcgaggaggaggcctgtgagaagaaggaccctgccacccagcaggcctttgtgtttggccagaacctgcgggacagagtgaagctgatcaatgaatctgtggatgaagctgacatggagaatgccggccaccccagcgctgacacccccacagccaccaactacttcctgcagtacatcagcagcagcctggagaacagcaccaacagcgcagatgccagcagcaacaagtttgtgtttggccagaacatgtctgagcgggtgctgagcccccccaagctgaatgaggtgtccagtgatgccaaccgggagaatgctgctgctgagagcggcagcgagagcagcagccaggaggccaccccagagaaggagagcctggccgagagcgctgctgcctacaccaaggccacagccaggaagtgcctgctggagaaggtggaggtgatcaccggggaggaggccgagagcaatgtgctgcagatgcagtgcaagctgtttgtgtttgacaagaccagccagagctggtggctgctgcggcacccccaccccagccaccctgctgtgggcccctgcctgtgtggggagcagcctgccctgtgcccctgccccggcctgcccaactaccggcccggcaccccagcccagctgggcggcctgctggtgcgggtgtag

SEQ ID NO: 167085 - DNA, 1704 bp, Artificial Sequence
  Description of Artificial Sequence: Synthetic coding sequence
atggctgacctggccaatgaggagaagccagccatcgcccctcctgtgtttgtgttccagaaggacaagggccagaagagccctgctgagcagaagaacctgagtgacagcggggaggagcccagaggagaggccgaggccccccaccacggcaccggccaccctgagagcgctggggagcacgccctggagcccccagccccagctggggccagcgccagcaccccacctcctccagcccctgaggcccagctgccccccttcccccgggagctggccggccgctctgctgggggcagcagccctgagggcggggaggacagcgacagagaagatggcaactactgcccccctgtgaagcgggagaggaccagcagcctgacccagtttcctcccagccagagcgaggagaggagcagcggcttccggctgaagccacccaccctcatccacggccaggcccccagcgctggcctgcccagccagaagcccaaggagcagcagaggtctgtgctgcggcctgctgtgctgcaggccccccagcccaaggccctgagccagacagtgcccagcagcggcaccaatggagtgtccctgcctgctgactgcaccggggctgtgcctgctgccagcccagacacagctgcctggaggagccccagcgaggccgcagatgaggtgtgtgccctggaggagaaggagccccagaagaatgaaagcagcaatgccagcgaggaggaggcctgtgagaagaaggaccctgccacccagcaggcctttgtgtttggccagaacctgcgggacagagtgaagctgatcaatgaatctgtggatgaggccgacatggagaatgccggccaccccagcgctgacacccccacagccaccaactacttcctgcagtacatcagcagcagcctggagaacagcaccaacagcgcagatgccagcagcaacaagtttgtgtttggccagaacatgtctgagcgggtgctgagcccccccaagctgaatgaggtgtccagtgatgccaacagagaaaatgctgctgctgagagcggcagcgagagcagcagccaggaggccaccccagagaaggagagcctggccgagagcgctgctgcctacaccaaggccacagccaggaagtgcctgctggagaaggtggaggtgatcactggagaggaggccgagagcaatgtgctgcagatgcagtgcaagctgtttgtgtttgacaagaccagccagagctgggtggagcggggccggggcctgctgcggctgaatgacatggccagcacagatgatggcaccctgcagagccggctggtgatgaggacccagggcagcctgcggctcatcctgaacaccaagctgtgggcccagatgcagattgacaaggccagcgagaagagcatccgcatcacagccatggacacagaggaccagggcgtgaaggtgttcctgatcagcgccagcagcaaggacaccggccagctgtatgctgccctgcaccaccgcatcctggccctgcggagccgggtggagcaggagcaggaggccaagatgcctgcccctgagcccggggccgcccccagcaatgaggaggatgacagtgatgatgatgatgtgctggcccccagcggggccacagctgctggagctggagatgaaggagatggccagaccaccggcagcacctag

SEQ ID NO: 167086 - DNA, 1689 bp, Artificial Sequence
  Description of Artificial Sequence: Synthetic coding sequence
atggctgacctggccaatgaggagaagccagccatcgcccctcctgtgtttgtgttccagaaggacaagggccagaagagccctgctgagcagaagaacctgagtgacagcggggaggagcccagaggagaggccgaggccccccaccacggcaccggccaccctgagagcgctggggagcacgccctggagcccccagccccagctggggccagcgccagcaccccacctcctccagcccctgaggcccagctgccccccttcccccgggagctggccggccgctctgctgggggcagcagccctgagggcggggaggacagcgacagagaagatggcaactactgcccccctgtgaagcgggagaggaccagcagcctgacccagtttcctcccagccagagcgaggagaggagcagcggcttccggctgaagccacccaccctcatccacggccaggcccccagcgctggcctgcccagccagaagcccaaggagcagcagaggtctgtgctgcggcctgctgtgctgcaggccccccagcccaaggccctgagccagacagtgcccagcagcggcaccaatggagtgtccctgcctgctgactgcaccggggctgtgcctgctgccagcccagacacagctgcctggaggagccccagcgaggccgcagatgaggagaaggagccccagaagaatgaaagcagcaatgccagcgaggaggaggcctgtgagaagaaggaccctgccacccagcaggcctttgtgtttggccagaacctgcgggacagagtgaagctgatcaatgaatctgtggatgaagctgacatggagaatgccggccaccccagcgctgacacccccacagccaccaactacttcctgcagtacatcagcagcagcctggagaacagcaccaacagcgcagatgccagcagcaacaagtttgtgtttggccagaacatgtctgagcgggtgctgagcccccccaagctgaatgaggtgtccagtgatgccaaccgggagaatgctgctgctgagagcggcagcgagagcagcagccaggaggccaccccagagaaggagagcctggccgagagcgctgctgcctacaccaaggccacagccaggaagtgcctgctggagaaggtggaggtgatcaccggggaggaggccgagagcaatgtgctgcagatgcagtgcaagctgtttgtgtttgacaagaccagccagagctgggtggagcggggccggggcctgctgcggctgaatgacatggccagcacagatgatggcaccctgcagagccggctggtgatgaggacccagggcagcctgcggctcatcctgaacaccaagctgtgggcccagatgcagattgacaaggccagcgagaagagcatccgcatcacagccatggacacagaggaccagggcgtgaaggtgttcctgatcagcgccagcagcaaggacaccggccagctgtatgctgccctgcaccaccgcatcctggccctgcggagccgggtggagcaggagcaggaggccaagatgcctgcccctgagcctggagctgcccccagcaatgaagaagatgacagtgatgatgatgatgtgctggcccccagcggggccacagctgctggagctggagatgaaggagatggccagaccaccggcagcacctag

SEQ ID NO: 167087 - DNA, 1320 bp, Artificial Sequence
  Description of Artificial Sequence: Synthetic coding sequence
atggctgacctggccaatgaggaggagaggagcagcggcttccggctgaagccacccaccctcatccacggccaggcccccagcgctggcctgcccagccagaagcccaaggagcagcagaggtctgtgctgcggcctgctgtgctgcaggccccccagcccaaggccctgagccagacagtgcccagcagcggcaccaatggagtgtccctgcctgctgactgcaccggggctgtgcctgctgccagcccagacacagctgcctggaggagccccagcgaggccgcagatgaggtgtgtgccctggaggagaaggagccccagaagaatgaaagcagcaatgccagcgaggaggaggcctgtgagaagaaggaccctgccacccagcaggcctttgtgtttggccagaacctgcgggacagagtgaagctgatcaatgaatctgtggatgaggccgacatggagaatgccggccaccccagcgctgacacccccacagccaccaactacttcctgcagtacatcagcagcagcctggagaacagcaccaacagcgcagatgccagcagcaacaagtttgtgtttggccagaacatgtctgagcgggtgctgagcccccccaagctgaatgaggtgtccagtgatgccaacagagaaaatgctgctgctgagagcggcagcgagagcagcagccaggaggccaccccagagaaggagagcctggccgagagcgctgctgcctacaccaaggccacagccaggaagtgcctgctggagaaggtggaggtgatcactggagaggaggccgagagcaatgtgctgcagatgcagtgcaagctgtttgtgtttgacaagaccagccagagctgggtggagcggggccggggcctgctgcggctgaatgacatggccagcacagatgatggcaccctgcagagccggctggtgatgaggacccagggcagcctgcggctcatcctgaacaccaagctgtgggcccagatgcagattgacaaggccagcgagaagagcatccgcatcacagccatggacacagaggaccagggcgtgaaggtgttcctgatcagcgccagcagcaaggacaccggccagctgtatgctgccctgcaccaccgcatcctggccctgcggagccgggtggagcaggagcaggaggccaagatgcctgcccctgagcccggggccgcccccagcaatgaggaggatgacagtgatgatgatgatgtgctggcccccagcggggccacagctgctggagctggagatgaaggagatggccagaccaccggcagcacctag

SEQ ID NO: 167088 - DNA, 2190 bp, Artificial Sequence
  Description of Artificial Sequence: Synthetic coding sequence
atgagcggccagcccccacctcctccaccccagcagcagcagcagcagcagcagctgagccccccacctcctgctgccctggcccctgtgtctggagtggtgctgcctgcccccccagctgtgtctgctggcagcagccctgctggcagccctgggggcggggccggcggggagggcctgggcgctgctgctgctgccctgctgctgcaccccccacctcctcctcctccagccacagctgcccctcctcctcctcctcctcctcctcctcctccagccagcgctgctgccccagccagcggccccccagcccctcctggcctggccgccggccctggccctgctggaggagcccccaccccagccctggtggccggcagcagcgctgctgcccccttcccccatggagacagcgccctgaatgagcaggagaaggagctgcagaggcggctgaagaggctgtacccagctgtggatgagcaggagacccccctgcccaggtcctggagccccaaggacaagttctcctacatcggcctgagccagaacaacctgcgggtgcactacaagggccacggcaagacccccaaggatgctgcctctgtgcgggccacccaccccatcccagctgcctgtggcatctactactttgaggtgaagatcgtgtccaagggcagagatggctacatgggcatcggcctgagcgcccagggcgtgaacatgaaccggctgcccggctgggacaagcacagctatggctaccatggagatgatggccacagcttctgcagcagcggcaccggccagccctacggccccaccttcaccactggagatgtgattggctgctgcgtgaacctgatcaacaacacctgcttctacaccaagaatggccacagcctgggcatcgccttcacagacctgccccccaacctgtaccccaccgtgggcctgcagaccccaggagaggtggtggatgccaactttggccagcacccctttgtgtttgatattgaggactacatgagggagtggaggaccaagatccaggcccagattgaccgcttccccatcggggaccgggagggggagtggcagaccatgatccagaagatggtgtcctcctacctggtgcaccacggctactgtgccacagctgaggcctttgcccggagcacagaccagacagtgctggaggagctggccagcatcaagaaccggcagaggatccagaagctggtgctggccggccgcatgggagaggccatcgagaccacccagcagctgtaccccagcctgctggagaggaaccccaacctgctcttcaccctgaaggtgcggcagttcatcgagatggtgaatggaacagacagcgaggtgcgctgcctgggcggccgcagccccaagagccaggacagctaccctgtgagcccccggcccttcagcagccccagcatgagccccagccacggcatgaacatccacaacctggccagcggcaagggcagcacagcccacttcagcggctttgagagctgcagcaatggagtcatcagcaacaaggcccaccagagctactgccacagcaacaagcaccagagcagcaacctgaatgtgcctgagctgaacagcatcaacatgagccgcagccagcaggtgaacaacttcaccagcaatgatgtggacatggagacagaccactacagcaatggagtgggggagaccagcagcaatggcttcctgaatggcagcagcaagcatgaccacgagatggaggactgtgacacagagatggaggtggacagcagccagctgcggcggcagctgtgtggcggcagccaggccgccattgaaagaatgatccacttcggccgggagctgcaggccatgtctgagcagctgcggcgggactgtgggaagaacacagccaacaagaagatgctgaaggatgccttcagcctgctggcctacagcgacccctggaacagccctgtgggcaaccagctggaccccatccagcgggagcctgtgtgcagcgccctgaacagcgccatcctggagacccacaacctgcccaagcagccccccctggccctggccatgggccaggccacccagtgcctgggcctgatggcccggagcggcatcggcagctgtgcctttgccaccgtggaggactacctgcactag

SEQ ID NO: 167089 - DNA, 1176 bp, Artificial Sequence
  Description of Artificial Sequence: Synthetic coding sequence
atgagcggccagcccccacctcctccaccccagcagcagcagcagcagcagcagctgagccccccacctcctgctgccctggcccctgtgtctggagtggtgctgcctgcccccccagctgtgtctgctggcagcagccctgctggcagccctgggggcggggccggcggggagggcctgggcgctgctgctgctgccctgctgctgcaccccccacctcctcctcctccagccacagctgcccctcctcctcctcctcctcctcctcctcctccagccagcgctgctgccccagccagcggccccccagcccctcctggcctggccgccggccctggccctgctggaggagcccccaccccagccctggtggccggcagcagcgctgctgcccccttcccccatggagacagcgccctgaatgagcaggagaaggagctgcagaggcggctgaagaggctgtacccagctgtggatgagcaggagacccccctgcccaggtcctggagccccaaggacaagttctcctacatcggcctgagccagaacaacctgcgggtgcactacaagggccacggcaagacccccaaggatgctgcctctgtgcgggccacccaccccatcccagctgcctgtggcatctactactttgaggtgaagatcgtgtccaagggcagagatggctacatgggcatcggcctgagcgcccagggcgtgaacatgaaccggctgcccggctgggacaagcacagctatggctaccatggagatgatggccacagcttctgcagcagcggcaccggccagccctacggccccaccttcaccactggagatgtgattggctgctgcgtgaacctgatcaacaacacctgcttctacaccaagaatggccacagcctgggcatcgccttcacagacctgccccccctggactaccctgtgagcccccggcccttcagcagccccagcatgagccccagccacggcatgaacatccacaacctggccagcggcaagggcagcacagcccacttcagcggctttgagagctgcagcaatggagtcatcagcaacaaggcccaccagagctactgccacagcaacaagcaccagagcagcaatgaatgtaccaggaccaagcagtacaagtatgtgaagatcacagccagctag

SEQ ID NO: 167090 - DNA, 1503 bp, Artificial Sequence
  Description of Artificial Sequence: Synthetic coding sequence
atgggcatcggcctgagcgcccagggcgtgaacatgaaccggctgcccggctgggacaagcacagctatggctaccatggagatgatggccacagcttctgcagcagcggcaccggccagccctacggccccaccttcaccactggagatgtgattggctgctgcgtgaacctgatcaacaacacctgcttctacaccaagaatggccacagcctgggcatcgccttcacagacctgccccccaacctgtaccccaccgtgggcctgcagaccccaggagaggtggtggatgccaactttggccagcacccctttgtgtttgatattgaggactacatgagggagtggaggaccaagatccaggcccagattgaccgcttccccatcggggaccgggagggggagtggcagaccatgatccagaagatggtgagcagctacctggtgcaccacggctactgtgccacagctgaggcctttgcccggagcacagaccagacagtgctggaggagctggccagcatcaagaaccggcagaggatccagaagctggtgctggccggccgcatgggagaggccatcgagaccacccagcagctgtaccccagcctgctggagaggaaccccaacctgctcttcaccctgaaggtgcggcagttcatcgagatggtgaatggaacagattctgaggtgcgctgcctgggcggccgcagccccaagagccaggacagctaccctgtgagcccccggcccttcagcagccccagcatgagccccagccacggcatgaacatccacaacctggccagcggcaagggcagcacagcccacttcagcggctttgagagctgcagcaatggagtcatcagcaacaaggcccaccagagctactgccacagcaacaagcaccagagcagcaacctgaatgtgcctgagctgaacagcatcaacatgagccgcagccagcaggtgaacaacttcaccagcaatgatgtggacatggagacagaccactacagcaatggagtgggggagaccagcagcaatggcttcctgaatggcagcagcaagcatgaccacgagatggaggactgtgacacagagatggaggtggacagcagccagctgcggcggcagctgtgtggcggcagccaggccgccatcgagaggatgatccacttcggccgggagctgcaggccatgtctgagcagctgcggcgggactgtgggaagaacacagccaacaagaagatgctgaaggatgccttcagcctgctggcctacagcgacccctggaacagccctgtgggcaaccagctggaccccatccagcgggagcctgtgtgcagcgccctgaacagcgccatcctggagacccacaacctgcccaagcagccccccctggccctggccatgggccaggccacccagtgcctgggcctgatggcccggtctggaattggcagctgtgcctttgccaccgtggaggactacctgcactag

SEQ ID NO: 167091 - DNA, 387 bp, Artificial Sequence
  Description of Artificial Sequence: Synthetic coding sequence
atgtttgatgtgaccagccgggtgacctacaagaatgtgcccaactggcaccgggacctggtgcgggtgtgtgagaacatccccatcgtgctgtgtggcaacaaggtggacatcaaggacaggaaggtgaaggccaagagcatcgtgttccacaggaagaagaacctgcagtactatgacatcagcgccaagagcaactacaactttgagaagcccttcctgtggctggccaggaagctgattggagaccccaacctggagtttgtggccatgcctgccctggcccctcctgaggtggtgatggaccctgccctggccgcccagtatgaacatgacctggaggtggcccagaccacagccctgcctgatgaagatgatgacctgtag

SEQ ID NO: 167092 - DNA, 702 bp, Artificial Sequence
  Description of Artificial Sequence: Synthetic coding sequence
atggccgcccagggcgagccccaggtgcagttcaagctggtgctggtgggagatggcggcaccgggaagaccacctttgtgaagaggcacctgaccggggagtttgagaagaagtatgtggccaccctgggcgtggaggtgcaccccctggtgttccacaccaacagaggccccatcaagttcaacgtgtgggacacagctggccaggagaagtttggaggcctgagagatggctactacatccaggagatgggcatccaccacgtggcccacgccggcctggagctgatgagcagcgcccagtgtgccatcatcatgtttgatgtgaccagccgggtgacctacaagaatgtgcccaactggcaccgggacctggtgcgggtgtgtgagaacatccccatcgtgctgtgtggcaacaaggtggacatcaaggacaggaaggtgaaggccaagagcatcgtgttccacaggaagaagaacctgcagtactatgacatcagcgccaagagcaactacaactttgagaagcccttcctgtggctggccaggaagctgattggagaccccaacctggagtttgtggccatgcctgccctggcccctcctgaggtggtgatggaccctgccctggccgcccagtatgaacatgacctggaggtggcccagaccacagccctgcctgatgaagatgatgacctgtag

SEQ ID NO: 167093 - DNA, 651 bp, Artificial Sequence
  Description of Artificial Sequence: Synthetic coding sequence
atggccgcccagggcgagccccaggtgcagttcaagctggtgctggtgggagatggcggcaccgggaagaccacctttgtgaagaggcacctgaccggggagtttgagaagaagtatgtggccaccctgggcgtggaggtgcaccccctggtgttccacaccaacagaggccccatcaagttcaacgtgtgggacacagctggccaggagaagtttggaggcctgagagatggctactacatccaggcccagtgtgccatcatcatgtttgatgtgaccagccgggtgacctacaagaatgtgcccaactggcaccgggacctggtgcgggtgtgtgagaacatccccatcgtgctgtgtggcaacaaggtggacatcaaggacaggaaggtgaaggccaagagcatcgtgttccacaggaagaagaacctgcagtactatgacatcagcgccaagagcaactacaactttgagaagcccttcctgtggctggccaggaagctgattggagaccccaacctggagtttgtggccatgcctgccctggcccctcctgaggtggtgatggaccctgccctggccgcccagtatgaacatgacctggaggtggcccagaccacagccctgcctgatgaagatgatgacctgtag

SEQ ID NO: 167094 - DNA, 705 bp, Artificial Sequence
  Description of Artificial Sequence: Synthetic coding sequence
agaagaagaaggctgcggctgcggcggctgaactgtgccagcgccatcttccctgcctctgtgggccgggcccggcggcgcttctggaagctggtgctggtgggagatggcggcaccgggaagaccacctttgtgaagaggcacctgaccggggagtttgagaagaagtatgtggccaccctgggcgtggaggtgcaccccctggtgttccacaccaacagaggccccatcaagttcaacgtgtgggacacagctggccaggagaagtttggaggcctgagagatggctactacatccaggcccagtgtgccatcatcatgtttgatgtgaccagccgggtgacctacaagaatgtgcccaactggcaccgggacctggtgcgggtgtgtgagaacatccccatcgtgctgtgtggcaacaaggtggacatcaaggacaggaaggtgaaggccaagagcatcgtgttccacaggaagaagaacctgcagtactatgacatcagcgccaagagcaactacaactttgagaagcccttcctgtggctggccaggaagctgattggagaccccaacctggagtttgtggccatgcctgccctggcccctcctgaggtggtgatggaccctgccctggccgcccagtatgaacatgacctggaggtggcccagaccacagccctgcctgatgaagatgatgacctgtag

SEQ ID NO: 167095 - DNA, 387 bp, Artificial Sequence; identical to SEQ ID NO: 167091
  Description of Artificial Sequence: Synthetic coding sequence

SEQ ID NO: 167096 - DNA, 651 bp, Artificial Sequence; identical to SEQ ID NO: 167093
  Description of Artificial Sequence: Synthetic coding sequence

SEQ ID NO: 167097 - DNA, 5271 bp, Artificial Sequence
  Description of Artificial Sequence: Synthetic coding sequence
atgaggaggagcaaggcctatggagagcgctacctggcctctgtgcagggcagcgcccccagccctgggaagaagctgcggggcttctactttgccaagctgtactatgaggccaaggagtatgacctggccaagaagtatgtgtgcacctacctgtctgtgcaggagcgggacccccgggcccaccgcttcctgggcctgctgtatgagctggaggagaacacagagaaggctgtggagtgctacagaagaagcctggagctgaaccccccccagaaggacctggtgctgaagattgctgagctgctgtgcaagaatgatgtgacagatggccgggccaagtactgggtggagcgggccgccaagctgtttcctggcagccctgccatctacaagctgaaggagcacctgctggactgtgaaggagaagatggctggaacaagctgtttgactggatccagagcgagctgtatgtgcggccagatgatgtgcacatgaacatccggctggtggagctgtaccgcagcaacaagaggctgaaggatgctgtggcccgctgccacgaggccgagaggaacatcgccctgcggagcagcctggagtggaacagctgtgtggtgcagaccctgaaggagtacctggagagcctgcagtgcctggagagtgacaagagtgactggagggccaccaacacagacctgctgctggcctatgccaacctgatgctgctgaccctgagcaccagagatgtgcaggagagccgggagctgctggagagctttgattctgccctgcagagcgccaagagcagcctgggcggcaatgatgagctgagcgccaccttcctggagatgaagggccacttctacatgcatgctggcagcctgctgctgaagatgggccagcacggcaacaacgtgcagtggcaggccctgtctgagctggccgccctgtgctacgtgattgccttccaggtgccccggcccaagatcaagctgatcaagggggaggccggccagaacctgctggagatgatggcctgtgaccggctgagccagagcggccacatgctgctgaacctgagccggggcaagcaggacttcctgaaggaggtggtggagacctttgccaacaagagcggccagagcgtgctgtacaatgccctcttcagcagccagagcagcaaggacaccagcttcctgggcagtgatgacatcggcaacattgatgtgcaggagcctgagctggaggacctggcccgctatgatgtgggcgccatccaggcccacaacggcagcctgcagcacctgacctggctgggcctgcagtggaacagcctgcctgccctgcccggcatcaggaagtggctgaagcagctgttccaccacctgccccaggagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccctgcctgtgtgcaagaggctgtgcacagagcggcagaagtcctggtgggatgctgtgtgcaccctcatccacaggaaggctgtgcccggcaacagcgctgagctgcggctggtggtgcagcacgagatcaacaccctgcgggcccaggagaagcacggcctgcagcctgccctgctggtgcactgggccaagtgcctgcagaagatgggccggggcctgaacagcagctatgaccagcaggagtacatcggccgctctgtgcactactggaagaaggtgctgcccctgctgaagatcatcaagaagaacagcatccctgagcccatcgaccccctcttcaagcacttccacagcgtggacatccaggccagcgagatcgtggagtatgaagaagatgcccacatcacctttgccatcctggatgctgtgcacggcaacattgaagatgctgtgacagcctttgagagcatcaagtctgtggtgtcctactggaacctggccctgatcttccacaggaaggcagaagatattgaaaatgatgctgtgtttcctgaggagcaggaggagtgcaagaactacctgaggaagacccgggactacctgatcaagatcattgatgacagcgacagcaacctgtctgtggtgaagaagctgcctgtgcccctggagagcgtgaaggagatgctgaagtctgtgatgcaggagctggaggactacagcgagggcggccccctgtacaagaatggcagcctgagaaatgctgacagcgagatcaagcacagcacccccagccccaccaagtacagcctgagccccagcaagagctacaagtacagccccaagaccccaccccgctgggccgaggaccagaacagcctgaggaagatgatctgccaggaggtgaaggccatcaccaagctgaacagcagcaagagcgccagccgccaccgctggcccacagaaaattatggcccagattctgtgcctgatggctaccagggcagccagaccttccatggagcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcattgctgtgtctgcagatggcttcaagtttggcatcagcgagcccggcaaccaggagaagaagtctgagaagcccctggagaatgacaccggcttccaggcccaggacatcagcggccagaagaatggccggggcgtcatcttcggccagaccagcagcaccttcacctttgctgatgtggccaagagcaccagcggggagggcttccagtttgggaagaaggaccccaacttcaagggcttctctggagctggggagaagctgttcagcagccagtgtgggaagatggccaacaaggccaacaccagcggggactttgagaaggatgatgatgcctgcaagacagaagattctgatgacatccactttgagcctgtggtgcagatgcctgagaaggtggagctggtgactggagaggagggggagaaggtgctgtacagccagggcgtgaagctgttccgctttgatgctgagatcagccagtggaaggagcggggcctgggcaacctgaagatcctgaagaatgaggtgaatggcaagcccaggatgctgatgagaagagaccaggtgctgaaggtgtgtgccaaccactggatcaccaccaccatgaacctgaagcccctgagcggcagtgaccgggcctggatgtggctggccagtgacttcagtgatggagatgccaagctggagcggctggccgcccagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcaccggggctgctggggccagtgacaccaccatcaagcccaacccagaaaatacaggccccaccctggagtgggacaactatgacctgcgggaggatgccctggatgacaacgtgagcagcagctctgtgcatgacagccccctggccagcagccctgtgaggaagaacatcttccgctttgatgagagcaccaccggcttcaacttctccttcaagagcgccctgagcctgagcaagagccctgccaagctgaaccagagcggcacctctgtgggcacagatgaggagagtgatgtgacccaggaggaggagagagatggccagtactttgagcctgtggtgcccctgcctgacctggtggaggtgtcctctggagaggagaatgagcaggtggtgttcagccacagagctgagctgtaccgctatgacaaggatgtgggccagtggaaggagcggggcattggagacatcaagatcctgcagaactatgacaacaagcaggtgagaattgtgatgaggcgggaccaggtgctgaagctgtgtgccaaccaccgcatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcacccctcatgtgagccgcagcagcaccccccgggagagcccctgtgggaagattgctgtggccgtgctggaggagaccacccgggagaggacagatgtgatccagggagatgatgtggctgatgctgccagcgaggtggaggtgagcagcaccagcgagaccaccaccaaggctgtggtgagcccccccaagtttgtgtttggaagtgaatctgtgaagaggatcttcagcagcgagaagagcaacccctttgccttcggcaacagcagcgccaccggcagcctgtttggcttctccttcaatgcccccctgaagagcaatgattctgagaccagctctgtggcccagagcggcagcgagagcaaggtggagcccaagaagtgtgagctgagcaagaacagcgacatcgagcagagcagtgacagcaaggtgaagaacctgagcgccagcttccccatggaggagagcagcatcaactacaccttcaagaccccagagaaggagccccccctgtggcacgccgagttcaccaaggaggagctggtgcagaagctgagcagcaccaccaagtctgctgaccagctgaatggcctgctgcgggagacagaggccaccagcgctgtgctgatggagcagatcaagctgctgaagtctgagatccggcggctggagaggaaccaggaggagagcgctgccaacgtggagcacctgaagaatgtgctgctgcagttcatcttcctgaagccaggcagcgagcgggagagcctgctgcccgtcatcaacaccatgctgcagctgagccctgaggagaagggcaagctggccgctgtggcccagggcctgcaggagaccagcatccccaagaagaagtag

SEQ ID NO: 167098 - DNA, 5247 bp, Artificial Sequence
  Description of Artificial Sequence: Synthetic coding sequence
atgaatgtgatgggcttcaacacagaccggctggcctggaccaggaacaagctgcggggcttctactttgccaagctgtactatgaggccaaggagtatgacctggccaagaagtatgtgtgcacctacctgtctgtgcaggagcgggacccccgggcccaccgcttcctgggcctgctgtatgagctggaggagaacacagagaaggctgtggagtgctacagaagaagcctggagctgaaccccccccagaaggacctggtgctgaagattgctgagctgctgtgcaagaatgatgtgacagatggccgggccaagtactgggtggagcgggccgccaagctgtttcctggcagccctgccatctacaagctgaaggagcacctgctggactgtgaaggagaagatggctggaacaagctgtttgactggatccagagcgagctgtatgtgcggccagatgatgtgcacatgaacatccggctggtggagctgtaccgcagcaacaagaggctgaaggatgctgtggcccgctgccacgaggccgagaggaacatcgccctgcggagcagcctggagtggaacagctgtgtggtgcagaccctgaaggagtacctggagagcctgcagtgcctggagagtgacaagagtgactggagggccaccaacacagacctgctgctggcctatgccaacctgatgctgctgaccctgagcaccagagatgtgcaggagagccgggagctgctggagagctttgattctgccctgcagagcgccaagagcagcctgggcggcaatgatgagctgagcgccaccttcctggagatgaagggccacttctacatgcatgctggcagcctgctgctgaagatgggccagcacggcaacaacgtgcagtggcaggccctgtctgagctggccgccctgtgctacgtgattgccttccaggtgccccggcccaagatcaagctgatcaagggggaggccggccagaacctgctggagatgatggcctgtgaccggctgagccagagcggccacatgctgctgaacctgagccggggcaagcaggacttcctgaaggaggtggtggagacctttgccaacaagagcggccagagcgtgctgtacaatgccctcttcagcagccagagcagcaaggacaccagcttcctgggcagtgatgacatcggcaacattgatgtgcaggagcctgagctggaggacctggcccgctatgatgtgggcgccatccaggcccacaacggcagcctgcagcacctgacctggctgggcctgcagtggaacagcctgcctgccctgcccggcatcaggaagtggctgaagcagctgttccaccacctgccccaggagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccctgcctgtgtgcaagaggctgtgcacagagcggcagaagtcctggtgggatgctgtgtgcaccctcatccacaggaaggctgtgcccggcaacagcgctgagctgcggctggtggtgcagcacgagatcaacaccctgcgggcccaggagaagcacggcctgcagcctgccctgctggtgcactgggccaagtgcctgcagaagatgggccggggcctgaacagcagctatgaccagcaggagtacatcggccgctctgtgcactactggaagaaggtgctgcccctgctgaagatcatcaagaagaacagcatccctgagcccatcgaccccctcttcaagcacttccacagcgtggacatccaggccagcgagatcgtggagtatgaagaagatgcccacatcacctttgccatcctggatgctgtgcacggcaacattgaagatgctgtgacagcctttgagagcatcaagtctgtggtgtcctactggaacctggccctgatcttccacaggaaggcagaagatattgaaaatgatgctgtgtttcctgaggagcaggaggagtgcaagaactacctgaggaagacccgggactacctgatcaagatcattgatgacagcgacagcaacctgtctgtggtgaagaagctgcctgtgcccctggagagcgtgaaggagatgctgaagtctgtgatgcaggagctggaggactacagcgagggcggccccctgtacaagaatggcagcctgagaaatgctgacagcgagatcaagcacagcacccccagccccaccaagtacagcctgagccccagcaagagctacaagtacagccccaagaccccaccccgctgggccgaggaccagaacagcctgaggaagatgatctgccaggaggtgaaggccatcaccaagctgaacagcagcaagagcgccagccgccaccgctggcccacagaaaattatggcccagattctgtgcctgatggctaccagggcagccagaccttccatggagcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcattgctgtgtctgcagatggcttcaagtttggcatcagcgagcccggcaaccaggagaagaagtctgagaagcccctggagaatgacaccggcttccaggcccaggacatcagcggccagaagaatggccggggcgtcatcttcggccagaccagcagcaccttcacctttgctgatgtggccaagagcaccagcggggagggcttccagtttgggaagaaggaccccaacttcaagggcttctctggagctggggagaagctgttcagcagccagtgtgggaagatggccaacaaggccaacaccagcggggactttgagaaggatgatgatgcctgcaagacagaagattctgatgacatccactttgagcctgtggtgcagatgcctgagaaggtggagctggtgactggagaggagggggagaaggtgctgtacagccagggcgtgaagctgttccgctttgatgctgagatcagccagtggaaggagcggggcctgggcaacctgaagatcctgaagaatgaggtgaatggcaagcccaggatgctgatgagaagagaccaggtgctgaaggtgtgtgccaaccactggatcaccaccaccatgaacctgaagcccctgagcggcagtgaccgggcctggatgtggctggccagtgacttcagtgatggagatgccaagctggagcggctggccgcccagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcaccggggctgctggggccagtgacaccaccatcaagcccaacccagaaaatacaggccccaccctggagtgggacaactatgacctgcgggaggatgccctggatgacaacgtgagcagcagctctgtgcatgacagccccctggccagcagccctgtgaggaagaacatcttccgctttgatgagagcaccaccggcttcaacttctccttcaagagcgccctgagcctgagcaagagccctgccaagctgaaccagagcggcacctctgtgggcacagatgaggagagtgatgtgacccaggaggaggagagagatggccagtactttgagcctgtggtgcccctgcctgacctggtggaggtgtcctctggagaggagaatgagcaggtggtgttcagccacagagctgagctgtaccgctatgacaaggatgtgggccagtggaaggagcggggcattggagacatcaagatcctgcagaactatgacaacaagcaggtgagaattgtgatgaggcgggaccaggtgctgaagctgtgtgccaaccaccgcatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcacccctcatgtgagccgcagcagcaccccccgggagagcccctgtgggaagattgctgtggccgtgctggaggagaccacccgggagaggacagatgtgatccagggagatgatgtggctgatgctgccagcgaggtggaggtgagcagcaccagcgagaccaccaccaaggctgtggtgagcccccccaagtttgtgtttggaagtgaatctgtgaagaggatcttcagcagcgagaagagcaacccctttgccttcggcaacagcagcgccaccggcagcctgtttggcttctccttcaatgcccccctgaagagcaatgattctgagaccagctctgtggcccagagcggcagcgagagcaaggtggagcccaagaagtgtgagctgagcaagaacagcgacatcgagcagagcagtgacagcaaggtgaagaacctgagcgccagcttccccatggaggagagcagcatcaactacaccttcaagaccccagagaaggagccccccctgtggcacgccgagttcaccaaggaggagctggtgcagaagctgagcagcaccaccaagtctgctgaccagctgaatggcctgctgcgggagacagaggccaccagcgctgtgctgatggagcagatcaagctgctgaagtctgagatccggcggctggagaggaaccaggaggagagcgctgccaacgtggagcacctgaagaatgtgctgctgcagttcatcttcctgaagccaggcagcgagcgggagagcctgctgcccgtcatcaacaccatgctgcagctgagccctgaggagaagggcaagctggccgctgtggcccagggcctgcaggagaccagcatccccaagaagaagtag

SEQ ID NO: 167099 - DNA, 1935 bp, Artificial Sequence
  Description of Artificial Sequence: Synthetic coding sequence
atgctgatgaggcgggaccaggtgctgaaggtgtgtgccaaccactggatcaccaccaccatgaacctgaagcccctgagcggcagtgaccgggcctggatgtggctggccagtgacttcagtgatggagatgccaagctggagcggctggccgcccagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcactggagctgctggggccagtgacaccaccatcaagcccaaccctgagaacacaggccccaccctggagtgggacaactatgacctgagagaagatgccctggatgacaacgtgagcagcagctctgtgcatgacagccccctggccagcagccctgtgaggaagaacatcttccgctttgatgagagcaccaccggcttcaacttctccttcaagagcgccctgagcctgagcaagagccctgccaagctgaaccagagcggcacctctgtgggcacagatgaggagagtgatgtgacccaggaggaggagagagatggccagtactttgagcctgtggtgcccctgcctgacctggtggaggtgagcagcggggaggagaatgagcaggtggtgttcagccacagagctgagctgtaccgctatgacaaggatgtgggccagtggaaggagcggggcatcggggacatcaagatcctgcagaactatgacaacaagcaggtgcgcatcgtgatgagaagagaccaggtgctgaagctgtgtgccaaccaccgcatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcaccccccacgtgagccgcagcagcaccccccgggagagcccctgtgggaagattgctgtggccgtgctggaggagaccacccgggagaggacagatgtgatccagggagatgatgtggctgatgctgccagcgaggtggaggtgagcagcaccagcgagaccaccaccaaggctgtggtgtccccacccaagtttgtgtttggcagcgagagcgtgaagaggatcttcagcagcgagaagagcaacccctttgcctttggaaacagcagcgccaccggcagcctgtttggcttctccttcaatgcccccctgaagagcaatgacagcgagaccagctctgtggcccagagcggcagcgagagcaaggtggagcccaagaagtgtgagctgagcaagaacagcgacatcgagcagagcagtgacagcaaggtgaagaacctgagcgccagcttccccatggaggagagcagcatcaactacaccttcaagaccccagagaaggagccccccctgtggcatgctgagttcaccaaggaggagctggtgcagaagctgagcagcaccaccaagtctgctgaccagctgaatggcctgctgcgggagacagaggccaccagcgctgtgctgatggagcagatcaagctgctgaagtctgagatccggcggctggagaggaaccaggaggagagcgctgccaacgtggagcacctgaagaatgtgctgctgcagttcatcttcctgaagccaggcagcgagcgggagcccagcagctgctacaagtatgatgtggccgcccagccctag

SEQ ID NO: 167100 - DNA, 5247 bp, Artificial Sequence; identical to SEQ ID NO: 167098
  Description of Artificial Sequence: Synthetic coding sequence

SEQ ID NO: 167101 - DNA, 3042 bp, Artificial Sequence
  Description of Artificial Sequence: Synthetic coding sequence
atgctgaagtctgtgatgcaggagctggaggactacagcgagggcggccccctgtacaagaatggcagcctgagaaatgctgacagcgagatcaagcacagcacccccagccccaccaagtacagcctgagccccagcaagagctacaagtacagccccaagaccccaccccgctgggccgaggaccagaacagcctgaggaagatgatctgccaggaggtgaaggccatcaccaagctgaacagcagcaagagcgccagccgccaccgctggcccacagagaactacggccctgacagcgtgcctgatggctaccagggcagccagaccttccacggggcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcattgctgtgtctgcagatggcttcaagtttggcatcagcgagcccggcaaccaggagaagaagtctgagaagcccctggagaatgacaccggcttccaggcccaggacatcagcggccagaagaatggccggggcgtcatcttcggccagaccagcagcaccttcacctttgctgatgtggccaagagcaccagcggggagggcttccagtttgggaagaaggaccccaacttcaagggcttcagcggggccggggagaagctgttcagcagccagtgtgggaagatggccaacaaggccaacaccagcggggactttgagaaggatgatgatgcctgcaagacagaggacagtgatgacatccactttgagcctgtggtgcagatgcctgagaaggtggagctggtgactggagaggagggggagaaggtgctgtacagccagggcgtgaagctgttccgctttgatgctgagatcagccagtggaaggagcggggcctgggcaacctgaagatcctgaagaatgaggtgaatggcaagcccaggatgctgatgaggcgggaccaggtgctgaaggtgtgtgccaaccactggatcaccaccaccatgaacctgaagcccctgagcggcagtgaccgggcctggatgtggctggccagtgacttcagtgatggagatgccaagctggagcggctggccgcccagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcactggagctgctggggccagtgacaccaccatcaagcccaaccctgagaacacaggccccaccctggagtgggacaactatgacctgagagaagatgccctggatgacaacgtgagcagcagctctgtgcatgacagccccctggccagcagccctgtgaggaagaacatcttccgctttgatgagagcaccaccggcttcaacttctccttcaagagcgccctgagcctgagcaagagccctgccaagctgaaccagagcggcacctctgtgggcacagatgaggagagtgatgtgacccaggaggaggagagagatggccagtactttgagcctgtggtgcccctgcctgacctggtggaggtgagcagcggggaggagaatgagcaggtggtgttcagccacatggccgagctgtaccgctatgacaaggatgtgggccagtggaaggagcggggcatcggggacatcaagatcctgcagaactatgacaacaagcaggtgcgcatcgtgatgagaagagaccaggtgctgaagctgtgtgccaaccaccgcatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcaccccccacgtgagccgcagcagcaccccccgggagagcccctgtgggaagattgctgtggccgtgctggaggagaccacccgggagaggacagatgtgatccagggagatgatgtggctgatgctgccagcgaggtggaggtgagcagcaccagcgagaccaccaccaaggctgtggtgtccccacccaagtttgtgtttggcagcgagagcgtgaagaggatcttcagcagcgagaagagcaacccctttgcctttggaaacagcagcgccaccggcagcctgtttggcttctccttcaatgcccccctgaagagcaatgacagcgagaccagctctgtggcccagagcggcagcgagagcaaggtggagcccaagaagtgtgagctgagcaagaacagcgacatcgagcagagcagtgacagcaaggtgaagaacctgagcgccagcttccccatggaggagagcagcatcaactacaccttcaagaccccagagaaggagccccccctgtggcatgctgagttcaccaaggaggagctggtgcagaagctgagcagcaccaccaagtctgctgaccagctgaatggcctgctgcgggagacagaggccaccagcgctgtgctgatggagcagatcaagctgctgaagtctgagatccggcggctggagaggaaccaggaggagagcgctgccaacgtggagcacctgaagaatgtgctgctgcagttcatcttcctgaagccaggcagcgagcgggagagcctgctgcctgtgatcaacaccatgctgcagctgagccctgaggagaagggcaagctggccgctgtggcccagggcctgcaggagaccagcatccccaagaagaagtag

SEQ ID NO: 167102 - DNA, 5271 bp, Artificial Sequence
  Description of Artificial Sequence: Synthetic coding sequence
atgaggaggagcaaggcctatggagagcgctacctggcctctgtgcagggcagcgcccccagccctgggaagaagctgcggggcttctactttgccaagctgtactatgaggccaaggagtatgacctggccaagaagtatgtgtgcacctacctgtctgtgcaggagcgggacccccgggcccaccgcttcctgggcctgctgtatgagctggaggagaacacagagaaggctgtggagtgctacagaagaagcctggagctgaaccccccccagaaggacctggtgctgaagattgctgagctgctgtgcaagaatgatgtgacagatggccgggccaagtactgggtggagcgggccgccaagctgtttcctggcagccctgccatctacaagctgaaggagcacctgctggactgtgaaggagaagatggctggaacaagctgtttgactggatccagagcgagctgtatgtgcggccagatgatgtgcacatgaacatccggctggtggagctgtaccgcagcaacaagaggctgaaggatgctgtggcccgctgccacgaggccgagaggaacatcgccctgcggagcagcctggagtggaacagctgtgtggtgcagaccctgaaggagtacctggagagcctgcagtgcctggagagtgacaagagtgactggagggccaccaacacagacctgctgctggcctatgccaacctgatgctgctgaccctgagcaccagagatgtgcaggagagccgggagctgctggagagctttgattctgccctgcagagcgccaagagcagcctgggcggcaatgatgagctgagcgccaccttcctggagatgaagggccacttctacatgcatgctggcagcctgctgctgaagatgggccagcacggcaacaacgtgcagtggcaggccctgtctgagctggccgccctgtgctacgtgattgccttccaggtgccccggcccaagatcaagctgatcaagggggaggccggccagaacctgctggagatgatggcctgtgaccggctgagccagagcggccacatgctgctgaacctgagccggggcaagcaggacttcctgaaggaggtggtggagacctttgccaacaagagcggccagagcgtgctgtacaatgccctcttcagcagccagagcagcaaggacaccagcttcctgggcagtgatgacatcggcaacattgatgtgcaggagcctgagctggaggacctggcccgctatgatgtgggcgccatccaggcccacaacggcagcctgcagcacctgacctggctgggcctgcagtggaacagcctgcctgccctgcccggcatcaggaagtggctgaagcagctgttccaccacctgccccaggagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccctgcctgtgtgcaagaggctgtgcacagagcggcagaagtcctggtgggatgctgtgtgcaccctcatccacaggaaggctgtgcccggcaacagcgctgagctgcggctggtggtgcagcacgagatcaacaccctgcgggcccaggagaagcacggcctgcagcctgccctgctggtgcactgggccaagtgcctgcagaagatgggccggggcctgaacagcagctatgaccagcaggagtacatcggccgctctgtgcactactggaagaaggtgctgcccctgctgaagatcatcaagaagaacagcatccctgagcccatcgaccccctcttcaagcacttccacagcgtggacatccaggccagcgagatcgtggagtatgaagaagatgcccacatcacctttgccatcctggatgctgtgcacggcaacattgaagatgctgtgacagcctttgagagcatcaagtctgtggtgtcctactggaacctggccctgatcttccacaggaaggcagaagatattgaaaatgatgctgtgtttcctgaggagcaggaggagtgcaagaactacctgaggaagacccgggactacctgatcaagatcattgatgacagcgacagcaacctgtctgtggtgaagaagctgcctgtgcccctggagagcgtgaaggagatgctgaagtctgtgatgcaggagctggaggactacagcgagggcggccccctgtacaagaatggcagcctgagaaatgctgacagcgagatcaagcacagcacccccagccccaccaagtacagcctgagccccagcaagagctacaagtacagccccaagaccccaccccgctgggccgaggaccagaacagcctgaggaagatgatctgccaggaggtgaaggccatcaccaagctgaacagcagcaagagcgccagccgccaccgctggcccacagaaaattatggcccagattctgtgcctgatggctaccagggcagccagaccttccatggagcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcattgctgtgtctgcagatggcttcaagtttggcatcagcgagcccggcaaccaggagaagaagtctgagaagcccctggagaatgacaccggcttccaggcccaggacatcagcggccagaagaatggccggggcgtcatcttcggccagaccagcagcaccttcacctttgctgatgtggccaagagcaccagcggggagggcttccagtttgggaagaaggaccccaacttcaagggcttctctggagctggggagaagctgttcagcagccagtgtgggaagatggccaacaaggccaacaccagcggggactttgagaaggatgatgatgcctgcaagacagaagattctgatgacatccactttgagcctgtggtgcagatgcctgagaaggtggagctggtgactggagaggagggggagaaggtgctgtacagccagggcgtgaagctgttccgctttgatgctgagatcagccagtggaaggagcggggcctgggcaacctgaagatcctgaagaatgaggtgaatggcaagcccaggatgctgatgagaagagaccaggtgctgaaggtgtgtgccaaccactggatcaccaccaccatgaacctgaagcccctgagcggcagtgaccgggcctggatgtggctggccagtgacttcagtgatggagatgccaagctggagcggctggccgcccagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcaccggggctgctggggccagtgacaccaccatcaagcccaacccagaaaatacaggccccaccctggagtgggacaactatgacctgcgggaggatgccctggatgacaacgtgagcagcagctctgtgcatgacagccccctggccagcagccctgtgaggaagaacatcttccgctttgatgagagcaccaccggcttcaacttctccttcaagagcgccctgagcctgagcaagagccctgccaagctgaaccagagcggcacctctgtgggcacagatgaggagagtgatgtgacccaggaggaggagagagatggccagtactttgagcctgtggtgcccctgcctgacctggtggaggtgtcctctggagaggagaatgagcaggtggtgttcagccacatggccgagctgtaccgctatgacaaggatgtgggccagtggaaggagcggggcattggagacatcaagatcctgcagaactatgacaacaagcaggtgagaattgtgatgaggcgggaccaggtgctgaagctgtgtgccaaccaccgcatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcacccctcatgtgagccgcagcagcaccccccgggagagcccctgtgggaagattgctgtggccgtgctggaggagaccacccgggagaggacagatgtgatccagggagatgatgtggctgatgctgccagcgaggtggaggtgagcagcaccagcgagaccaccaccaaggctgtggtgagcccccccaagtttgtgtttggaagtgaatctgtgaagaggatcttcagcagcgagaagagcaacccctttgccttcggcaacagcagcgccaccggcagcctgtttggcttctccttcaatgcccccctgaagagcaatgattctgagaccagctctgtggcccagagcggcagcgagagcaaggtggagcccaagaagtgtgagctgagcaagaacagcgacatcgagcagagcagtgacagcaaggtgaagaacctgagcgccagcttccccatggaggagagcagcatcaactacaccttcaagaccccagagaaggagccccccctgtggcacgccgagttcaccaaggaggagctggtgcagaagctgagcagcaccaccaagtctgctgaccagctgaatggcctgctgcgggagacagaggccaccagcgctgtgctgatggagcagatcaagctgctgaagtctgagatccggcggctggagaggaaccaggaggagagcgctgccaacgtggagcacctgaagaatgtgctgctgcagttcatcttcctgaagccaggcagcgagcgggagagcctgctgcccgtcatcaacaccatgctgcagctgagccctgaggagaagggcaagctggccgctgtggcccagggcctgcaggagaccagcatccccaagaagaagtag

SEQ ID NO: 167103 - DNA, 5247 bp, Artificial Sequence
  Description of Artificial Sequence: Synthetic coding sequence
atgaatgtgatgggcttcaacacagaccggctggcctggaccaggaacaagctgcggggcttctactttgccaagctgtactatgaggccaaggagtatgacctggccaagaagtatgtgtgcacctacctgtctgtgcaggagcgggacccccgggcccaccgcttcctgggcctgctgtatgagctggaggagaacacagagaaggctgtggagtgctacagaagaagcctggagctgaaccccccccagaaggacctggtgctgaagattgctgagctgctgtgcaagaatgatgtgacagatggccgggccaagtactgggtggagcgggccgccaagctgtttcctggcagccctgccatctacaagctgaaggagcacctgctggactgtgaaggagaagatggctggaacaagctgtttgactggatccagagcgagctgtatgtgcggccagatgatgtgcacatgaacatccggctggtggagctgtaccgcagcaacaagaggctgaaggatgctgtggcccgctgccacgaggccgagaggaacatcgccctgcggagcagcctggagtggaacagctgtgtggtgcagaccctgaaggagtacctggagagcctgcagtgcctggagagtgacaagagtgactggagggccaccaacacagacctgctgctggcctatgccaacctgatgctgctgaccctgagcaccagagatgtgcaggagagccgggagctgctggagagctttgattctgccctgcagagcgccaagagcagcctgggcggcaatgatgagctgagcgccaccttcctggagatgaagggccacttctacatgcatgctggcagcctgctgctgaagatgggccagcacggcaacaacgtgcagtggcaggccctgtctgagctggccgccctgtgctacgtgattgccttccaggtgccccggcccaagatcaagctgatcaagggggaggccggccagaacctgctggagatgatggcctgtgaccggctgagccagagcggccacatgctgctgaacctgagccggggcaagcaggacttcctgaaggaggtggtggagacctttgccaacaagagcggccagagcgtgctgtacaatgccctcttcagcagccagagcagcaaggacaccagcttcctgggcagtgatgacatcggcaacattgatgtgcaggagcctgagctggaggacctggcccgctatgatgtgggcgccatccaggcccacaacggcagcctgcagcacctgacctggctgggcctgcagtggaacagcctgcctgccctgcccggcatcaggaagtggctgaagcagctgttccaccacctgccccaggagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccctgcctgtgtgcaagaggctgtgcacagagcggcagaagtcctggtgggatgctgtgtgcaccctcatccacaggaaggctgtgcccggcaacagcgctgagctgcggctggtggtgcagcacgagatcaacaccctgcgggcccaggagaagcacggcctgcagcctgccctgctggtgcactgggccaagtgcctgcagaagatgggccggggcctgaacagcagctatgaccagcaggagtacatcggccgctctgtgcactactggaagaaggtgctgcccctgctgaagatcatcaagaagaacagcatccctgagcccatcgaccccctcttcaagcacttccacagcgtggacatccaggccagcgagatcgtggagtatgaagaagatgcccacatcacctttgccatcctggatgctgtgcacggcaacattgaagatgctgtgacagcctttgagagcatcaagtctgtggtgtcctactggaacctggccctgatcttccacaggaaggcagaagatattgaaaatgatgctgtgtttcctgaggagcaggaggagtgcaagaactacctgaggaagacccgggactacctgatcaagatcattgatgacagcgacagcaacctgtctgtggtgaagaagctgcctgtgcccctggagagcgtgaaggagatgctgaagtctgtgatgcaggagctggaggactacagcgagggcggccccctgtacaagaatggcagcctgagaaatgctgacagcgagatcaagcacagcacccccagccccaccaagtacagcctgagccccagcaagagctacaagtacagccccaagaccccaccccgctgggccgaggaccagaacagcctgaggaagatgatctgccaggaggtgaaggccatcaccaagctgaacagcagcaagagcgccagccgccaccgctggcccacagaaaattatggcccagattctgtgcctgatggctaccagggcagccagaccttccatggagcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcattgctgtgtctgcagatggcttcaagtttggcatcagcgagcccggcaaccaggagaagaagtctgagaagcccctggagaatgacaccggcttccaggcccaggacatcagcggccagaagaatggccggggcgtcatcttcggccagaccagcagcaccttcacctttgctgatgtggccaagagcaccagcggggagggcttccagtttgggaagaaggaccccaacttcaagggcttctctggagctggggagaagctgttcagcagccagtgtgggaagatggccaacaaggccaacaccagcggggactttgagaaggatgatgatgcctgcaagacagaagattctgatgacatccactttgagcctgtggtgcagatgcctgagaaggtggagctggtgactggagaggagggggagaaggtgctgtacagccagggcgtgaagctgttccgctttgatgctgagatcagccagtggaaggagcggggcctgggcaacctgaagatcctgaagaatgaggtgaatggcaagcccaggatgctgatgagaagagaccaggtgctgaaggtgtgtgccaaccactggatcaccaccaccatgaacctgaagcccctgagcggcagtgaccgggcctggatgtggctggccagtgacttcagtgatggagatgccaagctggagcggctggccgcccagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcaccggggctgctggggccagtgacaccaccatcaagcccaacccagaaaatacaggccccaccctggagtgggacaactatgacctgcgggaggatgccctggatgacaacgtgagcagcagctctgtgcatgacagccccctggccagcagccctgtgaggaagaacatcttccgctttgatgagagcaccaccggcttcaacttctccttcaagagcgccctgagcctgagcaagagccctgccaagctgaaccagagcggcacctctgtgggcacagatgaggagagtgatgtgacccaggaggaggagagagatggccagtactttgagcctgtggtgcccctgcctgacctggtggaggtgtcctctggagaggagaatgagcaggtggtgttcagccacatggccgagctgtaccgctatgacaaggatgtgggccagtggaaggagcggggcattggagacatcaagatcctgcagaactatgacaacaagcaggtgagaattgtgatgaggcgggaccaggtgctgaagctgtgtgccaaccaccgcatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcacccctcatgtgagccgcagcagcaccccccgggagagcccctgtgggaagattgctgtggccgtgctggaggagaccacccgggagaggacagatgtgatccagggagatgatgtggctgatgctgccagcgaggtggaggtgagcagcaccagcgagaccaccaccaaggctgtggtgagcccccccaagtttgtgtttggaagtgaatctgtgaagaggatcttcagcagcgagaagagcaacccctttgccttcggcaacagcagcgccaccggcagcctgtttggcttctccttcaatgcccccctgaagagcaatgattctgagaccagctctgtggcccagagcggcagcgagagcaaggtggagcccaagaagtgtgagctgagcaagaacagcgacatcgagcagagcagtgacagcaaggtgaagaacctgagcgccagcttccccatggaggagagcagcatcaactacaccttcaagaccccagagaaggagccccccctgtggcacgccgagttcaccaaggaggagctggtgcagaagctgagcagcaccaccaagtctgctgaccagctgaatggcctgctgcgggagacagaggccaccagcgctgtgctgatggagcagatcaagctgctgaagtctgagatccggcggctggagaggaaccaggaggagagcgctgccaacgtggagcacctgaagaatgtgctgctgcagttcatcttcctgaagccaggcagcgagcgggagagcctgctgcccgtcatcaacaccatgctgcagctgagccctgaggagaagggcaagctggccgctgtggcccagggcctgcaggagaccagcatccccaagaagaagtag

SEQ ID NO: 167104 - DNA, 1935 bp, Artificial Sequence
  Description of Artificial Sequence: Synthetic coding sequence
atgctgatgaggcgggaccaggtgctgaaggtgtgtgccaaccactggatcaccaccaccatgaacctgaagcccctgagcggcagtgaccgggcctggatgtggctggccagtgacttcagtgatggagatgccaagctggagcggctggccgcccagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcactggagctgctggggccagtgacaccaccatcaagcccaaccctgagaacacaggccccaccctggagtgggacaactatgacctgagagaagatgccctggatgacaacgtgagcagcagctctgtgcatgacagccccctggccagcagccctgtgaggaagaacatcttccgctttgatgagagcaccaccggcttcaacttctccttcaagagcgccctgagcctgagcaagagccctgccaagctgaaccagagcggcacctctgtgggcacagatgaggagagtgatgtgacccaggaggaggagagagatggccagtactttgagcctgtggtgcccctgcctgacctggtggaggtgagcagcggggaggagaatgagcaggtggtgttcagccacatggccgagctgtaccgctatgacaaggatgtgggccagtggaaggagcggggcatcggggacatcaagatcctgcagaactatgacaacaagcaggtgcgcatcgtgatgagaagagaccaggtgctgaagctgtgtgccaaccaccgcatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcaccccccacgtgagccgcagcagcaccccccgggagagcccctgtgggaagattgctgtggccgtgctggaggagaccacccgggagaggacagatgtgatccagggagatgatgtggctgatgctgccagcgaggtggaggtgagcagcaccagcgagaccaccaccaaggctgtggtgtccccacccaagtttgtgtttggcagcgagagcgtgaagaggatcttcagcagcgagaagagcaacccctttgcctttggaaacagcagcgccaccggcagcctgtttggcttctccttcaatgcccccctgaagagcaatgacagcgagaccagctctgtggcccagagcggcagcgagagcaaggtggagcccaagaagtgtgagctgagcaagaacagcgacatcgagcagagcagtgacagcaaggtgaagaacctgagcgccagcttccccatggaggagagcagcatcaactacaccttcaagaccccagagaaggagccccccctgtggcatgctgagttcaccaaggaggagctggtgcagaagctgagcagcaccaccaagtctgctgaccagctgaatggcctgctgcgggagacagaggccaccagcgctgtgctgatggagcagatcaagctgctgaagtctgagatccggcggctggagaggaaccaggaggagagcgctgccaacgtggagcacctgaagaatgtgctgctgcagttcatcttcctgaagccaggcagcgagcgggagcccagcagctgctacaagtatgatgtggccgcccagccctag

SEQ ID NO: 167105 - DNA, 5301 bp, Artificial Sequence
  Description of Artificial Sequence: Synthetic coding sequence
atgagctgcagcaaggcctatggagagagatatgtggcctctgtgcagggcagcgcccccagccccaggaagaagagcacccggggcttctactttgccaagctgtactatgaggccaaggagtatgacctggccaagaagtacatctgcacctacatcaacgtgcgggagatggacccccgggcccaccgcttcctgggcctgctgtatgagctggaggagaacacagagaaggctgtggagtgctaccgccgctctgtggagctgaaccccacccagaaggacctggtgctgaagattgctgagctgctgtgcaagaatgatgtgacagatggccgggcagagtactgggtggagagagctgccaagctgtttcctggcagccctgccatctacaagctgaaggagcagctgctggactgtgagggggaggatggctggaacaagctgtttgacctgatccagagcgagctgtatgtgcggccagatgatgtgcacgtgaacatccggctggtggagctgtaccgcagcaccaagaggctgaaggatgctgtggcccgctgccatgaagctgagagaaatattgccctgcggagcagcctggagtggaacagctgtgtggtgcagaccctgaaggagtacctggagagcctgcagtgcctggagagtgacaagagtgactggagggccaccaacacagacctgctgctggcctatgccaacctgatgctgctgaccctgagcaccagagatgtgcaggagagccgggagctgctggagagctttgacagcgccctgcagagcgccaagagcagcctgggcggcaatgatgagctgagcgccaccttcctggagatgaagggccacttctacatgcacgccggcagcctgctgctgaagatgggccagcacggcaacaacgtgcagtggagggccctgtctgagctggccgccctgtgctacctgattgccttccaggtgccccggcccaagatcaagctgatcaagggggaggccggccagaacctgctggagatgatggcctgtgaccggctgagccagagcggccacatgctgctgaacctgagccggggcaagcaggacttcctgaaggtggtggtggagacctttgccaacaagagcggccagagcgccctgtatgatgccctcttcagcagccagagccccaaggacaccagcttcctgggcagtgatgacatcggcaacattgatgtgcaggagcctgagctggaggacctggcccgctatgatgtgggcgccatccgggcccacaacggcagcctgcagcacctgacctggctgggcctgcagtggaacagcctgcctgccctgcccggcatcaggaagtggctgaagcagctgttccaccacctgccccaggagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccctgcctgtgtgcaagcagctgtgcacagagcggcagaagtcctggtgggatgctgtgtgcaccctcatccacaggaaggctgtgcccggcaacagcgccaagctgcggctgctggtgcagcacgagatcaacaccctgcgggcccaggagaagcacggcctgcagcctgccctgctggtgcactgggccaagtgcctgcagaagatgggcagcggcctgaacagcttctatgaccagcgggagtacatcggccgctctgtgcactactggaagaaggtgctgcccctgctgaagatcatcaagaagaagaacagcatccctgagcccatcgaccccctcttcaagcacttccacagcgtggacatccaggccagcgagatcgtggagtatgaagaagatgcccacgtgacctttgccatcctggatgctgtgaatggaaatattgaagatgccatgacagcctttgagagcatcaagtctgtggtgtcctactggaacctggccctgatcttccacaggaaggcagaagatattgccaatgatgccctgagccctgaggagcaggaggagtgcaagaactacctgaggaagacccggggctacctgatcaagatcctggatgacagcgacagcaacctgtctgtggtgaagaagctgcctgtgcccctggagagcgtgaaggagatgctgaagtctgtgatgcaggagctggagaactacagcgagggcggccccctgtacaagaatggcagcctgagaaatgctgacagcgagatcaagcacagcacccccagccccaccaagtacagcctgagccccagcaagagctacaagtacagccccaagaccccaccccgctgggccgaggaccagaacagcctgctgaagatgatccggcaggaggtgaaggccatcaaggaggagatgcaggagctgaagctgaacagcagcaagagcgccagccaccaccgctggcccacagaaaattatggcccagattctgtgcctgatggctaccagggcagccagaccttccatggagcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcatccctgtgtctgcagatggcttcaagtttggcatcagcgagcccggcaaccaggagaagaagtctgagaagcccctggagaatgacaccggcctgcaggcccaggacatcagcggcaggaagaagggccggggcgtcatcttcggccagaccagcagcaccttcacctttgctgatgtggccaagagcaccagcggggagggcttccagtttgggaagaaggacctgaacttcaagggcttctctggagctggggagaagctgttcagcagccagtatggcaagatggccaacaaggccaacaccagcggggactttgagaaggatgatgatgcctacaagacagaagattctgatgacatccactttgagcctgtggtgcagatgcctgagaaggtggagctggtgactggagaggagggggagaaggtgctgtacagccagggcgtgaagctgttccgctttgatgctgaggtgtcccagtggaaggagcggggcctgggcaacctgaagatcctgaagaatgaggtgaatggcaaggtgaggatgctgatgcagcgggagcaggtgctgaaggtgtgtgccaaccactggatcaccaccaccatgaacctgaagcccctgagcggcagtgaccgggcctggatgtggagcgccagtgacttcagtgatggagatgccaagctggagcggctggccgccaagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtggccgaggaggagaacaagggcagcggcaccggggctgctggggccagtgacaccaccatcaagcccaatgcagaaaatacaggccccaccctggagtgggacaactatgacctgcgggaggatgccctggatgacagcgtgagcagcagctctgtgcacgccagccccctggccagcagccctgtgaggaagaacctcttccactttgatgagagcaccaccggcagcaacttctccttcaagagcgccctgagcctgagcaagagccctgccaagctgaaccagagcggcacctctgtgggcacagatgaggagagtgatgtgacccaggaggaggagagagatggccagtactttgagcctgtggtgcccctgcctgacctggtggaggtgtcctctggagaggagaatgagcaggtggtgttcagccacagagctgagttctaccgctatgacaaggatgtgggccagtggaaggagcggggcattggagacatcaagatcctgcagaactatgacaacaagcacgtgcgcatcctgatgaggcgggaccaggtgctgaagctgtgtgccaaccaccgcatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcacccctcatgtgagccgcagcagcaccccccgggagagcccctgtgggaagattgctgtggccgtgctggaggagaccacccgggagaggacagatgtgatccagggagatgatgtggctgatgctgccagcgaggtggaggtgagcagcaccagcgagaccaccaccaaggctgtggtgagcccccccaagtttgtgtttggaagtgaatctgtgaagaggatcttcagcagcgagaagagcaagccctttgccttcggcaacagcagcgccaccggcagcctgtttggcttctccttcaatgcccccctgaagagcaacaacagcgagaccagctctgtggcccagagcggcagcgagagcaaggtggagcccaagaagtgtgagctgagcaagaacagcgacatcgagcagagcagtgacagcaaggtgaagaacctgagcgccagcttccccacagaggagagcagcatcaactacaccttcaagaccccagagaaggagccccccctgtggtacgccgagttcaccaaggaggagctggtgcagaagctgagcagcaccaccaagtctgctgaccacctgaatggcctgctgcgggagattgaggccaccaatgctgtgctgatggagcagatcaagctgctgaagtctgagatccggcggctggagaggaaccaggagcaggaggtgtctgctgccaacgtggagcacctgaagaatgtgctgctgcagttcatcttcctgaagccaggcagcgagcgggagcggctgctgcccgtcatcaacaccatgctgcagctgagcctggaggagaagggcaagctggccgctgtggcccaggccgagcggggctttgtgctgaacagcaccttctag

SEQ ID NO: 167106 - DNA, 471 bp, Artificial Sequence
  Description of Artificial Sequence: Synthetic coding sequence
atggacccccgggcccaccgcttcctgggcctgctgtatgagctggaggagaacacagagaaggctgtggagtgctacagaagatctgtggagctgaaccccacccagaaggacctggtgctgaagattgctgagctgctgtgcaagaatgatgtgacagatggccgggcagagtactgggtggagcgggccgccaagctgtttcctggcagccctgccatctacaagctgaaggagcagctgctggactgtgaaggagaagatggctggaacaagctgtttgacctgatccagagcgagctgtatgtgcggccagatgatgtgcacgtgaacatccggctggtggagctgtaccgcagcaccaagaggctgaaggatgctgtggcccgctgccacgaggccgagaggaacatcgccctgcggagcagcctggagtggaacagctgtgtggtgcagaccctgaagttctag

SEQ ID NO: 167107 - DNA, 3378 bp, Artificial Sequence
  Description of Artificial Sequence: Synthetic coding sequence
atgctgctgaccctgagcaccagagatgtgcaggagagccgggagctgctggagagctttgacagcgccctgcagagcgccaagagcagcctgggcggcaatgatgagctgagcgccaccttcctggagatgaagggccacttctacatgcacgccggcagcctgctgctgaagatgggccagcacggcaacaacgtgcagtggagggccctgtctgagctggccgccctgtgctacctgattgccttccaggtgccccggcccaagatcaagctgatcaagggggaggccggccagaacctgctggagatgatggcctgtgaccggctgagccagagcggccacatgctgctgaacctgagccggggcaagcaggacttcctgaaggtggtggtggagacctttgccaacaagagcggccagagcgccctgtatgatgccctcttcagcagccagagccccaaggacaccagcttcctgggcagtgatgacatcggcaacattgatgtgcaggagcctgagctggaggacctggcccgctatgatgtgggcgccatccgggcccacaacggcagcctgcagcacctgacctggctgggcctgcagtggaacagcctgcctgccctgcccggcatcaggaagtggctgaagcagctgttccaccacctgccccaggagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccctgcctgtgtgcaagcagctgtgcacagagcggcagaagtcctggtgggatgctgtgtgcaccctcatccacaggaaggctgtgcccggcaacagcgccaagctgcggctgctggtgcagcacgagatcaacaccctgcgggcccaggagaagcacggcctgcagcctgccctgctggtgcactgggccaagtgcctgcagaagatgggcagcggcctgaacagcttctatgaccagcgggagtacatcggccgctctgtgcactactggaagaaggtgctgcccctgctgaagatcatcaagaagaagaacagcatccctgagcccatcgaccccctcttcaagcacttccacagcgtggacatccaggccagcgagatcgtggagtatgaagaagatgcccacgtgacctttgccatcctggatgctgtgaatggaaatattgaagatgccatgacagcctttgagagcatcaagtctgtggtgtcctactggaacctggccctgatcttccacaggaaggcagaagatattgccaatgatgccctgagccctgaggagcaggaggagtgcaagaactacctgaggaagacccggggctacctgatcaagatcctggatgacagcgacagcaacctgtctgtggtgaagaagctgcctgtgcccctggagagcgtgaaggagatgctgaagtctgtgatgcaggagctggagaactacagcgagggcggccccctgtacaagaatggcagcctgagaaatgctgacagcgagatcaagcacagcacccccagccccaccaagtacagcctgagccccagcaagagctacaagtacagccccaagaccccaccccgctgggccgaggaccagaacagcctgctgaagatgatccggcaggaggtgaaggccatcaaggaggagatgcaggagctgaagctgaacagcagcaagagcgccagccaccaccgctggcccacagaaaattatggcccagattctgtgcctgatggctaccagggcagccagaccttccatggagcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcatccctgtgtctgcagatggcttcaagtttggcatcagcgagcccggcaaccaggagaagaagtctgagaagcccctggagaatgacaccggcctgcaggcccaggacatcagcggcaggaagaagggccggggcgtcatcttcggccagaccagcagcaccttcacctttgctgatgtggccaagagcaccagcggggagggcttccagtttgggaagaaggacctgaacttcaagggcttctctggagctggggagaagctgttcagcagccagtatggcaagatggccaacaaggccaacaccagcggggactttgagaaggatgatgatgcctacaagacagaagattctgatgacatccactttgagcctgtggtgcagatgcctgagaaggtggagctggtgactggagaggagggggagaaggtgctgtacagccagggcgtgaagctgttccgctttgatgctgaggtgtcccagtggaaggagcggggcctgggcaacctgaagatcctgaagaatgaggtgaatggcaaggtgaggatgctgatgcagcgggagcaggtgctgaaggtgtgtgccaaccactggatcaccaccaccatgaacctgaagcccctgagcggcagtgaccgggcctggatgtggagcgccagtgacttcagtgatggagatgccaagctggagcggctggccgccaagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcagcgagagcaaggtggagcccaagaagtgtgagctgagcaagaacagcgacatcgagcagagcagtgacagcaaggtgaagaacctgagcgccagcttccccacagaggagagcagcatcaactacaccttcaagaccccagagaaggagccccccctgtggtatgcagagttcaccaaggaggagctggtgcagaagctgagcagcaccaccaagtctgctgaccacctgaatggcctgctgcgggagattgaggccaccaatgctgtgctgatggagcagatcaagctgctgaagtctgagatccggcggctggagaggaaccaggagcaggaggtgtctgctgccaacgtggagcacctgaagaatgtgctgctgcagttcatcttcctgaagccaggcagcgagcgggagcggctgctgcctgtgatcaacaccatgctgcagctgagcctggaggagaagggcaagctggccgctgtggcccagggcgaggagtag

SEQ ID NO: 167108 - DNA, 423 bp, Artificial Sequence
  Description of Artificial Sequence: Synthetic coding sequence
acagaggagagcagcatcaactacaccttcaagaccccagagaaggagccccccctgtggtacgccgagttcaccaaggaggagctggtgcagaagctgagcagcaccaccaagtctgctgaccacctgaatggcctgctgcgggagattgaggccaccaatgctgtgctgatggagcagatcaagctgctgaagtctgagatccggcggctggagaggaaccaggagcaggaggtgtctgctgccaacgtggagcacctgaagaatgtgctgctgcagttcatcttcctgaagccaggcagcgagcgggagcggctgctgcccgtcatcaacaccatgctgcagctgagcctggaggagaagggcaagctggccgctgtggcccagggcctgcaggagaccagcatccccaagaagaagtag

SEQ ID NO: 167109 - DNA, 5277 bp, Artificial Sequence
  Description of Artificial Sequence: Synthetic coding sequence
atgagctgcagcaaggcctatggagagagatatgtggcctctgtgcagggcagcgcccccagccccaggaagaagagcacccggggcttctactttgccaagctgtactatgaggccaaggagtatgacctggccaagaagtacatctgcacctacatcaacgtgcgggagatggacccccgggcccaccgcttcctgggcctgctgtatgagctggaggagaacacagagaaggctgtggagtgctaccgccgctctgtggagctgaaccccacccagaaggacctggtgctgaagattgctgagctgctgtgcaagaatgatgtgacagatggccgggcagagtactgggtggagagagctgccaagctgtttcctggcagccctgccatctacaagctgaaggagcagctgctggactgtgagggggaggatggctggaacaagctgtttgacctgatccagagcgagctgtatgtgcggccagatgatgtgcacgtgaacatccggctggtggagctgtaccgcagcaccaagaggctgaaggatgctgtggcccgctgccatgaagctgagagaaatattgccctgcggagcagcctggagtggaacagctgtgtggtgcagaccctgaaggagtacctggagagcctgcagtgcctggagagtgacaagagtgactggagggccaccaacacagacctgctgctggcctatgccaacctgatgctgctgaccctgagcaccagagatgtgcaggagagccgggagctgctggagagctttgacagcgccctgcagagcgccaagagcagcctgggcggcaatgatgagctgagcgccaccttcctggagatgaagggccacttctacatgcacgccggcagcctgctgctgaagatgggccagcacggcaacaacgtgcagtggagggccctgtctgagctggccgccctgtgctacctgattgccttccaggtgccccggcccaagatcaagctgatcaagggggaggccggccagaacctgctggagatgatggcctgtgaccggctgagccagagcggccacatgctgctgaacctgagccggggcaagcaggacttcctgaaggtggtggtggagacctttgccaacaagagcggccagagcgccctgtatgatgccctcttcagcagccagagccccaaggacaccagcttcctgggcagtgatgacatcggcaacattgatgtgcaggagcctgagctggaggacctggcccgctatgatgtgggcgccatccgggcccacaacggcagcctgcagcacctgacctggctgggcctgcagtggaacagcctgcctgccctgcccggcatcaggaagtggctgaagcagctgttccaccacctgccccaggagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccctgcctgtgtgcaagcagctgtgcacagagcggcagaagtcctggtgggatgctgtgtgcaccctcatccacaggaaggctgtgcccggcaacagcgccaagctgcggctgctggtgcagcacgagatcaacaccctgcgggcccaggagaagcacggcctgcagcctgccctgctggtgcactgggccaagtgcctgcagaagatgggcagcggcctgaacagcttctatgaccagcgggagtacatcggccgctctgtgcactactggaagaaggtgctgcccctgctgaagatcatcaagaagaagaacagcatccctgagcccatcgaccccctcttcaagcacttccacagcgtggacatccaggccagcgagatcgtggagtatgaagaagatgcccacgtgacctttgccatcctggatgctgtgaatggaaatattgaagatgccatgacagcctttgagagcatcaagtctgtggtgtcctactggaacctggccctgatcttccacaggaaggcagaagatattgccaatgatgccctgagccctgaggagcaggaggagtgcaagaactacctgaggaagacccggggctacctgatcaagatcctggatgacagcgacagcaacctgtctgtggtgaagaagctgcctgtgcccctggagagcgtgaaggagatgctgaagtctgtgatgcaggagctggagaactacagcgagggcggccccctgtacaagaatggcagcctgagaaatgctgacagcgagatcaagcacagcacccccagccccaccaagtacagcctgagccccagcaagagctacaagtacagccccaagaccccaccccgctgggccgaggaccagaacagcctgctgaagatgatccggcaggaggtgaaggccatcaaggaggagatgcaggagctgaagctgaacagcagcaagagcgccagccaccaccgctggcccacagaaaattatggcccagattctgtgcctgatggctaccagggcagccagaccttccatggagcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcatccctgtgtctgcagatggcttcaagtttggcatcagcgagcccggcaaccaggagaagaagtctgagaagcccctggagaatgacaccggcctgcaggcccaggacatcagcggcaggaagaagggccggggcgtcatcttcggccagaccagcagcaccttcacctttgctgatgtggccaagagcaccagcggggagggcttccagtttgggaagaaggacctgaacttcaagggcttctctggagctggggagaagctgttcagcagccagtatggcaagatggccaacaaggccaacaccagcggggactttgagaaggatgatgatgcctacaagacagaagattctgatgacatccactttgagcctgtggtgcagatgcctgagaaggtggagctggtgactggagaggagggggagaaggtgctgtacagccagggcgtgaagctgttccgctttgatgctgaggtgtcccagtggaaggagcggggcctgggcaacctgaagatcctgaagaatgaggtgaatggcaaggtgaggatgctgatgcagcgggagcaggtgctgaaggtgtgtgccaaccactggatcaccaccaccatgaacctgaagcccctgagcggcagtgaccgggcctggatgtggagcgccagtgacttcagtgatggagatgccaagctggagcggctggccgccaagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtggccgaggaggagaacaagggcagcggcaccggggctgctggggccagtgacaccaccatcaagcccaatgcagaaaatacaggccccaccctggagtgggacaactatgacctgcgggaggatgccctggatgacagcgtgagcagcagctctgtgcacgccagccccctggccagcagccctgtgaggaagaacctcttccactttgatgagagcaccaccggcagcaacttctccttcaagagcgccctgagcctgagcaagagccctgccaagctgaaccagagcggcacctctgtgggcacagatgaggagagtgatgtgacccaggaggaggagagagatggccagtactttgagcctgtggtgcccctgcctgacctggtggaggtgtcctctggagaggagaatgagcaggtggtgttcagccacagagctgagttctaccgctatgacaaggatgtgggccagtggaaggagcggggcattggagacatcaagatcctgcagaactatgacaacaagcacgtgcgcatcctgatgaggcgggaccaggtgctgaagctgtgtgccaaccaccgcatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcacccctcatgtgagccgcagcagcaccccccgggagagcccctgtgggaagattgctgtggccgtgctggaggagaccacccgggagaggacagatgtgatccagggagatgatgtggctgatgctgccagcgaggtggaggtgagcagcaccagcgagaccaccaccaaggctgtggtgagcccccccaagtttgtgtttggaagtgaatctgtgaagaggatcttcagcagcgagaagagcaagccctttgccttcggcaacagcagcgccaccggcagcctgtttggcttctccttcaatgcccccctgaagagcaacaacagcgagaccagctctgtggcccagagcggcagcgagagcaaggtggagcccaagaagtgtgagctgagcaagaacagcgacatcgagcagagcagtgacagcaaggtgaagaacctgagcgccagcttccccacagaggagagcagcatcaactacaccttcaagaccccagagaaggagccccccctgtggtacgccgagttcaccaaggaggagctggtgcagaagctgagcagcaccaccaagtctgctgaccacctgaatggcctgctgcgggagattgaggccaccaatgctgtgctgatggagcagatcaagctgctgaagtctgagatccggcggctggagaggaaccaggagcaggaggtgtctgctgccaacgtggagcacctgaagaatgtgctgctgcagttcatcttcctgaagccaggcagcgagcgggagcggctgctgcccgtcatcaacaccatgctgcagctgagcctggaggagaagggcaagctggccgctgtggcccagggcgaggagtag

SEQ ID NO: 167110 - DNA, 5301 bp, Artificial Sequence
  Description of Artificial Sequence: Synthetic coding sequence
atgagctgcagcaaggcctatggagagagatatgtggcctctgtgcagggcagcgcccccagccccaggaagaagagcacccggggcttctactttgccaagctgtactatgaggccaaggagtatgacctggccaagaagtacatctgcacctacatcaacgtgcgggagatggacccccgggcccaccgcttcctgggcctgctgtatgagctggaggagaacacagagaaggctgtggagtgctaccgccgctctgtggagctgaaccccacccagaaggacctggtgctgaagattgctgagctgctgtgcaagaatgatgtgacagatggccgggccaagtactgggtggagagagctgccaagctgtttcctggcagccctgccatctacaagctgaaggagcagctgctggactgtgagggggaggatggctggaacaagctgtttgacctgatccagagcgagctgtatgtgcggccagatgatgtgcacgtgaacatccggctggtggagctgtaccgcagcaccaagaggctgaaggatgctgtggcccgctgccatgaagctgagagaaatattgccctgcggagcagcctggagtggaacagctgtgtggtgcagaccctgaaggagtacctggagagcctgcagtgcctggagagtgacaagagtgactggagggccaccaacacagacctgctgctggcctatgccaacctgatgctgctgaccctgagcaccagagatgtgcaggagagccgggagctgctggagagctttgacagcgccctgcagagcgccaagagcagcctgggcggcaatgatgagctgagcgccaccttcctggagatgaagggccacttctacatgcacgccggcagcctgctgctgaagatgggccagcacggcaacaacgtgcagtggagggccctgtctgagctggccgccctgtgctacctgattgccttccaggtgccccggcccaagatcaagctgatcaagggggaggccggccagaacctgctggagatgatggcctgtgaccggctgagccagagcggccacatgctgctgaacctgagccggggcaagcaggacttcctgaaggtggtggtggagacctttgccaacaagagcggccagagcgccctgtatgatgccctcttcagcagccagagccccaaggacaccagcttcctgggcagtgatgacatcggcaacattgatgtgcaggagcctgagctggaggacctggcccgctatgatgtgggcgccatccgggcccacaacggcagcctgcagcacctgacctggctgggcctgcagtggaacagcctgcctgccctgcccggcatcaggaagtggctgaagcagctgttccaccacctgccccaggagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccctgcctgtgtgcaagcagctgtgcacagagcggcagaagtcctggtgggatgctgtgtgcaccctcatccacaggaaggctgtgcccggcaacagcgccaagctgcggctgctggtgcagcacgagatcaacaccctgcgggcccaggagaagcacggcctgcagcctgccctgctggtgcactgggccaagtgcctgcagaagatgggcagcggcctgaacagcttctatgaccagcgggagtacatcggccgctctgtgcactactggaagaaggtgctgcccctgctgaagatcatcaagaagaagaacagcatccctgagcccatcgaccccctcttcaagcacttccacagcgtggacatccaggccagcgagatcgtggagtatgaagaagatgcccacgtgacctttgccatcctggatgctgtgaatggaaatattgaagatgccatgacagcctttgagagcatcaagtctgtggtgtcctactggaacctggccctgatcttccacaggaaggcagaagatattgccaatgatgccctgagccctgaggagcaggaggagtgcaagaactacctgaggaagacccggggctacctgatcaagatcctggatgacagcgacagcaacctgtctgtggtgaagaagctgcctgtgcccctggagagcgtgaaggagatgctgaagtctgtgatgcaggagctggagaactacagcgagggggaccccctgtacaagaatggcagcctgagaaatgctgacagcgagatcaagcacagcacccccagccccaccaagtacagcctgagccccagcaagagctacaagtacagccccaagaccccaccccgctgggccgaggaccagaacagcctgctgaagatgatccggcaggaggtgaaggccatcaaggaggagatgcaggagctgaagctgaacagcagcaagagcgccagccaccaccgctggcccacagaaaattatggcccagattctgtgcctgatggctaccagggcagccagaccttccatggagcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcatccctgtgtctgcagatggcttcaagtttggcatcagcgagcccggcaaccaggagaaggagagcgagaagcccctggagaatgacaccggcttccaggcccaggacatcagcggccagaagaatggccggggcgtcatcttcggccagaccagcagcaccttcacctttgctgatgtggccaagagcaccagcggggagggcttccagtttgggaagaaggaccccaacttcaagggcttctctggagctggggagaagctgttcagcagccagtgtgggaagatggccaacaaggccaacaccagcggggactttgagaaggatgatgatgcctacaagacagaagattctgatgacatccactttgagcctgtggtgcagatgcctgagaaggtggagctggtgattggagaggagggggagaaggtgctgtacagccagggcgtgaagctgttccgctttgatgctgaggtgcggcagtggaaggagcggggcctgggcaacctgaagatcctgaagaatgaggtgaatggcaagcccaggatgctgatgagaagagagcaggtgctgaaggtgtgtgccaaccactggatcaccaccaccatgaacctgaagcccctgagcggcagtgaccgggcctggatgtggagcgccagtgacttcagtgatggagatgccaagctggagcggctggccgccaagttcaagaccccagagctggccgaggagttcaagcagaagtttgaggagtgccagcagctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcaccggggctgctggggccagtgacaccaccatcaagcccaacccagaaaatacaggccccaccctggagtgggacaactgtgacctgcgggaggatgccctggatgacagcgtgagcagcagctctgtgcacgccagccccctggccagcagccctgtgaggaagaacctcttccactttggagagagcaccaccggcagcaacttctccttcaagagcgccctgagccccagcaagagccctgccaagctgaaccagagcggcacctctgtgggcacagatgaggagagtgatgtgacccaggaggaggagagagatggccagtactttgagcctgtggtgcccctgcctgacctggtggaggtgtcctctggagaggagaatgagaaggtggtgttcagccacagagctgagctgtaccgctatgacaaggatgtgggccagtggaaggagcggggcattggagacatcaagatcctgcagaactatgacaacaagcaggtgagaattgtgatgaggcgggaccaggtgctgaagctgtgtgccaaccacaccatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcacccctcatgtgagccgcagcagcaccccccgggagagcccctgtgggaagattgctgtggccgtgctggaggagaccacccgggagaggacagatgtgatccagggagatgatgtggctgatgctgccagcgaggtggaggtgagcagcaccagcgagaccaccaccaaggctgtggtgagcccccccaagtttgtgtttggaagtgaatctgtgaagaggatcttcagcagcgagaagagcaagccctttgccttcggcaacagcagcgccaccggcagcctgtttggcttctccttcaatgccagcctgaagagcaacaacagcgagaccagctctgtggcccagagcggcagcgagagcaaggtggagcccaagaagtgtgagctgagcaagaacagcgacatcgagcagagcagtgacagcaaggtgaagaacctgagcgccagcttccccatggaggagagcagcatcaactacaccttcaagaccccagagaaggagccccccctgtggcacgccgagttcaccaaggaggagctggtgcagaagctgagcagcaccaccaagtctgctgaccacctgaatggcctgctgcgggaggccgaggccaccagcgctgtgctgatggagcagatcaagctgctgaagtctgagatccggcggctggagaggaaccaggagcaggaggagagcgctgccaacgtggagcacctgaagaatgtgctgctgcagttcatcttcctgaagccaggcagcgagcgggagcggctgctgcccgtcatcaacaccatgctgcagctgagccctgaggagaagggcaagctggccgctgtggcccaggccgagcggggctttgtgctgaacagcaccttctag

SEQ ID NO: 167111 - DNA, 3378 bp, Artificial Sequence
  Description of Artificial Sequence: Synthetic coding sequence
atgctgctgaccctgagcaccagagatgtgcaggagagccgggagctgctggagagctttgacagcgccctgcagagcgccaagagcagcctgggcggcaatgatgagctgagcgccaccttcctggagatgaagggccacttctacatgcacgccggcagcctgctgctgaagatgggccagcacggcaacaacgtgcagtggagggccctgtctgagctggccgccctgtgctacctgattgccttccaggtgccccggcccaagatcaagctgatcaagggggaggccggccagaacctgctggagatgatggcctgtgaccggctgagccagagcggccacatgctgctgaacctgagccggggcaagcaggacttcctgaaggtggtggtggagacctttgccaacaagagcggccagagcgccctgtatgatgccctcttcagcagccagagccccaaggacaccagcttcctgggcagtgatgacatcggcaacattgatgtgcaggagcctgagctggaggacctggcccgctatgatgtgggcgccatccgggcccacaacggcagcctgcagcacctgacctggctgggcctgcagtggaacagcctgcctgccctgcccggcatcaggaagtggctgaagcagctgttccaccacctgccccaggagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccctgcctgtgtgcaagcagctgtgcacagagcggcagaagtcctggtgggatgctgtgtgcaccctcatccacaggaaggctgtgcccggcaacagcgccaagctgcggctgctggtgcagcacgagatcaacaccctgcgggcccaggagaagcacggcctgcagcctgccctgctggtgcactgggccaagtgcctgcagaagatgggcagcggcctgaacagcttctatgaccagcgggagtacatcggccgctctgtgcactactggaagaaggtgctgcccctgctgaagatcatcaagaagaagaacagcatccctgagcccatcgaccccctcttcaagcacttccacagcgtggacatccaggccagcgagatcgtggagtatgaagaagatgcccacgtgacctttgccatcctggatgctgtgaatggaaatattgaagatgccatgacagcctttgagagcatcaagtctgtggtgtcctactggaacctggccctgatcttccacaggaaggcagaagatattgccaatgatgccctgagccctgaggagcaggaggagtgcaagaactacctgaggaagacccggggctacctgatcaagatcctggatgacagcgacagcaacctgtctgtggtgaagaagctgcctgtgcccctggagagcgtgaaggagatgctgaagtctgtgatgcaggagctggagaactacagcgagggggaccccctgtacaagaatggcagcctgagaaatgctgacagcgagatcaagcacagcacccccagccccaccaagtacagcctgagccccagcaagagctacaagtacagccccaagaccccaccccgctgggccgaggaccagaacagcctgctgaagatgatccggcaggaggtgaaggccatcaaggaggagatgcaggagctgaagctgaacagcagcaagagcgccagccaccaccgctggcccacagaaaattatggcccagattctgtgcctgatggctaccagggcagccagaccttccatggagcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcatccctgtgtctgcagatggcttcaagtttggcatcagcgagcccggcaaccaggagaaggagagcgagaagcccctggagaatgacaccggcttccaggcccaggacatcagcggccagaagaatggccggggcgtcatcttcggccagaccagcagcaccttcacctttgctgatgtggccaagagcaccagcggggagggcttccagtttgggaagaaggaccccaacttcaagggcttctctggagctggggagaagctgttcagcagccagtgtgggaagatggccaacaaggccaacaccagcggggactttgagaaggatgatgatgcctacaagacagaagattctgatgacatccactttgagcctgtggtgcagatgcctgagaaggtggagctggtgattggagaggagggggagaaggtgctgtacagccagggcgtgaagctgttccgctttgatgctgaggtgcggcagtggaaggagcggggcctgggcaacctgaagatcctgaagaatgaggtgaatggcaagcccaggatgctgatgagaagagagcaggtgctgaaggtgtgtgccaaccactggatcaccaccaccatgaacctgaagcccctgagcggcagtgaccgggcctggatgtggagcgccagtgacttcagtgatggagatgccaagctggagcggctggccgccaagttcaagaccccagagctggccgaggagttcaagcagaagtttgaggagtgccagcagctgctgctggacatccccctgcagaccccccacaagctggtggacaccggccgggccgccaagctgatccagagagctgaggagatgaagagcggcagcgagagcaaggtggagcccaagaagtgtgagctgagcaagaacagcgacatcgagcagagcagtgacagcaaggtgaagaacctgagcgccagcttccccatggaggagagcagcatcaactacaccttcaagaccccagagaaggagccccccctgtggcatgctgagttcaccaaggaggagctggtgcagaagctgagcagcaccaccaagtctgctgaccacctgaatggcctgctgcgggaggccgaggccaccagcgctgtgctgatggagcagatcaagctgctgaagtctgagatccggcggctggagaggaaccaggagcaggaggagagcgctgccaacgtggagcacctgaagaatgtgctgctgcagttcatcttcctgaagccaggcagcgagcgggagcggctgctgcctgtgatcaacaccatgctgcagctgagccctgaggagaagggcaagctggccgctgtggcccagggcgaggagtag

SEQ ID NO: 167112 - DNA, 471 bp, Artificial Sequence
  Description of Artificial Sequence: Synthetic coding sequence
atggacccccgggcccaccgcttcctgggcctgctgtatgagctggaggagaacacagagaaggctgtggagtgctacagaagatctgtggagctgaaccccacccagaaggacctggtgctgaagattgctgagctgctgtgcaagaatgatgtgacagatggccgggccaagtactgggtggagcgggccgccaagctgtttcctggcagccctgccatctacaagctgaaggagcagctgctggactgtgaaggagaagatggctggaacaagctgtttgacctgatccagagcgagctgtatgtgcggccagatgatgtgcacgtgaacatccggctggtggagctgtaccgcagcaccaagaggctgaaggatgctgtggcccgctgccacgaggccgagaggaacatcgccctgcggagcagcctggagtggaacagctgtgtggtgcagaccctgaagttctag

SEQ ID NO: 167113 - DNA, 5277 bp, Artificial Sequence
  Description of Artificial Sequence: Synthetic coding sequence
atgagctgcagcaaggcctatggagagagatatgtggcctctgtgcagggcagcgcccccagccccaggaagaagagcacccggggcttctactttgccaagctgtactatgaggccaaggagtatgacctggccaagaagtacatctgcacctacatcaacgtgcgggagatggacccccgggcccaccgcttcctgggcctgctgtatgagctggaggagaacacagagaaggctgtggagtgctaccgccgctctgtggagctgaaccccacccagaaggacctggtgctgaagattgctgagctgctgtgcaagaatgatgtgacagatggccgggccaagtactgggtggagagagctgccaagctgtttcctggcagccctgccatctacaagctgaaggagcagctgctggactgtgagggggaggatggctggaacaagctgtttgacctgatccagagcgagctgtatgtgcggccagatgatgtgcacgtgaacatccggctggtggagctgtaccgcagcaccaagaggctgaaggatgctgtggcccgctgccatgaagctgagagaaatattgccctgcggagcagcctggagtggaacagctgtgtggtgcagaccctgaaggagtacctggagagcctgcagtgcctggagagtgacaagagtgactggagggccaccaacacagacctgctgctggcctatgccaacctgatgctgctgaccctgagcaccagagatgtgcaggagagccgggagctgctggagagctttgacagcgccctgcagagcgccaagagcagcctgggcggcaatgatgagctgagcgccaccttcctggagatgaagggccacttctacatgcacgccggcagcctgctgctgaagatgggccagcacggcaacaacgtgcagtggagggccctgtctgagctggccgccctgtgctacctgattgccttccaggtgccccggcccaagatcaagctgatcaagggggaggccggccagaacctgctggagatgatggcctgtgaccggctgagccagagcggccacatgctgctgaacctgagccggggcaagcaggacttcctgaaggtggtggtggagacctttgccaacaagagcggccagagcgccctgtatgatgccctcttcagcagccagagccccaaggacaccagcttcctgggcagtgatgacatcggcaacattgatgtgcaggagcctgagctggaggacctggcccgctatgatgtgggcgccatccgggcccacaacggcagcctgcagcacctgacctggctgggcctgcagtggaacagcctgcctgccctgcccggcatcaggaagtggctgaagcagctgttccaccacctgccccaggagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccctgcctgtgtgcaagcagctgtgcacagagcggcagaagtcctggtgggatgctgtgtgcaccctcatccacaggaaggctgtgcccggcaacagcgccaagctgcggctgctggtgcagcacgagatcaacaccctgcgggcccaggagaagcacggcctgcagcctgccctgctggtgcactgggccaagtgcctgcagaagatgggcagcggcctgaacagcttctatgaccagcgggagtacatcggccgctctgtgcactactggaagaaggtgctgcccctgctgaagatcatcaagaagaagaacagcatccctgagcccatcgaccccctcttcaagcacttccacagcgtggacatccaggccagcgagatcgtggagtatgaagaagatgcccacgtgacctttgccatcctggatgctgtgaatggaaatattgaagatgccatgacagcctttgagagcatcaagtctgtggtgtcctactggaacctggccctgatcttccacaggaaggcagaagatattgccaatgatgccctgagccctgaggagcaggaggagtgcaagaactacctgaggaagacccggggctacctgatcaagatcctggatgacagcgacagcaacctgtctgtggtgaagaagctgcctgtgcccctggagagcgtgaaggagatgctgaagtctgtgatgcaggagctggagaactacagcgagggggaccccctgtacaagaatggcagcctgagaaatgctgacagcgagatcaagcacagcacccccagccccaccaagtacagcctgagccccagcaagagctacaagtacagccccaagaccccaccccgctgggccgaggaccagaacagcctgctgaagatgatccggcaggaggtgaaggccatcaaggaggagatgcaggagctgaagctgaacagcagcaagagcgccagccaccaccgctggcccacagaaaattatggcccagattctgtgcctgatggctaccagggcagccagaccttccatggagcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcatccctgtgtctgcagatggcttcaagtttggcatcagcgagcccggcaaccaggagaaggagagcgagaagcccctggagaatgacaccggcttccaggcccaggacatcagcggccagaagaatggccggggcgtcatcttcggccagaccagcagcaccttcacctttgctgatgtggccaagagcaccagcggggagggcttccagtttgggaagaaggaccccaacttcaagggcttctctggagctggggagaagctgttcagcagccagtgtgggaagatggccaacaaggccaacaccagcggggactttgagaaggatgatgatgcctacaagacagaagattctgatgacatccactttgagcctgtggtgcagatgcctgagaaggtggagctggtgattggagaggagggggagaaggtgctgtacagccagggcgtgaagctgttccgctttgatgctgaggtgcggcagtggaaggagcggggcctgggcaacctgaagatcctgaagaatgaggtgaatggcaagcccaggatgctgatgagaagagagcaggtgctgaaggtgtgtgccaaccactggatcaccaccaccatgaacctgaagcccctgagcggcagtgaccgggcctggatgtggagcgccagtgacttcagtgatggagatgccaagctggagcggctggccgccaagttcaagaccccagagctggccgaggagttcaagcagaagtttgaggagtgccagcagctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcaccggggctgctggggccagtgacaccaccatcaagcccaacccagaaaatacaggccccaccctggagtgggacaactgtgacctgcgggaggatgccctggatgacagcgtgagcagcagctctgtgcacgccagccccctggccagcagccctgtgaggaagaacctcttccactttggagagagcaccaccggcagcaacttctccttcaagagcgccctgagccccagcaagagccctgccaagctgaaccagagcggcacctctgtgggcacagatgaggagagtgatgtgacccaggaggaggagagagatggccagtactttgagcctgtggtgcccctgcctgacctggtggaggtgtcctctggagaggagaatgagaaggtggtgttcagccacagagctgagctgtaccgctatgacaaggatgtgggccagtggaaggagcggggcattggagacatcaagatcctgcagaactatgacaacaagcaggtgagaattgtgatgaggcgggaccaggtgctgaagctgtgtgccaaccacaccatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcacccctcatgtgagccgcagcagcaccccccgggagagcccctgtgggaagattgctgtggccgtgctggaggagaccacccgggagaggacagatgtgatccagggagatgatgtggctgatgctgccagcgaggtggaggtgagcagcaccagcgagaccaccaccaaggctgtggtgagcccccccaagtttgtgtttggaagtgaatctgtgaagaggatcttcagcagcgagaagagcaagccctttgccttcggcaacagcagcgccaccggcagcctgtttggcttctccttcaatgccagcctgaagagcaacaacagcgagaccagctctgtggcccagagcggcagcgagagcaaggtggagcccaagaagtgtgagctgagcaagaacagcgacatcgagcagagcagtgacagcaaggtgaagaacctgagcgccagcttccccatggaggagagcagcatcaactacaccttcaagaccccagagaaggagccccccctgtggcacgccgagttcaccaaggaggagctggtgcagaagctgagcagcaccaccaagtctgctgaccacctgaatggcctgctgcgggaggccgaggccaccagcgctgtgctgatggagcagatcaagctgctgaagtctgagatccggcggctggagaggaaccaggagcaggaggagagcgctgccaacgtggagcacctgaagaatgtgctgctgcagttcatcttcctgaagccaggcagcgagcgggagcggctgctgcccgtcatcaacaccatgctgcagctgagccctgaggagaagggcaagctggccgctgtggcccagggcgaggagtag

SEQ ID NO: 167114 - DNA, 5298 bp, Artificial Sequence
  Description of Artificial Sequence: Synthetic coding sequence
atgaggaggagcaaggcagatgtggagagatatgtggcctctgtgctgggcctgacccccagcccccggcagaagtccatgaagggcttctactttgccaagctgtactatgaggccaaggagtatgacctggccaagaagtacatctgcacctacatcaacgtgcaggagcgggaccccaaggcccaccgcttcctgggcctgctgtatgagctggaggagaacacagagaaggctgtggagtgctaccgccgctctgtggagctgaaccccacccagaaggacctggtgctgaagattgctgagctgctgtgcaagaatgatgtgacagatggccgggccaagtactgggtggagagagctgccaagctgtttcctggcagccctgccatctacaagctgaaggagcagctgctggactgtgagggggaggatggctggaacaagctgtttgacctgatccagagcgagctgtatgtgcggccagatgatgtgcacgtgaacatccggctggtggagctgtaccgcagcaccaagaggctgaaggatgctgtggcccactgccatgaagctgagagaaatattgccctgcggagcagcctggagtggaacagctgtgtggtgcagaccctgaaggagtacctggagagcctgcagtgcctggagagtgacaagagtgactggcaggccaccaacacagacctgctgctggcctatgccaacctgatgctgctgaccctgagcaccagagatgtgcaggagaaccgggagctgctggagagctttgacagcgccctgcagagcgccaagagcagcctgggcggcaatgatgagctgagcgccaccttcctggagatgaagggccacttctacatgtatgccggcagcctgctgctgaagatgggccagcacggcaacaacgtgcagtggagggccctgtctgagctggccgccctgtgctacctgattgccttccaggtgccccggcccaagatcaagctgcgggagggcaaggccggccagaacctgctggagatgatggcctgtgaccggctgagccagagcggccacatgctgctgagcctgagccggggcaagcaggacttcctgaaggaggtggtggagacctttgccaacaagattggccagagcgccctgtatgatgccctcttcagcagccagagccccaaggacaccagcttcctgggcagtgatgacatcggcaagattgatgtgcaggagcctgagctggaggacctggcccgctatgatgtgggcgccatccgggcccacaacggcagcctgcagcacctgacctggctgggcctgcagtggaacagcctgcctgccctgcccggcatcaggaagtggctgaagcagctgttccaccggctgccccatgagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccttccctgtgtgcaagcagctgtgcacagagcggcagaagtcctggtgggatgctgtgtgcaccctcatccacaggaaggctgtgcccggcaacctggccaagctgcggctgctggtgcagcacgagatcaacaccctgcgggcccaggagaagcacggcctgcagcctgccctgctggtgcactgggccaagtacctgcagaagacaggcagcggcctgaacagcttctacggccagctggagtacatcggccgctctgtgcactactggaagaaggtgctgcccctgctgaagatcatcaagaagaacagcatccctgagcccatcgaccccctcttcaagcacttccacagcgtggacatccaggccagcgagatcgtggagtatgaggaggatgcccacatcacctttgccatgctggatgctgtgaatggaaatattgaagatgctgtgacagcctttgagagcatcaagtctgtggtgtcctactggaacctggccctgatcttccacaggaaggccgaggacattgaaaatgatgccctgagccctgaggagcaggaggagtgcaggaactacctgaccaagacccgggactacctgatcaagatcattgatgatggagacagcaacctgtctgtggtgaagaagctgcctgtgcccctggagagcgtgaagcagatgctgaacagcgtgatgcaggagctggaggactacagcgagggcggccccctgtacaagaatggcagcctgagaaatgctgacagcgagatcaagcacagcacccccagccccaccaagtacagcctgagccccagcaagagctacaagtacagccctgagaccccaccccgctggacagaagatagaaacagcctgctgaacatgatctgccagcaggtggaggccatcaagaaggagatgcaggagctgaagctgaacagcagcaagagcgccagccgccaccgctggcccacagagaactacggccctgacagcgtgcctgatggctaccagggcagccagaccttccacggggcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcatccctgtgtctgcagatggcttcaagtttggcatcagcgagcccggcaaccaggagaagaagcgggagaagcccctggagaatgacaccggcttccaggcccaggacatcagcggcaggaagaagggccggggcgtcatcttcggccagaccagcagcaccttcacctttgctgatgtggccaagagcaccagcggggagggcttccagtttgggaagaaggacctgaacttcaagggcttcagcggggccggggagaagctgttcagcagccgctatggcaagatggccaacaaggccaacaccagcggggactttgagaaggatgatgatgcctacaagacagaggacagtgatgacatccactttgagcctgtggtgcagatgcctgagaaggtggagctggtgactggagaggagggggagaaggtgctgtacagccagggcgtgaagctgttccgctttgatgctgaggtgcggcagtggaaggagcggggcctgggcaacctgaagatcctgaagaatgaggtgaatggcaagctgaggatgctgatgaggcgggagcaggtgctgaaggtgtgtgccaaccactggatcaccaccaccatgaacctgaagcccctgagcggcagtgaccgggcctggatgtggagcgccagtgacttcagtgatggagatgccaagctggagcggctggccgccaagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcactggagctgctggggccagtgacaccaccatcaagcccaatgctgagaacacaggccccaccctggagtgggacaactatgacctgagagaagatgccctggatgattctgtgagcagcagctctgtgcacgccagccccctggccagcagccctgtgaggaagaacctcttccgctttgatgagagcaccaccggcagcaacttctccttcaagagcgccctgagcctgagcaagagccctgccaagctgaaccagagcggcacctctgtgggcacagatgaggagagcgtggtgacccaggaggaggagagagatggccagtactttgagcctgtggtgcccctgcctgacctggtggaggtgagcagcggggaggagaatgagcaggtggtgttcagccacagagctgagatctaccgctatgacaaggatgtgggccagtggaaggagcggggcatcggggacatcaagatcctgcagaactatgacaacaagcaggtgcgcatcgtgatgagaagagaccaggtgctgaagctgtgtgccaaccaccgcatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcaccccccacgtgagccgcagcagcaccccccgggagagcccctgtgggaagattgctgtggccatcctggaggagaccacccgggagaggacagatgtgatccagggagatgatgtggctgatgctgccagcgaggtggaggtgagcagcaccagcgagaccaccaccaaggctgtggtgtccccacccaagtttgtgtttgtgtctgagagcgtgaagaggatcttcagcagcgagaagagcaagccctttgtgtttggaaacagcagcgccaccggcagcctgtttggcttctccttcaatgcccccctgaagagcaacaacagcgagaccagctctgtggcccagagcggcagcgagagcaaggtggagcccaagaagtgtgagctgagcaagaacagcgacatcgagcagagcagtgacagcaaggtgaagaacctgagcgccagcttccccacagaggagagcagcatcaactacaccttcaagaccccagagaaggagccccccctgtggcatgctgagttcaccaaggaggagctggtgcagaagctgcggagcaccaccaagtctgctgaccacctgaatggcctgctgcgggagattgaggccaccaatgctgtgctgatggagcagatcaagctgctgaagtctgagatccggcggctggagaggaaccaggagcgggagaagtctgctgccaacctggagtacctgaagaatgtgctgctgcagttcatcttcctgaagccaggcagcgagcgggagcggctgctgcctgtgatcaacaccatgctgcagctgagccctgaggagaagggcaagctggccgctgtggcccaggatgaggaggagaatgccagccgcagcagcggctag

SEQ ID NO: 167115 - DNA, 2715 bp, Artificial Sequence
  Description of Artificial Sequence: Synthetic coding sequence
atgaggaggagcaaggcagatgtggagagatatgtggcctctgtgctgggcctgacccccagcccccggcagaagtccatgaagggcttctactttgccaagctgtactatgaggccaaggagtatgacctggccaagaagtacatctgcacctacatcaacgtgcaggagcgggaccccaaggcccaccgcttcctgggcctgctgtatgagctggaggagaacacagagaaggctgtggagtgctaccgccgctctgtggagctgaaccccacccagaaggacctggtgctgaagattgctgagctgctgtgcaagaatgatgtgacagatggccgggccaagtactgggtggagagagctgccaagctgtttcctggcagccctgccatctacaagctgaaggagcagctgctggactgtgagggggaggatggctggaacaagctgtttgacctgatccagagcgagctgtatgtgcggccagatgatgtgcacgtgaacatccggctggtggagctgtaccgcagcaccaagaggctgaaggatgctgtggcccactgccatgaagctgagagaaatattgccctgcggagcagcctggagtggaacagctgtgtggtgcagaccctgaaggagtacctggagagcctgcagtgcctggagagtgacaagagtgactggcaggccaccaacacagacctgctgctggcctatgccaacctgatgctgctgaccctgagcaccagagatgtgcaggagaaccgggagctgctggagagctttgacagcgccctgcagagcgccaagagcagcctgggcggcaatgatgagctgagcgccaccttcctggagatgaagggccacttctacatgtatgccggcagcctgctgctgaagatgggccagcacggcaacaacgtgcagtggagggccctgtctgagctggccgccctgtgctacctgattgccttccaggtgccccggcccaagatcaagctgcgggagggcaaggccggccagaacctgctggagatgatggcctgtgaccggctgagccagagcggccacatgctgctgagcctgagccggggcaagcaggacttcctgaaggaggtggtggagacctttgccaacaagattggccagagcgccctgtatgatgccctcttcagcagccagagccccaaggacaccagcttcctgggcagtgatgacatcggcaagattgatgtgcaggagcctgagctggaggacctggcccgctatgatgtgggcgccatccgggcccacaacggcagcctgcagcacctgacctggctgggcctgcagtggaacagcctgcctgccctgcccggcatcaggaagtggctgaagcagctgttccaccggctgccccatgagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccttccctgtgtgcaagcagctgtgcacagagcggcagaagtcctggtgggatgctgtgtgcaccctcatccacaggaaggctgtgcccggcaacctggccaagctgcggctgctggtgcagcacgagatcaacaccctgcgggcccaggagaagcacggcctgcagcctgccctgctggtgcactgggccaagtacctgcagaagacaggcagcggcctgaacagcttctacggccagctggagtacatcggccgctctgtgcactactggaagaaggtgctgcccctgctgaagatcatcaagaagaacagcatccctgagcccatcgaccccctcttcaagcacttccacagcgtggacatccaggccagcgagatcgtggagtatgaggaggatgcccacatcacctttgccatgctggatgctgtgaatggaaatattgaagatgctgtgacagcctttgagagcatcaagtctgtggtgtcctactggaacctggccctgatcttccacaggaaggccgaggacattgaaaatgatgccctgagccctgaggagcaggaggagtgcaggaactacctgaccaagacccgggactacctgatcaagatcattgatgatggagacagcaacctgtctgtggtgaagaagctgcctgtgcccctggagagcgtgaagcagatgctgaacagcgtgatgcaggagctggaggactacagcgagggcggccccctgtacaagaatggcagcctgagaaatgctgacagcgagatcaagcacagcacccccagccccaccaagtacagcctgagccccagcaagagctacaagtacagccctgagaccccaccccgctggacagaagatagaaacagcctgctgaacatgatctgccagcaggtggaggccatcaagaaggagatgcaggagctgaagctgaacagcagcaagagcgccagccgccaccgctggcccacagagaactacggccctgacagcgtgcctgatggctaccagggcagccagaccttccacggggcccccctgacagaagctgcccaccgccacttcaccatcgagaagcatggagacagcaagtggatcatctaccgcttcaccaagcagctgtgtggcacagagcgggcccgggccaagatctcctag

SEQ ID NO: 167116 - DNA, 459 bp, Artificial Sequence
  Description of Artificial Sequence: Synthetic coding sequence
atgtggagcggcaccagcccccgctgctgggtgagcccccggcggctggaccgctacatctgcacctacatcaacgtgcaggagcgggaccccaaggcccaccgcttcctgggcctgctgtatgagctggaggagaacacagagaaggctgtggagtgctacagaagatctgtggagctgaaccccacccagaaggacctggtgctgaagattgctgagctgctgtgcaagaatgatgtgacagatggccgggccaagtactgggtggagcgggccgccaagctgtttcctggcagccctgccatctacaagctgaaggagcagctgctggactgtgaaggagaagatggctggaacaagctgtttgacctgatccagagcgagctgtatgtgcggccagatgatgtgcacgtgaacatccggctggtggagctgtaccgcagcaccaagaggctgtag

SEQ ID NO: 167117 - DNA, 2715 bp, Artificial Sequence; identical to SEQ ID NO: 167115
  Description of Artificial Sequence: Synthetic coding sequence

SEQ ID NO: 167118 - DNA, 5298 bp, Artificial Sequence; identical to SEQ ID NO: 167114
  Description of Artificial Sequence: Synthetic coding sequence

SEQ ID NO: 167119 - DNA, 2715 bp, Artificial Sequence; identical to SEQ ID NO: 167115
  Description of Artificial Sequence: Synthetic coding sequence

SEQ ID NO: 167120 - DNA, 5298 bp, Artificial Sequence
  Description of Artificial Sequence: Synthetic coding sequence
atgaggaggagcaaggcagatgtggagagatatgtggcctctgtgctgggcctgacccccagcccccggcagaagtccatgaagggcttctactttgccaagctgtactatgaggccaaggagtatgacctggccaagaagtacatctgcacctacatcaacgtgcaggagcgggaccccaaggcccaccgcttcctgggcctgctgtatgagctggaggagaacacagagaaggctgtggagtgctaccgccgctctgtggagctgaaccccacccagaaggacctggtgctgaagattgctgagctgctgtgcaagaatgatgtgacagatggccgggccaagtactgggtggagagagctgccaagctgtttcctggcagccctgccatctacaagctgaaggagcagctgctggactgtgagggggaggatggctggaacaagctgtttgacctgatccagagcgagctgtatgtgcggccagatgatgtgcacgtgaacatccggctggtggagctgtaccgcagcaccaagaggctgaaggatgctgtggcccactgccatgaagctgagagaaatattgccctgcggagcagcctggagtggaacagctgtgtggtgcagaccctgaaggagtacctggagagcctgcagtgcctggagagtgacaagagtgactggagggccaccaacacagacctgctgctggcctatgccaacctgatgctgctgaccctgagcaccagagatgtgcaggagaaccgggagctgctggagagctttgacagcgccctgcagagcgccaagagcagcctgggcggcaatgatgagctgagcgccaccttcctggagatgaagggccacttctacatgtatgccggcagcctgctgctgaagatgggccagcacggcaacaacgtgcagtggagggccctgtctgagctggccgccctgtgctacctgattgccttccaggtgccccggcccaagatcaagctgcgggagggcaaggccggccagaacctgctggagatgatggcctgtgaccggctgagccagagcggccacatgctgctgagcctgagccggggcaagcaggacttcctgaaggaggtggtggagacctttgccaacaagattggccagagcgccctgtatgatgccctcttcagcagccagagccccaaggacaccagcttcctgggcagtgatgacatcggcaagattgatgtgcaggagcctgagctggaggacctggcccgctatgatgtgggcgccatccgggcccacaacggcagcctgcagcacctgacctggctgggcctgcagtggaacagcctgcctgccctgcccggcatcaggaagtggctgaagcagctgttccaccggctgccccatgagaccagccggctggagaccaatgcccctgagagcatctgcatcctggacctggaggtgttcctgctgggcgtggtgtacaccagccacctgcagctgaaggagaagtgcaacagccaccacagcagctaccagcccctgtgcctgcccttccctgtgtgcaagcagctgtgcacagagcggcagaagtcctggtgggatgctgtgtgcaccctcatccacaggaaggctgtgcccggcaacctggccaagctgcggctgctggtgcagcacgagatcaacaccctgcgggcccaggagaagcacggcctgcagcctgccctgctggtgcactgggccaagtacctgcagaagacaggcagcggcctgaacagcttctacggccagctggagtacatcggccgctctgtgcactactggaagaaggtgctgcccctgctgaagatcatcaagaagaacagcatccctgagcccatcgaccccctcttcaagcacttccacagcgtggacatccaggccagcgagatcgtggagtatgaggaggatgcccacatcacctttgccatcctggatgctgtgaatggaaatattgaagatgctgtgacagcctttgagagcatcaagtctgtggtgtcctactggaacctggccctgatcttccacaggaaggccgaggacattgaaaatgatgccctgagccctgaggagcaggaggagtgcaggaactacctgaccaagacccgggactacctgatcaagatcattgatgatggagacagcaacctgtctgtggtgaagaagctgcctgtgcccctggagagcgtgaagcagatgctgaacagcgtgatgcaggagctggaggactacagcgagggcggccccctgtacaagaatggcagcctgagaaatgctgacagcgagatcaagcacagcacccccagccccaccaagtacagcctgagccccagcaagagctacaagtacagccctgagaccccaccccgctggacagaagatagaaacagcctgctgaacatgatctgccagcaggtggaggccatcaagaaggagatgcaggagctgaagctgaacagcagcaagagcgccagccgccaccgctggcccacagagaactacggccctgacagcgtgcctgatggctaccagggcagccagaccttccacggggcccccctgactgtggccaccaccggccccagcgtgtactacagccagagccctgcctacaacagccagtacctgctgcggcctgctgccaacgtgacccccaccaagggcagcagcaacacagagttcaagagcaccaaggagggcttcagcatccctgtgtctgcagatggcttcaagtttggcatcagcgagcccggcaaccaggagaagaagcgggagaagcccctggagaatgacaccggcctgcaggcccaggacatccggggcaggaagaagggccggggcgtcatcttcggccagaccagcagcaccttcacctttgctgatgtggccaagagcaccagcggggagggcttccagtttgggaagaaggacctgaacttcaagggcttcagcggggccggggagaagctgttcagcagccgctatggcaagatggccaacaaggccaacaccagcggggactttgagaaggatgatgatgcctacaagacagaggacagtgatgacatccactttgagcctgtggtgcagatgcctgagaaggtggagctggtgactggagaggagggggagaaggtgctgtacagccagggcgtgaagctgttccgctttgatgctgaggtgcggcagtggaaggagcggggcctgggcaacctgaagatcctgaagaatgaggtgaatggcaagctgaggatgctgatgaggcgggagcaggtgctgaaggtgtgtgccaaccactggatcaccaccaccatgaacctgaagcccctgagcggcagtgaccgggcctggatgtggagcgccagtgacttcagtgatggagatgccaagctggagcggctggccgccaagttcaagaccccagagctggccgaggagttcaagcagaagtttgaggagtgccagaggctgctgctggacatccccctgcagaccccccacaagctggtggacaccggccgggccgccaagctgatccagagagctgaggagatgaagagcggcctgaaggacttcaagaccttcctgaccaatgaccagaccaaggtgacagaggaggagaacaagggcagcggcactggagtggccggggccagtgacaccaccatcaagcccaatgctgagaacacaggccccaccctggagtgggacaactatgacctgagagaagatgccctggatgattctgtgagcagcagctctgtgcacgccagccccctggccagcagccctgtgaggaagaacctcttccgctttgatgagagcaccaccggcagcaacttctccttcaagagcgccctgagcctgagcaagagccctgccaagctgaaccagagcggcacctctgtgggcacagatgaggagagcgtggtgacccaggaggaggagagagatggccagtactttgagcctgtggtgcccctgcctgacctggtggaggtgagcagcggggaggagaatgagcaggtggtgttcagccacagagctgagatctaccgctatgacaaggatgtgggccagtggaaggagcggggcatcggggacatcaagatcctgcagaactatgacaacaagcaggtgcgcatcgtgatgagaagagaccaggtgctgaagctgtgtgccaaccaccgcatcaccccagacatgagcctgcagaacatgaagggcacagagcgggtgtgggtgtggacagcctgtgactttgctgatggagagaggaaggtggagcacctggccgtgcgcttcaagctgcaggatgtggccgacagcttcaagaagatctttgatgaggccaagacagcccaggagaaggacagcctcatcaccccccacgtgagccgcagcagcaccccccgggagagcccctgtgggaagattgctgtggccgtgctggaggagatcacccgggagaggacagatgtgatccagggagatgatgtggctgatgctgccagcgaggtggaggtgagcagcaccagcgagaccaccaccaaggctgtggtgtccccacccaagtttgtgtttgtgtctgagagcgtgaagaggatcttcagcagcgagaagagcaagccctttgcctttggaaacagcagcgccaccggcagcctgtttggcttctccttcaatgcccccctgaagagcaacaacagcgagaccagctctgtggcccagagcggcagcgagagcaaggtggagcccaagaagtgtgagctgagcaagaacagcgacatcgagcagagcagtgacagcaaggtgaagaacctgagcgccagcttccccacagaggagagcagcatcaactacaccttcaagaccccagagaaggagccccccctgtggcatgctgagttcaccaaggaggagctggtgcagaagctgcggagcaccaccaagtctgctgaccacctgaatggcctgctgcgggagattgaggccaccaatgctgtgctgatggagcagatcaagctgctgaagtctgagatccggcggctggagaggaaccaggagcgggagaagtctgctgccaacctggagtacctgaagaatgtgctgctgcagttcatcttcctgaagccaggcagcgagcgggagcggctgctgcctgtgatcaacaccatgctgcagctgagccctgaggagaagggcaagctggccgctgtggcccaggatgaggaggagaaccccagccgcagcagcggctag

SEQ ID NO: 167121 - DNA, 1407 bp, Artificial Sequence
  Description of Artificial Sequence: Synthetic coding sequence
atgggcacagccaccccagatggccgggaggaccaggagcggctgtgggtgtctgtggaggatgcccagatgcacacagtgaccatctggctgactgtgcggccagacatgacagtggccagcctgaaggacatggtgttcctggactatggcttcccccctgtgctgcagcagtgggtgattggccagaggctggcccgggaccaggagaccctgcacagccatggagtgcggcagaatggagacagcgcctacctgtacctgctgagcgccaggaacaccagcctgaacccccaggagctgcagcgggagcggcagctgaggatgctggaggacctgggcttcaaggacctgaccctgcagccccggggccccctggagcccggcccccccaagccaggagtgccccaggagcccggccggggccagccagatgctgtgcctgagcccccacctgtgggctggcagtgccccggctgcaccttcatcaacaagcccaccaggcctggctgtgagatgtgctgccgggcccggcctgaggcctaccaggtgcctgccagctaccagccagatgaggaggagcgggcccggctggccggggaggaggaggccctgcggcagtaccagcagaggaagcagcagcagcaggagggcaactacctgcagcacgtgcagctggaccagaggagcctggtgctgaacacagagccagcagaatgtcctgtgtgctacagcgtgctggcccctggagaggccgtggtgctgagagaatgtctgcacaccttctgcagagaatgtctgcagggcaccatccggaacagccaggaggccgaggtgtcctgccccttcatcgacaacacctacagctgcagcggcaagctgctggagcgggagatcaaggccctgctgaccccagaggactaccagcgcttcctggacctgggcatcagcattgctgagaacagaagtgccttctcctaccactgcaagaccccagactgcaagggctggtgcttctttgaagatgatgtgaatgagttcacctgccctgtgtgcttccacgtgaactgcctgctgtgcaaggccatccacgagcagatgaactgcaaggagtaccaggaggacctggccctgcgggcccagaatgatgtggccgcccggcagaccacagagatgctgaaggtgatgctgcagcagggcgaggccatgcgctgcccccagtgccagatcgtggtgcagaagaaggatggctgtgactggatccgctgcaccgtgtgccacacagagatctgctgggtgaccaagggcccccgctggggccctgggggccctggggacaccagcggcggctgccgctgccgggtgaatggcatcccctgccaccccagctgccagaactgccactag

SEQ ID NO: 167122 - DNA, 1533 bp, Artificial Sequence
  Description of Artificial Sequence: Synthetic coding sequence
atggatgagaagaccaagaaggccgaggagatggccctgagcctgaccagggctgtggccggaggagatgagcaggtggccatgaagtgtgccatctggctggccgagcagagggtgcccctgtctgtgcagctgaagccagaggtgagccccacccaggacatccggctgtgggtgtctgtggaggatgcccagatgcacacagtgaccatctggctgactgtgcggccagacatgacagtggccagcctgaaggacatggtgttcctggactatggcttcccccctgtgctgcagcagtgggtgattggccagaggctggcccgggaccaggagaccctgcacagccatggagtgcggcagaatggagacagcgcctacctgtacctgctgagcgccaggaacaccagcctgaacccccaggagctgcagcgggagcggcagctgaggatgctggaggacctgggcttcaaggacctgaccctgcagccccggggccccctggagcccggcccccccaagccaggagtgccccaggagcccggccggggccagccagatgctgtgcctgagcccccacctgtgggctggcagtgccccggctgcaccttcatcaacaagcccaccaggcctggctgtgagatgtgctgccgggcccggcctgaggcctaccaggtgcctgccagctaccagccagatgaggaggagcgggcccggctggccggggaggaggaggccctgcggcagtaccagcagaggaagcagcagcagcaggagggcaactacctgcagcacgtgcagctggaccagaggagcctggtgctgaacacagagccagcagaatgtcctgtgtgctacagcgtgctggcccctggagaggccgtggtgctgagagaatgtctgcacaccttctgcagagaatgtctgcagggcaccatccggaacagccaggaggccgaggtgtcctgccccttcatcgacaacacctacagctgcagcggcaagctgctggagcgggagatcaaggccctgctgaccccagaggactaccagcgcttcctggacctgggcatcagcattgctgagaacagaagtgccttctcctaccactgcaagaccccagactgcaagggctggtgcttctttgaagatgatgtgaatgagttcacctgccctgtgtgcttccacgtgaactgcctgctgtgcaaggccatccacgagcagatgaactgcaaggagtaccaggaggacctggccctgcgggcccagaatgatgtggccgcccggcagaccacagagatgctgaaggtgatgctgcagcagggcgaggccatgcgctgcccccagtgccagatcgtggtgcagaagaaggatggctgtgactggatccgctgcaccgtgtgccacacagagatctgctgggtgaccaagggcccccgctggggccctgggggccctggggacaccagcggcggctgccgctgccgggtgaatggcatcccctgccaccccagctgccagaactgccactag

SEQ ID NO: 167123 - DNA, 1011 bp, Artificial Sequence
  Description of Artificial Sequence: Synthetic coding sequence
atggatgagaagaccaagaaggccgaggagatggccctgagcctgaccagggctgtggccggaggagatgagcaggtggccatgaagtgtgccatctggctggccgagcagagggtgcccctgtctgtgcagctgaagccagaggtgagccccacccaggacatccggctgtgggtgtctgtggaggatgcccagatgcacacagtgaccatctggctgactgtgcggccagacatgacagtggccagcctgaaggacatggtgttcctggactatggcttcccccctgtgctgcagcagtgggtgattggccagaggctggcccgggaccaggagaccctgcacagccatggagtgcggcagaatggagacagcgcctacctgtacctgctgagcgccaggaacaccagcctgaacccccaggagctgcagcgggagcggcagctgaggatgctggaggacctgggcttcaaggacctgaccctgcagccccggggccccctggagcccggcccccccaagccaggagtgccccaggagcccggccggggccagccagatgctgtgcctgagcccccacctgtgggctggcagtgccccggctgcaccttcatcaacaagcccaccaggcctggctgtgagatgtgctgccgggcccggcctgaggcctaccaggtgcctgccagctaccagccagatgaggaggagcgggcccggctggccggggaggaggaggccctgcggcagtaccagcagaggaagcagcagcagcaggagggcaactacctgcagcacgtgcagctggaccagaggagcctggtgctgaacacagagccagcagaatgtcctgtgtgctacagcgtgctggcccctggagaggccgtggtgctgcggagcgcctgccgggcccccagcgccacagccaggagaagaagaagccctgcccccagcctgaccacccccacccgggcccgggccagctgctggaggggccgcagccgccgctcctag

SEQ ID NO: 167124 - DNA, 792 bp, Artificial Sequence
  Description of Artificial Sequence: Synthetic coding sequence
atggatgagaagaccaagaaggccgaggagatggccctgagcctgaccagggctgtggccggaggagatgagcaggtggccatgaagtgtgccatctggctggccgagcagagggtgcccctgtctgtgcagctgaagccagaggtgagccccacccaggacatccgcagcagaggagagaagacagaggaggtgggggaggtgcgggaggtgcctgaccacggcggcccccgggtgctgccccgggtggacagcaagagctctgtggagcccctggagggccccaactggctgtgggtgtctgtggaggatgcccagatgcacacagtgaccatctggctgactgtgcggccagacatgacagtggccagcctgaaggacatggtgttcctggactatggcttcccccctgtgctgcagcagtgggtgattggccagaggctggcccgggaccaggagaccctgcacagccacggcgtgcggcagaatggagacagcgcctacctgtacctgctgagcgccaggaacaccagcctgaacccccaggagctgcagcgggagcggcagctgaggatgctggaggacctgggcttcaaggacctgaccctgcagccccggggccccctggagcccggcccccccaagccaggagtgccccaggagcccggccggggccagccagatgctgtgcctgagcccccacctgtgggctggcagtgccccggctgcaccttcatcaacaagcccacccggcccggctgtgagatgtgctgccgggcccggcctgagtag

SEQ ID NO: 167125 - DNA, 819 bp, Artificial Sequence
  Description of Artificial Sequence: Synthetic coding sequence
atggatgagaagaccaagaaggccgaggagatggccctgagcctgaccagggctgtggccggaggagatgagcaggtggccatgaagtgtgccatctggctggccgagcagagggtgcccctgtctgtgcagctgaagccagaggtgagccccacccaggacatccggctgtgggtgtctgtggaggatgcccagatgcacacagtgaccatctggctgactgtgcggccagacatgacagtggccagcctgaaggacatggtgttcctggactatggcttcccccctgtgctgcagcagtgggtgattggccagaggctggcccgggaccaggagaccctgcacagccatggagtgcggcagaatggagacagcgcctacctgtacctgctgagcgccaggaacaccagcctgaacccccaggagctgcagcgggagcggcagctgaggatgctggaggacctgggcttcaaggacctgaccctgcagccccggggccccctggagcccggcccccccaagccaggagtgccccaggagcccggccggggccagccagatgctgtgcctgagcccccacctgtgggctggcagtgccccggctgcaccttcatcaacaagcccaccaggcctggctgtgagatgtgctgccgggcccggcctgaggcctaccaggtgcctgccagctaccagccagatgaggaggagcgggcccggctggccggggaggaggaggccctgcggcagtaccagcagggcgtgcctgctggccaccacccccagcagcccggcggcggcggcctgctgcccctgcactag

SEQ ID NO: 167126 - DNA, 354 bp, Artificial Sequence
  Description of Artificial Sequence: Synthetic coding sequence
atggatgagaagaccaagaaggccgaggagatggccctgagcctgaccagggctgtggccggaggagatgagcaggtggccatgaagtgtgccatctggctggccgagcagagggtgcccctgtctgtgcagctgaagccagaggtgagccccacccaggacatccggctgtgggtgtctgtggaggatgcccagatgcacacagtgaccatctggctgactgtgcggccagacatgacagtggccagcctgaaggacatggtgttcctggactatggcttcccccctgtgctgcagcagtgggtgattggccagaggctggcccgggaccaggagaccctgcacagccactag

SEQ ID NO: 167127 - DNA, 768 bp, Artificial Sequence
  Description of Artificial Sequence: Synthetic coding sequence
tgagaaatggccctgagcctgaccagggctgtggccggaggagatgagcaggtggccatgaagtgtgccatctggctggccgagcagagggtgcccctgtctgtgcagctgaagccagaggtgagccccacccaggacatccgcagcagaggagagaagacagaggaggtgggggaggtgcgggaggtgcctgaccacggcggcccccgggtgctgccccgggtggacagcaagagctctgtggagcccctggagggccccaactggctgtgggtgtctgtggaggatgcccagatgcacacagtgaccatctggctgactgtgcggccagacatgacagtggccagcctgaaggacatggtgttcctggactatggcttcccccctgtgctgcagcagtgggtgattggccagaggctggcccgggaccaggagaccctgcacagccacggcgtgcggcagaatggagacagcgcctacctgtacctgctgagcgccaggaacaccagcctgaacccccaggagctgcagcgggagcggcagctgaggatgctggaggacctgggcttcaaggacctgaccctgcagccccggggccccctggagcccggcccccccaagccaggagtgccccaggagcccggccggggccagccagatgctgtgcctgagcccccacctgtgggctggcagtgccccggctgcaccttcatcaacaagcccacccggcccggctgtgagatgtgctgccgggcccggcctgagtag

SEQ ID NO: 167128 - DNA, 819 bp, Artificial Sequence; identical to SEQ ID NO: 167125
  Description of Artificial Sequence: Synthetic coding sequence

SEQ ID NO: 167129 - DNA, 4830 bp, Artificial Sequence
  Description of Artificial Sequence: Synthetic coding sequence
atgaacagccctgtggaccccggggcccggcaggccctgaggaagaagcccccagagaggaccccagaggacctgaacaccatctacagctacctgcacggcatggagatcctgagcaacctgcgggagcaccagctgcggctgatgtctgcccgggcccgctatgagcgctacagcggcaaccaggtgctcttctgcagcgagaccatcgcccgctgctggtacatcctgctgagcggctctgtgctggtgaagggctccatggtgctgcccccctgcagctttgggaagcagtttggaggcaagaggggctgtgactgcctggtgctggagcccagcgagatgattgtggtggagaatgccaaggacaatgaagattccatcctgcagcgggagatcccagcccggcagagcagaagacgcttcaggaagatcaactacaagggggagcggcagaccatcacagatgatgtggaggtgaacagctacctgagcctgcctgctgacctgaccaagatgcacctgacagagaacccccacccccaggtgacccacgtgagcagcagccagagcggctgcagcatcgccagtgacagcggcagcagcagcctgagtgacatctaccaggccacagaaagtgaggtgggagatgtggacctgacccggctgcctgagggccctgtggacagtgaagatgatgaggaggaggatgaggagattgacagaacagaccccctgcagggccgggacctggtgcgggagtgcctggagaaggagcctgctgacaagacagatgatgacatcgagcagctgctggagttcatgcaccagctgcctgcctttgccaacatgaccatgtctgtgagaagagagctgtgcagcgtgatgatctttgaggtggtggagcaggccggggccatcatcctggaggatggccaggagctggacagctggtacgtgatcctgaatggaacagtggagatcagccacccagatggcaaggtggagaacctcttcatgggcaacagctttggcatcacccccaccctggacaagcagtacatgcacggcatcgtgaggaccaaggtggatgactgccagtttgtgtgcatcgcccagcaggactactggaggatcctgaaccacgtggagaagaacacccacaaggtggaggaggagggggagatcgtgatggtgcatgagcaccgggagctggacaggagcggcaccaggaagggccacatcgtcatcaaggccaccccagagcggctcatcatgcacctgattgaggagcacagcatcgtggaccccacctacatcgaggacttcctgctgacctaccgcaccttcctggagagccccctggatgtgggcatcaagctgctggagtggttcaagattgacagcctgcgggacaaggtgaccagaattgtgctgctgtgggtgaacaaccacttcaatgactttgaaggagaccctgccatgacccgcttcctggaggagtttgagaagaacctggaggacaccaagatgaatggccacctgcggctgctgaacatcgcctgtgccgccaaggccaagtggaggcaggtggtgctgcagaaggccagccgggagagccccctgcagttcagcctgaatggaggcagcgagaagggcttcggcatctttgtggagggcgtggagcccggcagcaaggctgctgacagcggcctgaagagaggagaccagatcatggaggtgaatggccagaactttgagaacatcaccttcatgaaggctgtggagatcctgaggaacaacacccacctggccctgactgtgaagaccaacatctttgtgttcaaggagctgctcttcagaacagagcaggagaagtctggagtgccccacatccccaagattgctgagaagaagagcaacagacacagcatccagcacgtgcctggggacatcgagcagaccagccaggagaagggcagcaagaaggtgaaggccaacacagtgtctgggggcaggaacaagatcaggaagatcctggacaagacccgcttcagcatcctgccccccaagctgttcagtgatggcggcctgagccagagccaggatgacagcatcgtgggcaccaggcactgccgccacagcctggccatcatgcccatccctggcaccctgagcagcagcagcccagacctgctgcagcccaccacctccatgctggacttcagcaaccccagcgacatcccagaccaggtgatccgggtcttcaaggtggaccagcagagctgctacatcatcatcagcaaggacaccacagccaaggaggtggtgttccacgctgtgcatgaatttggcctgactggagccagtgacacctacagcctgtgtgaggtgtctgtgaccccagagggcgtcatcaagcagaggcggctgcctgaccagttcagcaagctggccgaccgcatccagctgaatggccgctactacctgaagaacaacatggagacagagaccctgtgcagtgatgaagatgcccaggagctggtgaaggagagccagctgtccatgctgcagctgagcaccatcgaggtggccacccagctgtccatgagggactttgacctcttcagaaatattgagcccacagagtacattgatgacctcttcaagctgaacagcaagacaggcaacacccacctgaagagatttgaggacatcgtgaaccaggagaccttctgggtggccagcgagatcctgacagaggccaaccagctgaagaggatgaagatcatcaagcacttcatcaagatcgccctgcactgccgggagtgcaagaacttcaacagcatgtttgccatcatcagcggcctgaacctggcctctgtggcccggctgcggggcacctgggagaagctgcccagcaaatatgagaagcacctgcaggacctgcaggacatctttgaccccagcaggaacatggccaagtacagaaacatcctgagcagccagagcatgcagccccccatcatccccctcttccctgtggtgaagaaggacatgaccttcctgcacgagggcaatgacagcaaggtggatggcctggtgaactttgagaagctgaggatgatcagcaaggagatccggcaggtggtgaggatgaccagcgccaacatggaccctgccatgatgttccggcagaggaagaagcgctggaggagcctgggcagcctgagccagggcagcaccaacagcaacatgctggatgtgcagggcggggcccacaagaagagggcccggcgcagcagcctgctgaatgccaagaagctgtatgaagatgcccagatggccaggaaggtgaagcagtacctgagcagcctggatgtggagacagatgaggagaagttccagatgatgagcctgcagtgggagcccgcctacggcaccctgaccaagaacctgtctgagaagaggtctgccaagagcagcgagatgagccctgtgcccatgaggtctgctggccagaccaccaaggcccacctgcaccagccccaccgggtgtcccaggtgctgcaggtgcctgctgtgaacctgcaccccatcaggaagaagggccagaccaaggaccctgccctgaacaccagcctgccccagaaggtgctgggcaccacagaggagatcagcggcaagaagcacacagaggacaccatctctgtggccagcagcctgcacagcagccccccagccagcccccagggcagcccccacaagggctacaccctcatccccagcgccaagagtgacaacctgagtgacagcagccacagcgagatcagcagccgcagcagcatcgtgagcaactgcagcgtggacagcatgtctgctgccctgcaggatgagcgctgcagcagccaggccctggccgtgcctgagagcactggagccctggagaagacagagcacgccagcggcatcggggaccacagccagcacggccctggctggaccctgctgaagcccagcctcatcaagtgcctggccgtgagcagctctgtgtccaatgaggagatcagccaggagcacatcatcattgaagctgctgacagcggccggggctcctggaccagctgcagcagcagcagccatgacaacttccagagcctgcccaaccccaagtcctgggacttcctgaacagctaccgccacacccacctggatgaccccatcgccgaggtggagcccacagacagcgagccctacagctgcagcaagagctgcagcaggacctgtggccagtgcaagggcagcctggagaggaagtcctggaccagcagcagcagcctgagtgacacctatgagcccaactatggaacagtgaagcagagggtgctggagagcaccccagctgagagcagcgagggcctggaccccaaggatgccacagatcctgtgtacaagacagtgaccagcagcacagagaagggcctcatcgtgtactgtgtgaccagccccaagaaggatgaccgctaccgggagcccccacccaccccacctggctacctgggcatcagcctggccgacctgaaggagggcccccacacccacctgaagcccccagactacagcgtggccgtgcagaggagcaagatgatgcacaacagcctgagccggctgcccccagccagcctgagcagcaacctggtggcctgtgtgcccagcaagatcgtgacccagccccagaggcacaacctgcagcccttccaccccaagctgggagatgtgacagatgctgacagcgaggctgatgaaaatgagcaggtgtctgctgtgtag

SEQ ID NO: 167130 - DNA, 4530 bp, Artificial Sequence
  Description of Artificial Sequence: Synthetic coding sequence
atgaacagccctgtggaccccggggcccggcaggccctgaggaagaagcccccagagaggaccccagaggacctgaacaccatctacagctacctgcacggcatggagatcctgagcaacctgcgggagcaccagctgcggctgatgtctgcccgggcccgctatgagcgctacagcggcaaccaggtgctcttctgcagcgagaccatcgcccgctgctggtacatcctgctgagcggctctgtgctggtgaagggctccatggtgctgcccccctgcagctttgggaagcagtttggaggcaagaggggctgtgactgcctggtgctggagcccagcgagatgattgtggtggagaatgccaaggacaatgaagattccatcctgcagcgggagatcccagcccggcagagcagaagacgcttcaggaagatcaactacaagggggagcggcagaccatcacagatgatgtggaggtgaacagctacctgagcctgcctgctgacctgaccaagatgcacctgacagagaacccccacccccaggtgacccacgtgagcagcagccagagcggctgcagcatcgccagtgacagcggcagcagcagcctgagtgacatctaccaggccacagaaagtgaggtgggagatgtggacctgacccggctgcctgagggccctgtggacagtgaagatgatgaggaggaggatgaggagattgacagaacagaccccctgcagggccgggacctggtgcgggagtgcctggagaaggagcctgctgacaagacagatgatgacatcgagcagctgctggagttcatgcaccagctgcctgcctttgccaacatgaccatgtctgtgagaagagagctgtgcagcgtgatgatctttgaggtggtggagcaggccggggccatcatcctggaggatggccaggagctggacagctggtacgtgatcctgaatggaacagtggagatcagccacccagatggcaaggtggagaacctcttcatgggcaacagctttggcatcacccccaccctggacaagcagtacatgcacggcatcgtgaggaccaaggtggatgactgccagtttgtgtgcatcgcccagcaggactactggaggatcctgaaccacgtggagaagaacacccacaaggtggaggaggagggggagatcgtgatggtgcatgagcaccgggagctggacaggagcggcaccaggaagggccacatcgtcatcaaggccaccccagagcggctcatcatgcacctgattgaggagcacagcatcgtggaccccacctacatcgaggacttcctgctgacctaccgcaccttcctggagagccccctggatgtgggcatcaagctgctggagtggttcaagattgacagcctgcgggacaaggtgaccagaattgtgctgctgtgggtgaacaaccacttcaatgactttgaaggagaccctgccatgacccgcttcctggaggagtttgagaagaacctggaggacaccaagatgaatggccacctgcggctgctgaacatcgcctgtgccgccaaggccaagtggaggcaggtggtgctgcagaaggccagccgggagagccccctgcagttcagcctgaatggaggcagcgagaagggcttcggcatctttgtggagggcgtggagcccggcagcaaggctgctgacagcggcctgaagagaggagaccagatcatggaggtgaatggccagaactttgagaacatcaccttcatgaaggctgtggagatcctgaggaacaacacccacctggccctgactgtgaagaccaacatctttgtgttcaaggagctgctcttcagaacagagcaggagaagtctggagtgccccacatccccaagattgctgagaagaagagcaacagacacagcatccagcacgtgcctggggacatcgagcagaccagccaggagaagggcagcaagaaggtgaaggccaacacagtgtctgggggcaggaacaagatcaggaagatcctggacaagacccgcttcagcatcctgccccccaagctgttcagtgatggcggcctgagccagagccaggatgacagcatcgtgggcaccaggcactgccgccacagcctggccatcatgcccatccctggcaccctgagcagcagcagcccagacctgctgcagcccaccacctccatgctggacttcagcaaccccagcgctgtgggcttctactacatcccagaccaggtgatccgggtcttcaaggtggaccagcagagctgctacatcatcatcagcaaggacaccacagccaaggaggtggtgttccacgctgtgcatgaatttggcctgaccggggccagtgacacctacagcctgtgtgaggtgtctgtgaccccagagggcgtcatcaagcagaggcggctgcctgaccagttcagcaagctggccgaccgcatccagctgaatggccgctactacctgaagaacaacatggagacagagaccctgtgcagtgatgaagatgcccaggagctggtgaaggagagccagctgtccatgctgcagctgagcaccatcgaggtggccacccagctgtccatgagggactttgacctcttcaggaacatcgagcccacagagtacattgatgacctcttcaagctgaacagcaagacaggcaacacccacctgaagagatttgaagatattgtgaaccaggagaccttctgggtggccagcgagatcctgacagaggccaaccagctgaagaggatgaagatcatcaagcacttcatcaagatcgccctgcactgccgggagtgcaagaacttcaacagcatgtttgccatcatcagcggcctgaacctggcctctgtggcccggctgcggggcacctgggagaagctgcccagcaaatatgagaagcacctgcaggacctgcaggacatctttgaccccagcaggaacatggccaagtacagaaacatcctgagcagccagagcatgcagccccccatcatccccctcttccctgtggtgaagaaggacatgaccttcctgcacgagggcaatgacagcaaggtggatggcctggtgaactttgagaagctgaggatgatcagcaaggagatccggcaggtggtgaggatgaccagcgccaacatggaccctgccatgatgttccggcagaggaagaagcgctggaggagcctgggcagcctgagccagggcagcaccaacagcaacatgctggatgtgcagggcggggcccacaagaagagggcccggcgcagcagcctgctgaatgccaagaagctgtatgaagatgcccagatggccaggaaggtgaagcagtacctgagcagcctggatgtggagacagatgaggagaagttccagatgatgagcctgcagtgggagcccgcctacggcaccctgaccaagaacctgtctgagaagaggtctgccaagagcagcgagatgagccctgtgcccatgaggtctgctggccagaccaccaaggcccacctgcaccagccccaccgggtgtcccaggtgctgcaggtgcctgctgtgaacctgcaccccatcaggaagaagggccagaccaaggaccctgccctgaacaccagcctgccccagaaggtgctgggcaccacagaggagatcagcggcaagaagcacacagaggacaccatctctgtggccagcagcctgcacagcagccccccagccagcccccagggcagcccccacaagggctacaccctcatccccagcgccaagagtgacaacctgagtgacagcagccacagcgagatcagcagccgcagcagcatcgtgagcaactgcagcgtggacagcatgtctgctgccctgcaggatgagcgctgcagcagccaggccctggccgtgcctgagagcactggagccctggagaagacagaacatgccagcggcattggagaccacagccagcacggccctggctggaccctgctgaagcccagcctcatcaagtgcctggccgtgagcagctctgtgtccaatgaggagatcagccaggagcacatcatcatcgaggccgctgacagcggccggggctcctggaccagctgcagcagcagcagccatgacaacttccagagcctgcccaaccccaagtcctgggacttcctgaacagctaccgccacacccacctggatgaccccatcgccgaggtggagcccacagattctgagccctacagctgcagcaagagctgcagcaggacctgtggccagtgcaagggcagcctggagaggaagtcctggaccagcagcagcagcctgagtgacacctatgagcccaactacggcaccgtgaagcagagggtgctggagagcaccccagctgagagcagcgagggcctggaccccaaggatgccacagatcctgtgtacaagacagtgaccagcagcacagagaagggcctgattgaaaatgagcaggtgtctgctgtgtag

SEQ ID NO: 167131 - DNA, 4530 bp, Artificial Sequence
  Description of Artificial Sequence: Synthetic coding sequence
atgaacagccctgtggaccccggggcccggcaggccctgaggaagaagcccccagagaggaccccagaggacctgaacaccatctacagctacctgcacggcatggagatcctgagcaacctgcgggagcaccagctgcggctgatgtctgcccgggcccgctatgagcgctacagcggcaaccaggtgctcttctgcagcgagaccatcgcccgctgctggtacatcctgctgagcggctctgtgctggtgaagggctccatggtgctgcccccctgcagctttgggaagcagtttggaggcaagaggggctgtgactgcctggtgctggagcccagcgagatgattgtggtggagaatgccaaggacaatgaagattccatcctgcagcgggagatcccagcccggcagagcagaagacgcttcaggaagatcaactacaagggggagcggcagaccatcacagatgatgtggaggtgaacagctacctgagcctgcctgctgacctgaccaagatgcacctgacagagaacccccacccccaggtgacccacgtgagcagcagccagagcggctgcagcatcgccagtgacagcggcagcagcagcctgagtgacatctaccaggccacagaaagtgaggtgggagatgtggacctgacccggctgcctgagggccctgtggacagtgaagatgatgaggaggaggatgaggagattgacagaacagaccccctgcagggccgggacctggtgcgggagtgcctggagaaggagcctgctgacaagacagatgatgacatcgagcagctgctggagttcatgcaccagctgcctgcctttgccaacatgaccatgtctgtgagaagagagctgtgcagcgtgatgatctttgaggtggtggagcaggccggggccatcatcctggaggatggccaggagctggacagctggtacgtgatcctgaatggaacagtggagatcagccacccagatggcaaggtggagaacctcttcatgggcaacagctttggcatcacccccaccctggacaagcagtacatgcacggcatcgtgaggaccaaggtggatgactgccagtttgtgtgcatcgcccagcaggactactggaggatcctgaaccacgtggagaagaacacccacaaggtggaggaggagggggagatcgtgatggtgcatgagcaccgggagctggacaggagcggcaccaggaagggccacatcgtcatcaaggccaccccagagcggctcatcatgcacctgattgaggagcacagcatcgtggaccccacctacatcgaggacttcctgctgacctaccgcaccttcctggagagccccctggatgtgggcatcaagctgctggagtggttcaagattgacagcctgcgggacaaggtgaccagaattgtgctgctgtgggtgaacaaccacttcaatgactttgaaggagaccctgccatgacccgcttcctggaggagtttgagaagaacctggaggacaccaagatgaatggccacctgcggctgctgaacatcgcctgtgccgccaaggccaagtggaggcaggtggtgctgcagaaggccagccgggagagccccctgcagttcagcctgaatggaggcagcgagaagggcttcggcatctttgtggagggcgtggagcccggcagcaaggctgctgacagcggcctgaagagaggagaccagatcatggaggtgaatggccagaactttgagaacatcaccttcatgaaggctgtggagatcctgaggaacaacacccacctggccctgactgtgaagaccaacatctttgtgttcaaggagctgctcttcagaacagagcaggagaagtctggagtgccccacatccccaagattgctgagaagaagagcaacagacacagcatccagcacgtgcctggggacatcgagcagaccagccaggagaagggcagcaagaaggtgaaggccaacacagtgtctgggggcaggaacaagatcaggaagatcctggacaagacccgcttcagcatcctgccccccaagctgttcagtgatggcggcctgagccagagccaggatgacagcatcgtgggcaccaggcactgccgccacagcctggccatcatgcccatccctggcaccctgagcagcagcagcccagacctgctgcagcccaccacctccatgctggacttcagcaaccccagcgccaagggcttcaagaacatcccagaccaggtgatccgggtcttcaaggtggaccagcagagctgctacatcatcatcagcaaggacaccacagccaaggaggtggtgttccacgctgtgcatgaatttggcctgaccggggccagtgacacctacagcctgtgtgaggtgtctgtgaccccagagggcgtcatcaagcagaggcggctgcctgaccagttcagcaagctggccgaccgcatccagctgaatggccgctactacctgaagaacaacatggagacagagaccctgtgcagtgatgaagatgcccaggagctggtgaaggagagccagctgtccatgctgcagctgagcaccatcgaggtggccacccagctgtccatgagggactttgacctcttcaggaacatcgagcccacagagtacattgatgacctcttcaagctgaacagcaagacaggcaacacccacctgaagagatttgaagatattgtgaaccaggagaccttctgggtggccagcgagatcctgacagaggccaaccagctgaagaggatgaagatcatcaagcacttcatcaagatcgccctgcactgccgggagtgcaagaacttcaacagcatgtttgccatcatcagcggcctgaacctggcctctgtggcccggctgcggggcacctgggagaagctgcccagcaaatatgagaagcacctgcaggacctgcaggacatctttgaccccagcaggaacatggccaagtacagaaacatcctgagcagccagagcatgcagccccccatcatccccctcttccctgtggtgaagaaggacatgaccttcctgcacgagggcaatgacagcaaggtggatggcctggtgaactttgagaagctgaggatgatcagcaaggagatccggcaggtggtgaggatgaccagcgccaacatggaccctgccatgatgttccggcagaggaagaagcgctggaggagcctgggcagcctgagccagggcagcaccaacagcaacatgctggatgtgcagggcggggcccacaagaagagggcccggcgcagcagcctgctgaatgccaagaagctgtatgaagatgcccagatggccaggaaggtgaagcagtacctgagcagcctggatgtggagacagatgaggagaagttccagatgatgagcctgcagtgggagcccgcctacggcaccctgaccaagaacctgtctgagaagaggtctgccaagagcagcgagatgagccctgtgcccatgaggtctgctggccagaccaccaaggcccacctgcaccagccccaccgggtgtcccaggtgctgcaggtgcctgctgtgaacctgcaccccatcaggaagaagggccagaccaaggaccctgccctgaacaccagcctgccccagaaggtgctgggcaccacagaggagatcagcggcaagaagcacacagaggacaccatctctgtggccagcagcctgcacagcagccccccagccagcccccagggcagcccccacaagggctacaccctcatccccagcgccaagagtgacaacctgagtgacagcagccacagcgagatcagcagccgcagcagcatcgtgagcaactgcagcgtggacagcatgtctgctgccctgcaggatgagcgctgcagcagccaggccctggccgtgcctgagagcactggagccctggagaagacagaacatgccagcggcattggagaccacagccagcacggccctggctggaccctgctgaagcccagcctcatcaagtgcctggccgtgagcagctctgtgtccaatgaggagatcagccaggagcacatcatcatcgaggccgctgacagcggccggggctcctggaccagctgcagcagcagcagccatgacaacttccagagcctgcccaaccccaagtcctgggacttcctgaacagctaccgccacacccacctggatgaccccatcgccgaggtggagcccacagattctgagccctacagctgcagcaagagctgcagcaggacctgtggccagtgcaagggcagcctggagaggaagtcctggaccagcagcagcagcctgagtgacacctatgagcccaactacggcaccgtgaagcagagggtgctggagagcaccccagctgagagcagcgagggcctggaccccaaggatgccacagatcctgtgtacaagacagtgaccagcagcacagagaagggcctgattggcaagaagcagaccagctacttctag

SEQ ID NO: 167132 - DNA, 4515 bp, Artificial Sequence
  Description of Artificial Sequence: Synthetic coding sequence
atgaacagccctgtggaccccggggcccggcaggccctgaggaagaagcccccagagaggaccccagaggacctgaacaccatctacagctacctgcacggcatggagatcctgagcaacctgcgggagcaccagctgcggctgatgtctgcccgggcccgctatgagcgctacagcggcaaccaggtgctcttctgcagcgagaccatcgcccgctgctggtacatcctgctgagcggctctgtgctggtgaagggctccatggtgctgcccccctgcagctttgggaagcagtttggaggcaagaggggctgtgactgcctggtgctggagcccagcgagatgattgtggtggagaatgccaaggacaatgaagattccatcctgcagcgggagatcccagcccggcagagcagaagacgcttcaggaagatcaactacaagggggagcggcagaccatcacagatgatgtggaggtgaacagctacctgagcctgcctgctgacctgaccaagatgcacctgacagagaacccccacccccaggtgacccacgtgagcagcagccagagcggctgcagcatcgccagtgacagcggcagcagcagcctgagtgacatctaccaggccacagaaagtgaggtgggagatgtggacctgacccggctgcctgagggccctgtggacagtgaagatgatgaggaggaggatgaggagattgacagaacagaccccctgcagggccgggacctggtgcgggagtgcctggagaaggagcctgctgacaagacagatgatgacatcgagcagctgctggagttcatgcaccagctgcctgcctttgccaacatgaccatgtctgtgagaagagagctgtgcagcgtgatgatctttgaggtggtggagcaggccggggccatcatcctggaggatggccaggagctggacagctggtacgtgatcctgaatggaacagtggagatcagccacccagatggcaaggtggagaacctcttcatgggcaacagctttggcatcacccccaccctggacaagcagtacatgcacggcatcgtgaggaccaaggtggatgactgccagtttgtgtgcatcgcccagcaggactactggaggatcctgaaccacgtggagaagaacacccacaaggtggaggaggagggggagatcgtgatggtgcatgagcaccgggagctggacaggagcggcaccaggaagggccacatcgtcatcaaggccaccccagagcggctcatcatgcacctgattgaggagcacagcatcgtggaccccacctacatcgaggacttcctgctgacctaccgcaccttcctggagagccccctggatgtgggcatcaagctgctggagtggttcaagattgacagcctgcgggacaaggtgaccagaattgtgctgctgtgggtgaacaaccacttcaatgactttgaaggagaccctgccatgacccgcttcctggaggagtttgagaagaacctggaggacaccaagatgaatggccacctgcggctgctgaacatcgcctgtgccgccaaggccaagtggaggcaggtggtgctgcagaaggccagccgggagagccccctgcagttcagcctgaatggaggcagcgagaagggcttcggcatctttgtggagggcgtggagcccggcagcaaggctgctgacagcggcctgaagagaggagaccagatcatggaggtgaatggccagaactttgagaacatcaccttcatgaaggctgtggagatcctgaggaacaacacccacctggccctgactgtgaagaccaacatctttgtgttcaaggagctgctcttcagaacagagcaggagaagtctggagtgccccacatccccaagattgctgagaagaagagcaacagacacagcatccagcacgtgcctggggacatcgagcagaccagccaggagaagggcagcaagaaggtgaaggccaacacagtgtctgggggcaggaacaagatcaggaagatcctggacaagacccgcttcagcatcctgccccccaagctgttcagtgatggcggcctgagccagagccaggatgacagcatcgtgggcaccaggcactgccgccacagcctggccatcatgcccatccctggcaccctgagcagcagcagcccagacctgctgcagcccaccacctccatgctggacttcagcaaccccagcgacatcccagaccaggtgatccgggtcttcaaggtggaccagcagagctgctacatcatcatcagcaaggacaccacagccaaggaggtggtgttccacgctgtgcatgaatttggcctgactggagccagtgacacctacagcctgtgtgaggtgtctgtgaccccagagggcgtcatcaagcagaggcggctgcctgaccagttcagcaagctggccgaccgcatccagctgaatggccgctactacctgaagaacaacatggagacagagaccctgtgcagtgatgaagatgcccaggagctggtgaaggagagccagctgtccatgctgcagctgagcaccatcgaggtggccacccagctgtccatgagggactttgacctcttcagaaatattgagcccacagagtacattgatgacctcttcaagctgaacagcaagacaggcaacacccacctgaagagatttgaggacatcgtgaaccaggagaccttctgggtggccagcgagatcctgacagaggccaaccagctgaagaggatgaagatcatcaagcacttcatcaagatcgccctgcactgccgggagtgcaagaacttcaacagcatgtttgccatcatcagcggcctgaacctggcctctgtggcccggctgcggggcacctgggagaagctgcccagcaaatatgagaagcacctgcaggacctgcaggacatctttgaccccagcaggaacatggccaagtacagaaacatcctgagcagccagagcatgcagccccccatcatccccctcttccctgtggtgaagaaggacatgaccttcctgcacgagggcaatgacagcaaggtggatggcctggtgaactttgagaagctgaggatgatcagcaaggagatccggcaggtggtgaggatgaccagcgccaacatggaccctgccatgatgttccggcagaggaagaagcgctggaggagcctgggcagcctgagccagggcagcaccaacagcaacatgctggatgtgcagggcggggcccacaagaagagggcccggcgcagcagcctgctgaatgccaagaagctgtatgaagatgcccagatggccaggaaggtgaagcagtacctgagcagcctggatgtggagacagatgaggagaagttccagatgatgagcctgcagtgggagcccgcctacggcaccctgaccaagaacctgtctgagaagaggtctgccaagagcagcgagatgagccctgtgcccatgaggtctgctggccagaccaccaaggcccacctgcaccagccccaccgggtgtcccaggtgctgcaggtgcctgctgtgaacctgcaccccatcaggaagaagggccagaccaaggaccctgccctgaacaccagcctgccccagaaggtgctgggcaccacagaggagatcagcggcaagaagcacacagaggacaccatctctgtggccagcagcctgcacagcagccccccagccagcccccagggcagcccccacaagggctacaccctcatccccagcgccaagagtgacaacctgagtgacagcagccacagcgagatcagcagccgcagcagcatcgtgagcaactgcagcgtggacagcatgtctgctgccctgcaggatgagcgctgcagcagccaggccctggccgtgcctgagagcactggagccctggagaagacagagcacgccagcggcatcggggaccacagccagcacggccctggctggaccctgctgaagcccagcctcatcaagtgcctggccgtgagcagctctgtgtccaatgaggagatcagccaggagcacatcatcattgaagctgctgacagcggccggggctcctggaccagctgcagcagcagcagccatgacaacttccagagcctgcccaaccccaagtcctgggacttcctgaacagctaccgccacacccacctggatgaccccatcgccgaggtggagcccacagacagcgagccctacagctgcagcaagagctgcagcaggacctgtggccagtgcaagggcagcctggagaggaagtcctggaccagcagcagcagcctgagtgacacctatgagcccaactatggaacagtgaagcagagggtgctggagagcaccccagctgagagcagcgagggcctggaccccaaggatgccacagatcctgtgtacaagacagtgaccagcagcacagagaagggcctgattgaaaatgagcaggtgtctgctgtgtag

SEQ ID NO: 167133 - DNA, 4806 bp, Artificial Sequence
  Description of Artificial Sequence: Synthetic coding sequence
atgaacagccctgtggaccccggggcccggcaggccctgaggaagaagcccccagagaggaccccagaggacctgaacaccatctacagctacctgcacggcatggagatcctgagcaacctgcgggagcaccagctgcggctgatgtctgcccgggcccgctatgagcgctacagcggcaaccaggtgctcttctgcagcgagaccatcgcccgctgctggtacatcctgctgagcggctctgtgctggtgaagggctccatggtgctgcccccctgcagctttgggaagcagtttggaggcaagaggggctgtgactgcctggtgctggagcccagcgagatgattgtggtggagaatgccaaggacaatgaagattccatcctgcagcgggagatcccagcccggcagagcagaagacgcttcaggaagatcaactacaagggggagcggcagaccatcacagatgatgtggaggtgaacagctacctgagcctgcctgctgacctgaccaagatgcacctgacagagaacccccacccccaggtgacccacgtgagcagcagccagagcggctgcagcatcgccagtgacagcggcagcagcagcctgagtgacatctaccaggccacagaaagtgaggtgggagatgtggacctgacccggctgcctgagggccctgtggacagtgaagatgatgaggaggaggatgaggagattgacagaacagaccccctgcagggccgggacctggtgcgggagtgcctggagaaggagcctgctgacaagacagatgatgacatcgagcagctgctggagttcatgcaccagctgcctgcctttgccaacatgaccatgtctgtgagaagagagctgtgcagcgtgatgatctttgaggtggtggagcaggccggggccatcatcctggaggatggccaggagctggacagctggtacgtgatcctgaatggaacagtggagatcagccacccagatggcaaggtggagaacctcttcatgggcaacagctttggcatcacccccaccctggacaagcagtacatgcacggcatcgtgaggaccaaggtggatgactgccagtttgtgtgcatcgcccagcaggactactggaggatcctgaaccacgtggagaagaacacccacaaggtggaggaggagggggagatcgtgatggtgcatgagcaccgggagctggacaggagcggcaccaggaagggccacatcgtcatcaaggccaccccagagcggctcatcatgcacctgattgaggagcacagcatcgtggaccccacctacatcgaggacttcctgctgacctaccgcaccttcctggagagccccctggatgtgggcatcaagctgctggagtggttcaagattgacagcctgcgggacaaggtgaccagaattgtgctgctgtgggtgaacaaccacttcaatgactttgaaggagaccctgccatgacccgcttcctggaggagtttgagaagaacctggaggacaccaagatgaatggccacctgcggctgctgaacatcgcctgtgccgccaaggccaagtggaggcaggtggtgctgcagaaggccagccgggagagccccctgcagttcagcctgaatggaggcagcgagaagggcttcggcatctttgtggagggcgtggagcccggcagcaaggctgctgacagcggcctgaagagaggagaccagatcatggaggtgaatggccagaactttgagaacatcaccttcatgaaggctgtggagatcctgaggaacaacacccacctggccctgactgtgaagaccaacatctttgtgttcaaggagctgctcttcagaacagagcaggagaagtctggagtgccccacatccccaagattgctgagaagaagagcaacagacacagcatccagcacgtgcctggggacatcgagcagaccagccaggagaagggcagcaagaaggtgaaggccaacacagtgtctgggggcaggaacaagatcaggaagatcctggacaagacccgcttcagcatcctgccccccaagctgttcagtgatggcggcctgagccagagccaggatgacagcatcgtgggcaccaggcactgccgccacagcctggccatcatgcccatccctggcaccctgagcagcagcagcccagacctgctgcagcccaccacctccatgctggacttcagcaaccccagcgacatcccagaccaggtgatccgggtcttcaaggtggaccagcagagctgctacatcatcatcagcaaggacaccacagccaaggaggtggtgttccacgctgtgcatgaatttggcctgactggagccagtgacacctacagcctgtgtgaggtgtctgtgaccccagagggcgtcatcaagcagaggcggctgcctgaccagttcagcaagctggccgaccgcatccagctgaatggccgctactacctgaagaacaacatggagacagagaccctgtgcagtgatgaagatgcccaggagctggtgaaggagagccagctgtccatgctgcagctgagcaccatcgaggtggccacccagctgtccatgagggactttgacctcttcagaaatattgagcccacagagtacattgatgacctcttcaagctgaacagcaagacaggcaacacccacctgaagagatttgaggacatcgtgaaccaggagaccttctgggtggccagcgagatcctgacagaggccaaccagctgaagaggatgaagatcatcaagcacttcatcaagatcgccctgcactgccgggagtgcaagaacttcaacagcatgtttgccatcatcagcggcctgaacctggcctctgtggcccggctgcggggcacctgggagaagctgcccagcaaatatgagaagcacctgcaggacctgcaggacatctttgaccccagcaggaacatggccaagtacagaaacatcctgagcagccagagcatgcagccccccatcatccccctcttccctgtggtgaagaaggacatgaccttcctgcacgagggcaatgacagcaaggtggatggcctggtgaactttgagaagctgaggatgatcagcaaggagatccggcaggtggtgaggatgaccagcgccaacatggaccctgccatgatgttccggcagaggagcctgagccagggcagcaccaacagcaacatgctggatgtgcagggcggggcccacaagaagagggcccggcgcagcagcctgctgaatgccaagaagctgtatgaagatgcccagatggccaggaaggtgaagcagtacctgagcagcctggatgtggagacagatgaggagaagttccagatgatgagcctgcagtgggagcccgcctacggcaccctgaccaagaacctgtctgagaagaggtctgccaagagcagcgagatgagccctgtgcccatgaggtctgctggccagaccaccaaggcccacctgcaccagccccaccgggtgtcccaggtgctgcaggtgcctgctgtgaacctgcaccccatcaggaagaagggccagaccaaggaccctgccctgaacaccagcctgccccagaaggtgctgggcaccacagaggagatcagcggcaagaagcacacagaggacaccatctctgtggccagcagcctgcacagcagccccccagccagcccccagggcagcccccacaagggctacaccctcatccccagcgccaagagtgacaacctgagtgacagcagccacagcgagatcagcagccgcagcagcatcgtgagcaactgcagcgtggacagcatgtctgctgccctgcaggatgagcgctgcagcagccaggccctggccgtgcctgagagcactggagccctggagaagacagagcacgccagcggcatcggggaccacagccagcacggccctggctggaccctgctgaagcccagcctcatcaagtgcctggccgtgagcagctctgtgtccaatgaggagatcagccaggagcacatcatcattgaagctgctgacagcggccggggctcctggaccagctgcagcagcagcagccatgacaacttccagagcctgcccaaccccaagtcctgggacttcctgaacagctaccgccacacccacctggatgaccccatcgccgaggtggagcccacagacagcgagccctacagctgcagcaagagctgcagcaggacctgtggccagtgcaagggcagcctggagaggaagtcctggaccagcagcagcagcctgagtgacacctatgagcccaactatggaacagtgaagcagagggtgctggagagcaccccagctgagagcagcgagggcctggaccccaaggatgccacagatcctgtgtacaagacagtgaccagcagcacagagaagggcctcatcgtgtactgtgtgaccagccccaagaaggatgaccgctaccgggagcccccacccaccccacctggctacctgggcatcagcctggccgacctgaaggagggcccccacacccacctgaagcccccagactacagcgtggccgtgcagaggagcaagatgatgcacaacagcctgagccggctgcccccagccagcctgagcagcaacctggtggcctgtgtgcccagcaagatcgtgacccagccccagaggcacaacctgcagcccttccaccccaagctgggagatgtgacagatgctgacagcgaggctgatgaaaatgagcaggtgtctgctgtgtag

SEQ ID NO: 167134 - DNA, 3615 bp, Artificial Sequence
  Description of Artificial Sequence: Synthetic coding sequence
atgaacagccctgtggaccccggggcccggcaggccctgaggaagaagcccccagagaggaccccagaggacctgaacaccatctacagctacctgcacggcatggagatcctgagcaacctgcgggagcaccagctgcggctgatgtctgcccgggcccgctatgagcgctacagcggcaaccaggtgctcttctgcagcgagaccatcgcccgctgctggtacatcctgctgagcggctctgtgctggtgaagggctccatggtgctgcccccctgcagctttgggaagcagtttggaggcaagaggggctgtgactgcctggtgctggagcccagcgagatgattgtggtggagaatgccaaggacaatgaagattccatcctgcagcgggagatcccagcccggcagagcagaagacgcttcaggaagatcaactacaagggggagcggcagaccatcacagatgatgtggaggtgaacagctacctgagcctgcctgctgacctgaccaagatgcacctgacagagaacccccacccccaggtgacccacgtgagcagcagccagagcggctgcagcatcgccagtgacagcggcagcagcagcctgagtgacatctaccaggccacagaaagtgaggtgggagatgtggacctgacccggctgcctgagggccctgtggacagtgaagatgatgaggaggaggatgaggagattgacagaacagaccccctgcagggccgggacctggtgcgggagtgcctggagaaggagcctgctgacaagacagatgatgacatcgagcagctgctggagttcatgcaccagctgcctgcctttgccaacatgaccatgtctgtgagaagagagctgtgcagcgtgatgatctttgaggtggtggagcaggccggggccatcatcctggaggatggccaggagctggacagctggtacgtgatcctgaatggaacagtggagatcagccacccagatggcaaggtggagaacctcttcatgggcaacagctttggcatcacccccaccctggacaagcagtacatgcacggcatcgtgaggaccaaggtggatgactgccagtttgtgtgcatcgcccagcaggactactggaggatcctgaaccacgtggagaagaacacccacaaggtggaggaggagggggagatcgtgatggtgcatgagcaccgggagctggacaggagcggcaccaggaagggccacatcgtcatcaaggccaccccagagcggctcatcatgcacctgattgaggagcacagcatcgtggaccccacctacatcgaggacttcctgctgacctaccgcaccttcctggagagccccctggatgtgggcatcaagctgctggagtggttcaagattgacagcctgcgggacaaggtgaccagaattgtgctgctgtgggtgaacaaccacttcaatgactttgaaggagaccctgccatgacccgcttcctggaggagtttgagaagaacctggaggacaccaagatgaatggccacctgcggctgctgaacatcgcctgtgccgccaaggccaagtggaggcaggtggtgctgcagaaggccagccgggagagccccctgcagttcagcctgaatggaggcagcgagaagggcttcggcatctttgtggagggcgtggagcccggcagcaaggctgctgacagcggcctgaagagaggagaccagatcatggaggtgaatggccagaactttgagaacatcaccttcatgaaggctgtggagatcctgaggaacaacacccacctggccctgactgtgaagaccaacatctttgtgttcaaggagctgctcttcagaacagagcaggagaagtctggagtgccccacatccccaagattgctgagaagaagagcaacagacacagcatccagcacgtgcctggggacatcgagcagaccagccaggagaagggcagcaagaaggtgaaggccaacacagtgtctgggggcaggaacaagatcaggaagatcctggacaagacccgcttcagcatcctgccccccaagctgttcagtgatggcggcctgagccagagccaggatgacagcatcgtgggcaccaggcactgccgccacagcctggccatcatgcccatccctggcaccctgagcagcagcagcccagacctgctgcagcccaccacctccatgctggacttcagcaaccccagcgacatcccagaccaggtgatccgggtcttcaaggtggaccagcagagctgctacatcatcatcagcaaggacaccacagccaaggaggtggtgttccacgctgtgcatgaatttggcctgactggagccagtgacacctacagcctgtgtgaggtgtctgtgaccccagagggcgtcatcaagcagaggcggctgcctgaccagttcagcaagctggccgaccgcatccagctgaatggccgctactacctgaagaacaacatggagacagagaccctgtgcagtgatgaagatgcccaggagctggtgaaggagagccagctgtccatgctgcagctgagcaccatcgaggtggccacccagctgtccatgagggactttgacctcttcagaaatattgagcccacagagtacattgatgacctcttcaagctgaacagcaagacaggcaacacccacctgaagagatttgaggacatcgtgaaccaggagaccttctgggtggccagcgagatcctgacagaggccaaccagctgaagaggatgaagatcatcaagcacttcatcaagatcgccctgcactgccgggagtgcaagaacttcaacagcatgtttgccatcatcagcggcctgaacctggcctctgtggcccggctgcggggcacctgggagaagctgcccagcaaatatgagaagcacctgcaggacctgcaggacatctttgaccccagcaggaacatggccaagtacagaaacatcctgagcagccagagcatgcagccccccatcatccccctcttccctgtggtgaagaaggacatgaccttcctgcacgagggcaatgacagcaaggtggatggcctggtgaactttgagaagctgaggatgatcagcaaggagatccggcaggtggtgaggatgaccagcgccaacatggaccctgccatgatgttccggcagaggagcctgagccagggcagcaccaacagcaacatgctggatgtgcagggcggggcccacaagaagagggcccggcgcagcagcctgctgaatgccaagaagctgtatgaagatgcccagatggccaggaaggtgaagcagtacctgagcagcctggatgtggagacagatgaggagaagttccagatgatgagcctgcagtgggagcccgcctacggcaccctgaccaagaacctgtctgagaagaggtctgccaagagcagcgagatgagccctgtgcccatgaggtctgctggccagaccaccaaggcccacctgcaccagccccaccgggtgtcccaggtgctgcaggtgcctgctgtgaacctgcaccccatcaggaagaagggccagaccaaggaccctgccctgatgtag

SEQ ID NO: 167135 - DNA, 4176 bp, Artificial Sequence
  Description of Artificial Sequence: Synthetic coding sequence
atgaacagccctgtggaccccggggcccggcaggccctgaggaagaagcccccagagaggaccccagaggacctgaacaccatctacagctacctgcacggcatggagatcctgagcaacctgcgggagcaccagctgcggctgatgtctgcccgggcccgctatgagcgctacagcggcaaccaggtgctcttctgcagcgagaccatcgcccgctgctggtacatcctgctgagcggctctgtgctggtgaagggctccatggtgctgcccccctgcagctttgggaagcagtttggaggcaagaggggctgtgactgcctggtgctggagcccagcgagatgattgtggtggagaatgccaaggacaatgaagattccatcctgcagcgggagatcccagcccggcagagcagaagacgcttcaggaagatcaactacaagggggagcggcagaccatcacagatgatgtggaggtgaacagctacctgagcctgcctgctgacctgaccaagatgcacctgacagagaacccccacccccaggtgacccacgtgagcagcagccagagcggctgcagcatcgccagtgacagcggcagcagcagcctgagtgacatctaccaggccacagaaagtgaggtgggagatgtggacctgacccggctgcctgagggccctgtggacagtgaagatgatgaggaggaggatgaggagattgacagaacagaccccctgcagggccgggacctggtgcgggagtgcctggagaaggagcctgctgacaagacagatgatgacatcgagcagctgctggagttcatgcaccagctgcctgcctttgccaacatgaccatgtctgtgagaagagagctgtgcagcgtgatgatctttgaggtggtggagcaggccggggccatcatcctggaggatggccaggagctggacagctggtacgtgatcctgaatggaacagtggagatcagccacccagatggcaaggtggagaacctcttcatgggcaacagctttggcatcacccccaccctggacaagcagtacatgcacggcatcgtgaggaccaaggtggatgactgccagtttgtgtgcatcgcccagcaggactactggaggatcctgaaccacgtggagaagaacacccacaaggtggaggaggagggggagatcgtgatggtgcatgagcaccgggagctggacaggagcggcaccaggaagggccacatcgtcatcaaggccaccccagagcggctcatcatgcacctgattgaggagcacagcatcgtggaccccacctacatcgaggacttcctgctgacctaccgcaccttcctggagagccccctggatgtgggcatcaagctgctggagtggttcaagattgacagcctgcgggacaaggtgaccagaattgtgctgctgtgggtgaacaaccacttcaatgactttgaaggagaccctgccatgacccgcttcctggaggagtttgagaagaacctggaggacaccaagatgaatggccacctgcggctgctgaacatcgcctgtgccgccaaggccaagtggaggcaggtggtgctgcagaaggccagccgggagagccccctgcagttcagcctgaatggaggcagcgagaagggcttcggcatctttgtggagggcgtggagcccggcagcaaggctgctgacagcggcctgaagagaggagaccagatcatggaggtgaatggccagaactttgagaacatcaccttcatgaaggctgtggagatcctgaggaacaacacccacctggccctgactgtgaagaccaacatctttgtgttcaaggagctgctcttcagaacagagcaggagaagtctggagtgccccacatccccaagattgctgagaagaagagcaacagacacagcatccagcacgtgcctggggacatcgagcagaccagccaggagaagggcagcaagaaggtgaaggccaacacagtgtctgggggcaggaacaagatcaggaagatcctggacaagacccgcttcagcatcctgccccccaagctgttcagtgatggcggcctgagccagagccaggatgacagcatcgtgggcaccaggcactgccgccacagcctggccatcatgcccatccctggcaccctgagcagcagcagcccagacctgctgcagcccaccacctccatgctggacttcagcaaccccagcgacatcccagaccaggtgatccgggtcttcaaggtggaccagcagagctgctacatcatcatcagcaaggacaccacagccaaggaggtggtgttccacgctgtgcatgaatttggcctgactggagccagtgacacctacagcctgtgtgaggtgtctgtgaccccagagggcgtcatcaagcagaggcggctgcctgaccagttcagcaagctggccgaccgcatccagctgaatggccgctactacctgaagaacaacatggagacagagaccctgtgcagtgatgaagatgcccaggagctggtgaaggagagccagctgtccatgctgcagctgagcaccatcgaggtggccacccagctgtccatgagggactttgacctcttcagaaatattgagcccacagagtacattgatgacctcttcaagctgaacagcaagacaggcaacacccacctgaagagatttgaggacatcgtgaaccaggagaccttctgggtggccagcgagatcctgacagaggccaaccagctgaagaggatgaagatcatcaagcacttcatcaagatcgccctgcactgccgggagtgcaagaacttcaacagcatgtttgccatcatcagcggcctgaacctggcctctgtggcccggctgcggggcacctgggagaagctgcccagcaaatatgagaagcacctgcaggacctgcaggacatctttgaccccagcaggaacatggccaagtacagaaacatcctgagcagccagagcatgcagccccccatcatccccctcttccctgtggtgaagaaggacatgaccttcctgcacgagggcaatgacagcaaggtggatggcctggtgaactttgagaagctgaggatgatcagcaaggagatccggcaggtggtgaggatgaccagcgccaacatggaccctgccatgatgttccggcagaggagcctgagccagggcagcaccaacagcaacatgctggatgtgcagggcggggcccacaagaagagggcccggcgcagcagcctgctgaatgccaagaagctgtatgaagatgcccagatggccaggaaggtgaagcagtacctgagcagcctggatgtggagacagatgaggagaagttccagatgatgagcctgcagtgggagcccgcctacggcaccctgaccaagaacctgtctgagaagaggtctgccaagagcagcgagatgagccctgtgcccatgaggtctgctggccagaccaccaaggcccacctgcaccagccccaccgggtgtcccaggtgctgcaggtgcctgctgtgaacctgcaccccatcaggaagaagggccagaccaaggaccctgccctgaacaccagcctgccccagaaggtgctgggcaccacagaggagatcagcggcaagaagcacacagaggacaccatctctgtggccagcagcctgcacagcagccccccagccagcccccagggcagcccccacaaggtgggcagcatcatcagtgaccacagcagcaagatcagcggccagagctgccccggcatcggcggggcctacctgcagaagaagatcctgcagatcaccaggagcacagccaagaggacagacagcacagagaaggccacagaagaaaatagagacaggaccagctgtgagaacaccaccaggaagaggatgaccagccccttccggcggctgcgggagaggatgctgagccgggagcggctggtgaacagccagaaggaggacacagaccacaaccaggccacagagagctgtgagaaggtgaaggatgtgggcagcaacatcaaggatgagaagggcagcgccatcttcaacagcaacagccagggcaacagcaacaccctgaactgcttctacacccgcttcaagagcaagaggaggaagaccctgtag

SEQ ID NO: 167136 - DNA, 2484 bp, Artificial Sequence
  Description of Artificial Sequence: Synthetic coding sequence
atgaacagccctgtggaccccggggcccggcaggccctgaggaagaagcccccagagaggaccccagaggacctgaacaccatctacagctacctgcacggcatggagatcctgagcaacctgcgggagcaccagctgcggctgatgtctgcccgggcccgctatgagcgctacagcggcaaccaggtgctcttctgcagcgagaccatcgcccgctgctggtacatcctgctgagcggctctgtgctggtgaagggctccatggtgctgcccccctgcagctttgggaagcagtttggaggcaagaggggctgtgactgcctggtgctggagcccagcgagatgattgtggtggagaatgccaaggacaatgaagattccatcctgcagcgggagatcccagcccggcagagcagaagacgcttcaggaagatcaactacaagggggagcggcagaccatcacagatgatgtggaggtgaacagctacctgagcctgcctgctgacctgaccaagatgcacctgacagagaacccccacccccaggtgacccacgtgagcagcagccagagcggctgcagcatcgccagtgacagcggcagcagcagcctgagtgacatctaccaggccacagaaagtgaggtgggagatgtggacctgacccggctgcctgagggccctgtggacagtgaagatgatgaggaggaggatgaggagattgacagaacagaccccctgcagggccgggacctggtgcgggagtgcctggagaaggagcctgctgacaagacagatgatgacatcgagcagctgctggagttcatgcaccagctgcctgcctttgccaacatgaccatgtctgtgagaagagagctgtgcagcgtgatgatctttgaggtggtggagcaggccggggccatcatcctggaggatggccaggagctggacagctggtacgtgatcctgaatggaacagtggagatcagccacccagatggcaaggtggagaacctcttcatgggcaacagctttggcatcacccccaccctggacaagcagtacatgcacggcatcgtgaggaccaaggtggatgactgccagtttgtgtgcatcgcccagcaggactactggaggatcctgaaccacgtggagaagaacacccacaaggtggaggaggagggggagatcgtgatggtgcatgagcaccgggagctggacaggagcggcaccaggaagggccacatcgtcatcaaggccaccccagagcggctcatcatgcacctgattgaggagcacagcatcgtggaccccacctacatcgaggacttcctgctgacctaccgcaccttcctggagagccccctggatgtgggcatcaagctgctggagtggttcaagattgacagcctgcgggacaaggtgaccagaattgtgctgctgtgggtgaacaaccacttcaatgactttgaaggagaccctgccatgacccgcttcctggaggagtttgagaagaacctggaggacaccaagatgaatggccacctgcggctgctgaacatcgcctgtgccgccaaggccaagtggaggcaggtggtgctgcagaaggccagccgggagagccccctgcagttcagcctgaatggaggcagcgagaagggcttcggcatctttgtggagggcgtggagcccggcagcaaggctgctgacagcggcctgaagagaggagaccagatcatggaggtgaatggccagaactttgagaacatcaccttcatgaaggctgtggagatcctgaggaacaacacccacctggccctgactgtgaagaccaacatctttgtgttcaaggagctgctcttcagaacagagcaggagaagtctggagtgccccacatccccaagattgctgagaagaagagcaacagacacagcatccagcacgtgcctggggacatcgagcagaccagccaggagaagggcagcaagaaggtgaaggccaacacagtgtctgggggcaggaacaagatcaggaagatcctggacaagacccgcttcagcatcctgccccccaagctgttcagtgatggcggcctgagccagagccaggatgacagcatcgtgggcaccaggcactgccgccacagcctggccatcatgcccatccctggcaccctgagcagcagcagcccagacctgctgcagcccaccacctccatgctggacttcagcaaccccagcgacatcccagaccaggtgatccgggtcttcaaggtggaccagcagagctgctacatcatcatcagcaaggacaccacagccaaggaggtggtgttccacgctgtgcatgaatttggcctgactggagccagtgacacctacagcctgtgtgaggtgtctgtgaccccagagggcgtcatcaagcagaggcggctgcctgaccagttcagcaagctggccgaccgcatccagctgaatggaagatag

SEQ ID NO: 167137 - DNA, 1551 bp, Artificial Sequence
  Description of Artificial Sequence: Synthetic coding sequence
atggctgacaacctgagtgacaccctgaagaagctgaagatcacagctgtggacaagacagaggacagcctggagggctgcctggactgcctgctgcaggccctggcccagaacaacacagagaccagcgagaagatccaggccagcggcatcctgcagctgtttgccagcctgctgaccccccagagcagctgcaaggccaaggtggccaacatcatcgccgaggtggccaagaatgagttcatgaggatcccctgtgtggatgctggcctcatcagccccctggtgcagctgctgaacagcaaggaccaggaggtgctgctgcagacaggccgggccctgggcaacatctgctatgacagccagagcagcaaggagcagtttgccagcaccaacattgctgaggagctggtgaagctgttcaagaagcagattgaacatgacaagcgggagatgatctttgaggtgctggcccccctggccgagaatgatgccatcaagctgcagctggtggaggccggcctggtggagtgcctgctggagatcgtgcagcagaaggtggacagcgacaaggaggatgacatcacagagctgaagacaggcagtgacctgatggtgctgctgctgctgggagatgagagcatgcagaagctgtttgaaggaggaaaaggatctgtgttccagagggtgctgtcctggatccccagcaacaaccaccagctgcagctggccggggccctggccatcgccaactttgccagaaatgatgccaactgcatccacatggtggacaatggaattgtggagaagctgatggacctgctggacagacatgtggaggatggaaatgtgacagtgcagcacgccgccctgagcgccctgaggaacctggccatccctgtgatcaacaaggccaagatgctgtctgctggggtgacagaagctgtgctgaagttcctgaagtctgagatgcctcctgtgcagttcaagctgctgggcaccctgaggatgctgattgatgcccaggccgaggccgctgagcagctgggcaagaatgtgaagctggtggagcggctggtggagtggtgtgaggccaaggaccatgctggggtgatgggagagagcaaccggctgctgagcgccctgatccgccacagcaagagcaaggatgtgatcaagaccatcgtgcagagcggcggcatcaagcacctggtgaccatggccaccagcgagcacgtgatcatgcagaatgaggccctggtggccctggccctgattgctgccctggagctgggcacagctgagaaggacctggagagcgccaagctggtgcagatcctgcaccggctgctggctgatgagaggtctgcccctgagatcaagtacaacagcatggtgctgatctgtgccctgatgggctctgaatgtctgcacaaggaggtgcaggacctggccttcctggatgtggtgtccaagctgcggagccatgagaacaagtctgtggcccagcaggccagcctgacagagcagaggctgactgtggagagctag

SEQ ID NO: 167138 - DNA, 1827 bp, Artificial Sequence
  Description of Artificial Sequence: Synthetic coding sequence
atggctgacaacctgagtgacaccctgaagaagctgaagatcacagctgtggacaagacagaggacagcctggagggctgcctggactgcctgctgcaggccctggcccagaacaacacagagaccagcgagaagatccaggccagcggcatcctgcagctgtttgccagcctgctgaccccccagagcagctgcaaggccaaggtggccaacatcatcgccgaggtggccaagaatgagttcatgaggatcccctgtgtggatgctggcctcatcagccccctggtgcagctgctgaacagcaaggaccaggaggtgctgctgcagacaggccgggccctgggcaacatctgctatgacagccatgagggccgctctgctgtggaccaggccggcggggcccagatcgtcatcgaccacctgcggagcctgtgcagcatcacagatcctgccaatgagaagctgctgactgtgttctgtggcatgctgatgaactacagcaatgaaaatgacagcctgcaggcccagctgatcaacatgggcgtcatccccaccctggtgaagctgctgggcatccactgccagaatgctgccctgacagagatgtgcctggtggcctttggaaacctggccgagctggagagcagcaaggagcagtttgccagcaccaacattgctgaggagctggtgaagctgttcaagaagcagattgaacatgacaagcgggagatgatctttgaggtgctggcccccctggccgagaatgatgccatcaagctgcagctggtggaggccggcctggtggagtgcctgctggagatcgtgcagcagaaggtggacagcgacaaggaggatgacatcacagagctgaagacaggcagtgacctgatggtgctgctgctgctgggagatgagagcatgcagaagctgtttgaaggaggaaaaggatctgtgttccagagggtgctgtcctggatccccagcaacaaccaccagctgcagctggccggggccctggccatcgccaactttgccagaaatgatgccaactgcatccacatggtggacaatggaattgtggagaagctgatggacctgctggacagacatgtggaggatggaaatgtgacagtgcagcacgccgccctgagcgccctgaggaacctggccatccctgtgatcaacaaggccaagatgctgtctgctggggtgacagaagctgtgctgaagttcctgaagtctgagatgcctcctgtgcagttcaagctgctgggcaccctgaggatgctgattgatgcccaggccgaggccgctgagcagctgggcaagaatgtgaagctggtggagcggctggtggagtggtgtgaggccaaggaccatgctggggtgatgggagagagcaaccggctgctgagcgccctgatccgccacagcaagagcaaggatgtgatcaagaccatcgtgcagagcggcggcatcaagcacctggtgaccatggccaccagcgagcacgtgatcatgcagaatgaggccctggtggccctggccctgattgctgccctggagctgggcacagctgagaaggacctggagagcgccaagctggtgcagatcctgcaccggctgctggctgatgagaggtctgcccctgagatcaagtacaacagcatggtgctgatctgtgccctgatgggctctgaatgtctgcacaaggaggtgcaggacctggccttcctggatgtggtgtccaagctgcggagccatgagaacaagtctgtggcccagcaggccagcctgacagagcagaggctgactgtggagagctag

SEQ ID NO: 167139 - DNA, 1680 bp, Artificial Sequence
  Description of Artificial Sequence: Synthetic coding sequence
atggctgacaacctgagtgacaccctgaagaagctgaagatcacagctgtggacaagacagaggacagcctggagggctgcctggactgcctgctgcaggccctggcccagaacaacacagagaccagcgagaagatccaggccagcggcatcctgcagctgtttgccagcctgctgaccccccagagcagctgcaaggccaaggtggccaacatcatcgccgaggtggccaagaatgagttcatgaggatcccctgtgtggatgctggcctcatcagccccctggtgcagctgctgaacagcaaggaccaggaggtgctgctgcagacaggccgggccctgggcaacatctgctatgacagccacagcctgcaggcccagctgatcaacatgggcgtcatccccaccctggtgaagctgctgggcatccactgccagaatgctgccctgacagagatgtgcctggtggccttcggcaacctggccgagctggagagcagcaaggagcagtttgccagcaccaacattgctgaggagctggtgaagctgttcaagaagcagatcgagcatgacaagcgggagatgatctttgaggtgctggcccccctggctgaaaatgatgccatcaagctgcagctggtggaggccggcctggtggagtgcctgctggagatcgtgcagcagaaggtggacagcgacaaggaggatgacatcacagagctgaagacaggcagtgacctgatggtgctgctgctgctgggagatgagagcatgcagaagctgtttgagggcggcaagggcagcgtcttccagagggtgctgtcctggatccccagcaacaaccaccagctgcagctggccggggccctggccatcgccaactttgccagaaatgatgccaactgcatccacatggtggacaatggcatcgtggagaagctgatggacctgctggacagacatgtggaggatggaaatgtgacagtgcagcacgccgccctgagcgccctgaggaacctggccatccctgtgatcaacaaggccaagatgctgtctgctggggtgacagaggccgtgctgaagttcctgaagtctgagatgcctcctgtgcagttcaagctgctgggcaccctgaggatgctgattgatgcccaggccgaggccgctgagcagctgggcaagaatgtgaagctggtggagcggctggtggagtggtgtgaggccaaggaccacgccggcgtgatgggagagagcaaccggctgctgagcgccctgatccgccacagcaagagcaaggatgtgatcaagaccatcgtgcagagcggcggcatcaagcacctggtgaccatggccaccagcgagcacgtgatcatgcagaatgaggccctggtggccctggccctgattgctgccctggagctgggcacagctgagaaggacctggagagcgccaagctggtgcagatcctgcaccggctgctggctgatgagaggtctgcccctgagatcaagtacaacagcatggtgctgatctgtgccctgatgggcagcgagtgcctgcacaaggaggtgcaggacctggccttcctggatgtggtgtccaagctgcggagccatgagaacaagtctgtggcccagcaggccagcctgacagagcagaggctgactgtggagagctag

SEQ ID NO: 167140 - DNA, 1677 bp, Artificial Sequence
  Description of Artificial Sequence: Synthetic coding sequence
atggacaacctgagtgacaccctgaagaagctgaagatcacagctgtggacaagacagaggacagcctggagggctgcctggactgcctgctgcaggccctggcccagaacaacacagagaccagcgagaagatccaggccagcggcatcctgcagctgtttgccagcctgctgaccccccagagcagctgcaaggccaaggtggccaacatcatcgccgaggtggccaagaatgagttcatgaggatcccctgtgtggatgctggcctcatcagccccctggtgcagctgctgaacagcaaggaccaggaggtgctgctgcagacaggccgggccctgggcaacatctgctatgacagccacagcctgcaggcccagctgatcaacatgggcgtcatccccaccctggtgaagctgctgggcatccactgccagaatgctgccctgacagagatgtgcctggtggcctttggaaacctggccgagctggagagcagcaaggagcagtttgccagcaccaacattgctgaggagctggtgaagctgttcaagaagcagattgaacatgacaagcgggagatgatctttgaggtgctggcccccctggccgagaatgatgccatcaagctgcagctggtggaggccggcctggtggagtgcctgctggagatcgtgcagcagaaggtggacagcgacaaggaggatgacatcacagagctgaagacaggcagtgacctgatggtgctgctgctgctgggagatgagagcatgcagaagctgtttgaaggaggaaaaggatctgtgttccagagggtgctgtcctggatccccagcaacaaccaccagctgcagctggccggggccctggccatcgccaactttgccagaaatgatgccaactgcatccacatggtggacaatggaattgtggagaagctgatggacctgctggacagacatgtggaggatggaaatgtgacagtgcagcacgccgccctgagcgccctgaggaacctggccatccctgtgatcaacaaggccaagatgctgtctgctggggtgacagaagctgtgctgaagttcctgaagtctgagatgcctcctgtgcagttcaagctgctgggcaccctgaggatgctgattgatgcccaggccgaggccgctgagcagctgggcaagaatgtgaagctggtggagcggctggtggagtggtgtgaggccaaggaccatgctggggtgatgggagagagcaaccggctgctgagcgccctgatccgccacagcaagagcaaggatgtgatcaagaccatcgtgcagagcggcggcatcaagcacctggtgaccatggccaccagcgagcacgtgatcatgcagaatgaggccctggtggccctggccctgattgctgccctggagctgggcacagctgagaaggacctggagagcgccaagctggtgcagatcctgcaccggctgctggctgatgagaggtctgcccctgagatcaagtacaacagcatggtgctgatctgtgccctgatgggctctgaatgtctgcacaaggaggtgcaggacctggccttcctggatgtggtgtccaagctgcggagccatgagaacaagtctgtggcccagcaggccagcctgacagagcagaggctgactgtggagagctag

SEQ ID NO: 167141 - DNA, 1824 bp, Artificial Sequence
  Description of Artificial Sequence: Synthetic coding sequence
atggacaacctgagtgacaccctgaagaagctgaagatcacagctgtggacaagacagaggacagcctggagggctgcctggactgcctgctgcaggccctggcccagaacaacacagagaccagcgagaagatccaggccagcggcatcctgcagctgtttgccagcctgctgaccccccagagcagctgcaaggccaaggtggccaacatcatcgccgaggtggccaagaatgagttcatgaggatcccctgtgtggatgctggcctcatcagccccctggtgcagctgctgaacagcaaggaccaggaggtgctgctgcagacaggccgggccctgggcaacatctgctatgacagccatgagggccgctctgctgtggaccaggccggcggggcccagatcgtgattgaccacctgcggagcctgtgcagcatcacagatcctgccaatgagaagctgctgaccgtcttctgtggcatgctgatgaactacagcaatgaaaatgacagcctgcaggcccagctgatcaacatgggcgtcatccccaccctggtgaagctgctgggcatccactgccagaatgctgccctgacagagatgtgcctggtggccttcggcaacctggccgagctggagagcagcaaggagcagtttgccagcaccaacattgctgaggagctggtgaagctgttcaagaagcagatcgagcatgacaagcgggagatgatctttgaggtgctggcccccctggctgaaaatgatgccatcaagctgcagctggtggaggccggcctggtggagtgcctgctggagatcgtgcagcagaaggtggacagcgacaaggaggatgacatcacagagctgaagacaggcagtgacctgatggtgctgctgctgctgggagatgagagcatgcagaagctgtttgagggcggcaagggcagcgtcttccagagggtgctgtcctggatccccagcaacaaccaccagctgcagctggccggggccctggccatcgccaactttgccagaaatgatgccaactgcatccacatggtggacaatggcatcgtggagaagctgatggacctgctggacagacatgtggaggatggaaatgtgacagtgcagcacgccgccctgagcgccctgaggaacctggccatccctgtgatcaacaaggccaagatgctgtctgctggggtgacagaggccgtgctgaagttcctgaagtctgagatgcctcctgtgcagttcaagctgctgggcaccctgaggatgctgattgatgcccaggccgaggccgctgagcagctgggcaagaatgtgaagctggtggagcggctggtggagtggtgtgaggccaaggaccacgccggcgtgatgggagagagcaaccggctgctgagcgccctgatccgccacagcaagagcaaggatgtgatcaagaccatcgtgcagagcggcggcatcaagcacctggtgaccatggccaccagcgagcacgtgatcatgcagaatgaggccctggtggccctggccctgattgctgccctggagctgggcacagctgagaaggacctggagagcgccaagctggtgcagatcctgcaccggctgctggctgatgagaggtctgcccctgagatcaagtacaacagcatggtgctgatctgtgccctgatgggcagcgagtgcctgcacaaggaggtgcaggacctggccttcctggatgtggtgtccaagctgcggagccatgagaacaagtctgtggcccagcaggccagcctgacagagcagaggctgactgtggagagctag

SEQ ID NO: 167142 - DNA, 1824 bp, Artificial Sequence
  Description of Artificial Sequence: Synthetic coding sequence
atggctgacaacctgagtgacaccctgaagaagctgaagatcacagctgtggacaagacagaggacagcctggagggctgcctggactgcctgctgcaggccctggcccagaacaacacagagaccagcgagaagatccaggccagcggcatcctgcagctgtttgccagcctgctgaccccccagagcagctgcaaggccaaggtggccaacatcatcgccgaggtggccaagaatgagttcatgaggatcccctgtgtggatgctggcctcatcagccccctggtgcagctgctgaacagcaaggaccaggaggtgctgctgcagacaggccgggccctgggcaacatctgctatgacagccatgagggccgctctgctgtggaccaggccggcggggcccagatcgtcatcgaccacctgcggagcctgtgcagcatcacagatcctgccaatgagaagctgctgactgtgttctgtggcatgctgatgaactacagcaatgaaaatgacagcctgcaggcccagctgatcaacatgggcgtcatccccaccctggtgaagctgctgggcatccactgccagaatgctgccctgacagagatgtgcctggtggcctttggaaacctggccgagctggagagcagcaaggagcagtttgccagcaccaacattgctgaggagctggtgaagctgttcaagaagcagattgaacatgacaagcgggagatgatctttgaggtgctggcccccctggccgagaatgatgccatcaagctgcagctggtggaggccggcctggtggagtgcctgctggagatcgtgcagcagaaggtggacagcgacaaggaggatgacatcacagagctgaagacaggcagtgacctgatggtgctgctgctgctgggagatgagagcatgcagaagctgtttgaaggaggaaaaggatctgtgttccagagggtgctgtcctggatccccagcaacaaccaccagctgcagctggccggggccctggccatcgccaactttgccagaaatgatgccaactgcatccacatggtggacaatggaattgtggagaagctgatggacctgctggacagacatgtggaggatggaaatgtgacagtgcagcacgccgccctgagcgccctgaggaacctggccatccctgtgatcaacaaggccaagatgctgtctgctggggtgacagaagctgtgctgaagttcctgaagtctgagatgcctcctgtgcagttcaagctgctgggcaccctgaggatgctgattgatgcccaggaggccgctgagcagctgggcaagaatgtgaagctggtggagcggctggtggagtggtgtgaggccaaggaccacgccggcgtgatgggagagagcaaccggctgctgagcgccctgatccgccacagcaagagcaaggatgtgatcaagaccatcgtgcagagcggcggcatcaagcacctggtgaccatggccaccagcgagcacgtgatcatgcagaatgaggccctggtggccctggccctgattgctgccctggagctgggcacagctgagaaggacctggagagcgccaagctggtgcagatcctgcaccggctgctggctgatgagaggtctgcccctgagatcaagtacaacagcatggtgctgatctgtgccctgatgggcagcgagtgcctgcacaaggaggtgcaggacctggccttcctggatgtggtgtccaagctgcggagccatgagaacaagtctgtggcccagcaggccagcctgacagagcagaggctgactgtggagagctag

SEQ ID NO: 167143 - DNA, 555 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctggagatcctggacacagctggaacagagcagttcaccgccatgagggacctgtacatgaagaatggccagggctttgccctggtgtacagcatcacagcccagagcaccttcaatgacctgcaggacctgcgggagcagatcctgcgggtgaaggacacagatgatgtgcccatgatcctggtgggcaacaagtgtgacctggaggatgagcgggtggtgggcaaggagcagggccagaacctggcccggcagtggaacaactgtgccttcctggagagcagcgccaagagcaagatcaacgtgaatgagatcttctatgacctggtgcggcagatcaacaggaagacccctgtgcctgggaaggccaggaagaagagcagctgccagctgctgtag

SEQ ID NO: 167144 - DNA, 555 bp, Artificial Sequence; identical to SEQ ID NO: 167143
  Description of Artificial Sequence: Synthetic coding sequence

SEQ ID NO: 167145 - DNA, 357 bp, Artificial Sequence
  Description of Artificial Sequence: Synthetic coding sequence
atgagggacctgtacatgaagaatggccagggctttgccctggtgtacagcatcacagcccagagcaccttcaatgacctgcaggacctgcgggagcagatcctgcgggtgaaggacacagatgatgtgcccatgatcctggtgggcaacaagtgtgacctggaggatgagcgggtggtgggcaaggagcagggccagaacctggcccggcagtggaacaactgtgccttcctggagagcagcgccaagagcaagatcaacgtgaatgagatcttctatgacctggtgcggcagatcaacaggaagacccctgtgcctgggaaggccaggaagaagagcagctgccagctgctgtag

SEQ ID NO: 167146 - DNA, 555 bp, Artificial Sequence; identical to SEQ ID NO: 167143
  Description of Artificial Sequence: Synthetic coding sequence

SEQ ID NO: 167147 - DNA, 99 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtactag

SEQ ID NO: 167148 - DNA, 429 bp, Artificial Sequence
  Description of Artificial Sequence: Synthetic coding sequence
atgagggagtacaagctggtggtgctgggcagcggaggagtgggcaagagcgccctggagcagttcaccgccatgagggacctgtacatgaagaatggccagggctttgccctggtgtacagcatcacagcccagagcaccttcaatgacctgcaggacctgcgggagcagatcctgcgggtgaaggacacagatgatgtgcccatgatcctggtgggcaacaagtgtgacctggaggatgagcgggtggtgggcaaggagcagggccagaacctggcccggcagtggaacaactgtgccttcctggagagcagcgccaagagcaagatcaacgtgaatgagatcttctatgacctggtgcggcagatcaacaggaagacccctgtgcctgggaaggccaggaagaagagcagctgccagctgctgtag

SEQ ID NO: 167149 - DNA, 384 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctggagatcctggacacagctggaacagagcagttcaccgccatgagggacctgtacatgaagaatggccagggctttgccctggtgtacagcatcacagcccagagcaccttcaatgacctgcaggacctgcgggagcagatcctgcgggtgaaggacacagatgatgtgcccatgatcctggtgggcaacaagtgtgacctggaggatgagcgggtggtgggctag

SEQ ID NO: 167150 - DNA, 429 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctggagatcctggacacagctggaacagagcagttcaccgccatgagggacctgtacatgaagaatggccagggctttgccctggtgtacagcatcacagcccagagcaccttcaatgacctgcaggacctgcgggagcagatcctgcgggtgaaggacacagatgatgtgcccatgatcctggtgggcaacaagtgtgacctggaggatgagcgggtggtgggcaaggagcagggccagaacctggacaatggcaccaccgtgcacagctag

SEQ ID NO: 167151 - DNA, 147 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcctag

SEQ ID NO: 167152 - DNA, 36 bp, Artificial Sequence
  Description of Artificial Sequence: Synthetic coding sequence
atgagggagtacaagctggtggtgctgggcagctag

SEQ ID NO: 167153 - DNA, 264 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctggagatcctggacacagctggaacagagcagttcaccgccatgagggacctgtacatgaagaatggccagggctttgccctggtgtacagcatcacagcccagtag

SEQ ID NO: 167154 - DNA, 555 bp, Artificial Sequence; identical to SEQ ID NO: 167143
  Description of Artificial Sequence: Synthetic coding sequence

SEQ ID NO: 167155 - DNA, 306 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctggagatcctggacacagctggaacagagcagttcaccgccatgagggacctgtacatgaagaatggccagggctttgccctggtgtacagcatcacagcccagagcaccttcaatgacctgcaggacctgcgggagcagatcctgtag

SEQ ID NO: 167156 - DNA, 162 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctgtag

SEQ ID NO: 167157 - DNA, 429 bp, Artificial Sequence; identical to SEQ ID NO: 167148
  Description of Artificial Sequence: Synthetic coding sequence

SEQ ID NO: 167158 - DNA, 498 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaaggagcagttcaccgccatgagggacctgtacatgaagaatggccagggctttgccctggtgtacagcatcacagcccagagcaccttcaatgacctgcaggacctgcgggagcagatcctgcgggtgaaggacacagatgatgtgcccatgatcctggtgggcaacaagtgtgacctggaggatgagcgggtggtgggcaaggagcagggccagaacctggcccggcagtggaacaactgtgccttcctggagagcagcgccaagagcaagatcaacgtgaatgagatcttctatgacctggtgcggcagatcaacaggaagacccctgtgcctgggaaggccaggaagaagagcagctgccagctgctgtag

SEQ ID NO: 167159 - DNA, 420 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctggagatcctggacacagctggaacagagcagttcaccgccatgagggacctgtacatgaagaatggccagggctttgccctggtgtacagcatcacagcccagagcaccttcaatgacctgcaggacctgcgggagcagatcctgcgggtgaaggacacagatgatgtgcccatgatcctggtgggcaacaagtgtgacctggaggatgagcgggtggtgggcaaggagcagggccagaacctggcccggcagtggaactag

SEQ ID NO: 167160 - DNA, 282 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctggagatcctggacacagctggaacagagcagttcaccgccatgagggacctgtacatgaagaatggccagggctttgccctggtgtacagcatcacagcccagagcaccttcaatgacctgtag

SEQ ID NO: 167161 - DNA, 36 bp, Artificial Sequence; identical to SEQ ID NO: 167152
  Description of Artificial Sequence: Synthetic coding sequence

SEQ ID NO: 167162 - DNA, 297 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctggagatcctggacacagctggaacagagcagttcaccgccatgagggacctgtacatgaagaatggccagggctttgccctggtgtacagcatcacagcccagagcaccttcaatgacctgcaggacctgcgggagtag

SEQ ID NO: 167163 - DNA, 414 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctggagatcctggacacagctggcaccgtgcccatgatcctggtgggcaacaagtgtgacctggaggatgagcgggtggtgggcaaggagcagggccagaacctggcccggcagtggaacaactgtgccttcctggagagcagcgccaagagcaagatcaacgtgaatgagatcttctatgacctggtgcggcagatcaacaggaagacccctgtgcctgggaaggccaggaagaagagcagctgccagctgctgtag

SEQ ID NO: 167164 - DNA, 357 bp, Artificial Sequence; identical to SEQ ID NO: 167145
  Description of Artificial Sequence: Synthetic coding sequence

SEQ ID NO: 167165 - DNA, 369 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctggagatcctggacacagctggaacagagcagttcaccgccatgagggacctgtacatgaagaatggccagggctttgccctggtgtacagcatcacagcccagagcaccttcaatgacctgcaggacctgcgggagcagatcctgcgggtgaaggacacagatgatgtgcccatgatcctggtgggcaacaagtgtgacctggaggactag

SEQ ID NO: 167166 - DNA, 258 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggatgcccagcagtgcatgctggagatcctggacacagctggaacagagcagttcaccgccatgagggacctgtacatgaagaatggccagggctttgccctggtgtacagcatcacctag

SEQ ID NO: 167167 - DNA, 552 bp, Artificial Sequence
  Description of Artificial Sequence: Synthetic coding sequence
atgagggagtacaaggtggtggtgctgggcagcggaggagtgggcaagagcgccctgactgtgcagtttgtgacaggcaccttcatcgagaagtatgaccccaccatcgaggacttctacaggaaggagattgaggtggacagcagccccagcgtgctggagatcctggacacagctggaacagagcagtttgcctccatgagggacctgtacatcaagaatggccagggcttcatcctggtgtacagcctggtgaaccagcagagcttccaggacatcaagcccatgagggaccagatcatccgggtgaagagatatgagaaggtgcctgtgatcctggtgggcaacaaggtggacctggagagcgagcgggaggtgagcagcagcgagggccgggccctggccgaggagtggggctgccccttcatggagaccagcgccaagagcaagaccatggtggatgagctgtttgctgagatcgtgcggcagatgaactatgctgcccagcctgacaaggatgacccctgctgcagcgcctgcaacatccagtag

SEQ ID NO: 167168 - DNA, 1671 bp, Artificial Sequence
  Description of Artificial Sequence: Synthetic coding sequence
atgaatgaaggagcccctggggacagcgacctggagacagaggcccgggtgccctggagcatcatgggccactgcctgaggacaggccaggccaggatgtctgccacccccaccccagctggggagggcgccaggagagatgagctgtttggcatcctgcagatcctgcaccagtgcatcctgagcagtggagatgcctttgtgctgactggagtgtgctgctcctggaggcagaatggcaagccaccctacagccagaaggaggacaaggaggtgcagacaggctacatgaatgcccagatcgagatcatcccctgcaagatctgtggggacaagagcagcggcatccactacggcgtcatcacctgtgagggctgcaagggcttcttcagaagaagccagcagagcaatgccacctacagctgcccccggcagaagaactgcctgattgacaggaccagcaggaaccgctgccagcactgccgcctgcagaagtgcctggccgtgggcatgagcagagatgctgtgaagtttggccgcatgagcaagaagcagagggacagcctgtatgcagaggtgcagaagcacaggatgcagcagcagcagagggaccaccagcagcagcctggagaggccgagcccctgacccccacctacaacatcagcgccaacggcctgacagagctgcatgatgacctgagcaactacattgatggccacaccccagagggcagcaaggctgacagcgctgtgtcctccttctacctggacatccagcccagcccagaccagagcggcctggacatcaatggcatcaagccagagcccatctgtgactacaccccagccagcggcttcttcccctactgcagcttcaccaacggggagaccagccccaccgtgtccatggccgagctggagcacctggcccagaacatcagcaagagccacctggagacctgccagtacctgcgggaggagctgcagcagatcacctggcagaccttcctgcaggaggagattgagaactaccagaacaagcagcgggaggtgatgtggcagctgtgtgccatcaagatcacagaggccatccagtatgtggtggagtttgccaagagaattgatggcttcatggagctgtgccagaatgaccagatcgtgctgctgaaggccggcagcctggaggtggtgttcatccgcatgtgccgggcctttgacagccagaacaacacagtgtactttgatggcaagtatgccagcccagatgtgttcaagagcctgggctgtgaggacttcatcagctttgtgtttgaatttgggaagagcctgtgcagcatgcacctgacagaagatgaaattgccctcttcagcgcctttgtgctgatgtctgctgaccgctcctggctgcaggagaaggtgaagattgagaagctgcagcagaagatccagctggccctgcagcacgtgctgcagaagaaccaccgggaggatggcatcctgaccaagctgatctgcaaggtgtccaccctgcgggccctgtgtggccgccacacagagaagctgatggccttcaaggccatctacccagacatcgtgcggctgcacttcccccccctgtacaaggagctgttcaccagcgagtttgagcccgccatgcagattgatggatag

SEQ ID NO: 167169 - DNA, 1647 bp, Artificial Sequence
  Description of Artificial Sequence: Synthetic coding sequence
atgaatgaaggagcccctggggacagcgacctggagacagaggcccgggtgccctggagcatcatgggccactgcctgaggacaggccaggccaggatgtctgccacccccaccccagctggggagggcgcccggagcagcagcacctgcagcagcctgagccgcctcttctggagccagctggagcacatcaactgggatggagccacagccaagaacttcatcaacctgcgggagttcttctccttcctgctgcctgccctgaggaaggcccagatcgagatcatcccctgcaagatctgtggggacaagagcagcggcatccactacggcgtcatcacctgtgagggctgcaagggcttcttcagaagaagccagcagagcaatgccacctacagctgcccccggcagaagaactgcctgattgacaggaccagcaggaaccgctgccagcactgccgcctgcagaagtgcctggccgtgggcatgagcagagatgctgtgaagtttggccgcatgagcaagaagcagagggacagcctgtatgcagaggtgcagaagcacaggatgcagcagcagcagagggaccaccagcagcagcctggagaggccgagcccctgacccccacctacaacatcagcgccaacggcctgacagagctgcatgatgacctgagcaactacattgatggccacaccccagagggcagcaaggctgacagcgctgtgtcctccttctacctggacatccagcccagcccagaccagagcggcctggacatcaatggcatcaagccagagcccatctgtgactacaccccagccagcggcttcttcccctactgcagcttcaccaacggggagaccagccccaccgtgtccatggccgagctggagcacctggcccagaacatcagcaagagccacctggagacctgccagtacctgcgggaggagctgcagcagatcacctggcagaccttcctgcaggaggagattgagaactaccagaacaagcagcgggaggtgatgtggcagctgtgtgccatcaagatcacagaggccatccagtatgtggtggagtttgccaagagaattgatggcttcatggagctgtgccagaatgaccagatcgtgctgctgaaggccggcagcctggaggtggtgttcatccgcatgtgccgggcctttgacagccagaacaacacagtgtactttgatggcaagtatgccagcccagatgtgttcaagagcctgggctgtgaggacttcatcagctttgtgtttgaatttgggaagagcctgtgcagcatgcacctgacagaagatgaaattgccctcttcagcgcctttgtgctgatgtctgctgaccgctcctggctgcaggagaaggtgaagattgagaagctgcagcagaagatccagctggccctgcagcacgtgctgcagaagaaccaccgggaggatggcatcctgaccaagctgatctgcaaggtgtccaccctgcgggccctgtgtggccgccacacagagaagctgatggccttcaaggccatctacccagacatcgtgcggctgcacttcccccccctgtacaaggagctgttcaccagcgagtttgagcccgccatgcagattgatggatag

SEQ ID NO: 167170 - DNA, 1572 bp, Artificial Sequence
  Description of Artificial Sequence: Synthetic coding sequence
atggagagcgccccagctgccccagaccctgctgccagcgagcccggcagcagcggggctgatgctgctgctggcagccgggagacccccctgaaccaggagagcgccaggaagtctgagcccccagcccctgtgcggcggcagagctacagcagcaccagccggggcatctctgtgaccaagaagacccacaccagccagatcgagatcatcccctgcaagatctgtggggacaagagcagcggcatccactatggagtcatcacctgtgagggctgcaagggcttcttccgccgcagccagcagagcaatgccacctacagctgcccccggcagaagaactgcctgattgacaggaccagcaggaaccgctgccagcactgccgcctgcagaagtgcctggccgtgggcatgagcagagatgctgtgaagtttggaaggatgagcaagaagcagagggacagcctgtatgcagaggtgcagaagcacaggatgcagcagcagcagagggaccaccagcagcagcccggggaggccgagcccctgacccccacctacaacatcagcgccaacggcctgacagagctgcatgatgacctgagcaactacattgatggccacaccccagagggcagcaaggctgacagcgctgtgagcagcttctacctggacatccagcccagcccagaccagagcggcctggacatcaatggcatcaagccagagcccatctgtgactacaccccagccagcggcttcttcccctactgcagcttcaccaatggagagaccagccccaccgtgtccatggccgagctggagcacctggcccagaacatcagcaagagccacctggagacctgccagtacctgcgggaggagctgcagcagatcacctggcagaccttcctgcaggaggagattgagaactaccagaacaagcagcgggaggtgatgtggcagctgtgtgccatcaagatcacagaggccatccagtatgtggtggagtttgccaagagaattgatggcttcatggagctgtgccagaatgaccagatcgtgctgctgaaggccggcagcctggaggtggtgttcatccgcatgtgccgggcctttgacagccagaacaacacagtgtactttgatggcaagtatgccagcccagatgtgttcaagagcctgggctgtgaggacttcatcagctttgtgtttgaatttgggaagagcctgtgcagcatgcacctgacagaagatgagatcgccctcttcagcgcctttgtgctgatgtctgctgaccgctcctggctgcaggagaaggtgaagattgagaagctgcagcagaagatccagctggccctgcagcacgtgctgcagaagaaccacagagaagatggcatcctgaccaagctgatctgcaaggtgtccaccctgcgggccctgtgtggccgccacacagagaagctgatggccttcaaggccatctacccagacatcgtgcggctgcacttcccccccctgtacaaggagctgttcaccagcgagtttgagcccgccatgcagattgatggatag

SEQ ID NO: 167171 - DNA, 1407 bp, Artificial Sequence
  Description of Artificial Sequence: Synthetic coding sequence
atgatgtactttgtgattgctgccatgaaggcccagatcgagatcatcccctgcaagatctgtggggacaagagcagcggcatccactacggcgtcatcacctgtgagggctgcaagggcttcttcagaagaagccagcagagcaatgccacctacagctgcccccggcagaagaactgcctgattgacaggaccagcaggaaccgctgccagcactgccgcctgcagaagtgcctggccgtgggcatgagcagagatgctgtgaagtttggccgcatgagcaagaagcagagggacagcctgtatgcagaggtgcagaagcacaggatgcagcagcagcagagggaccaccagcagcagcctggagaggccgagcccctgacccccacctacaacatcagcgccaacggcctgacagagctgcatgatgacctgagcaactacattgatggccacaccccagagggcagcaaggctgacagcgctgtgtcctccttctacctggacatccagcccagcccagaccagagcggcctggacatcaatggcatcaagccagagcccatctgtgactacaccccagccagcggcttcttcccctactgcagcttcaccaacggggagaccagccccaccgtgtccatggccgagctggagcacctggcccagaacatcagcaagagccacctggagacctgccagtacctgcgggaggagctgcagcagatcacctggcagaccttcctgcaggaggagattgagaactaccagaacaagcagcgggaggtgatgtggcagctgtgtgccatcaagatcacagaggccatccagtatgtggtggagtttgccaagagaattgatggcttcatggagctgtgccagaatgaccagatcgtgctgctgaaggccggcagcctggaggtggtgttcatccgcatgtgccgggcctttgacagccagaacaacacagtgtactttgatggcaagtatgccagcccagatgtgttcaagagcctgggctgtgaggacttcatcagctttgtgtttgaatttgggaagagcctgtgcagcatgcacctgacagaagatgaaattgccctcttcagcgcctttgtgctgatgtctgctgaccgctcctggctgcaggagaaggtgaagattgagaagctgcagcagaagatccagctggccctgcagcacgtgctgcagaagaaccaccgggaggatggcatcctgaccaagctgatctgcaaggtgtccaccctgcgggccctgtgtggccgccacacagagaagctgatggccttcaaggccatctacccagacatcgtgcggctgcacttcccccccctgtacaaggagctgttcaccagcgagtttgagcccgccatgcagattgatggatag

SEQ ID NO: 167172 - DNA, 1557 bp, Artificial Sequence
  Description of Artificial Sequence: Synthetic coding sequence
atggaccgggccccccagaggcagcaccgggccagccgggagctgctggccgccaagaagacccacaccagccagatcgaggtgatcccctgcaagatctgtggggacaagagcagcggcatccactatggagtcatcacctgtgagggctgcaagggcttcttccgccgcagccagcgctgcaatgctgcctacagctgcacccggcagcagaactgccccatcgacaggaccagcaggaaccgctgccagcactgccgcctgcagaagtgcctggccctgggcatgagcagagatgctgtgaagtttggaaggatgagcaagaagcagagggacagcctgcacgccgaggtgcagaagcagctgcagcagaggcagcagcagcagcaggagcctgtggtgaagaccccacctgctggggcccagggcgctgacaccctgacctacaccctgggcctgcctgatggccagctgcccctgggcagcagcccagacctgcctgaggccagcgcctgccccccaggcctgctgaaggccagcggcagcggccccagctacagcaacaacctggccaaggccggcctgaatggagccagctgccacctggagtacagccctgagcggggcaaggccgagggccgggagagcttctacagcacaggcagccagctgaccccagacagatgtggcctgcgctttgaggagcaccgccaccctggcctgggggagctgggccagggccctgacagctatggcagccccagcttccgcagcaccccagaggccccctatgccagcctgacagaaattgagcacctggtgcagagcgtgtgcaagagctaccgggagacctgccagctgcggctggaggacctgctgcggcagaggagcaacatcttcagccgggaggaggtgacaggctaccagaggaagtccatgtgggagatgtgggagcgctgtgcccaccacctgacagaggccatccagtatgtggtggagtttgccaagaggctgagcggcttcatggagctgtgccagaatgaccagatcgtgctgctgaaggccggggccatggaggtggtgctggtgaggatgtgccgggcctacaatgctgacaacagaacagtgttctttgagggcaagtatggaggcatggagctgttccgggccctgggctgcagcgagctgatcagcagcatctttgacttcagccacagcctgagcgccctgcacttctctgaagatgaaattgccctgtacacagccctggtgctgatcaatgcccacaggcctggcctgcaggagaagaggaaggtggagcagctgcagtacaacctggagctggccttccaccaccacctgtgcaagacccaccggcagagcatcctggccaagctgccccccaagggcaagctgcggagcctgtgcagccagcacgtggagcggctgcagatcttccagcacctgcaccccatcgtggtgcaggccgccttcccccccctgtacaaggagctgttcagcacagaaacagagagccctgtgggcctgagcaagtag

SEQ ID NO: 167173 - DNA, 1494 bp, Artificial Sequence
  Description of Artificial Sequence: Synthetic coding sequence
atgaggacccagattgaagtcatcccctgcaagatctgtggggacaagagcagcggcatccactacggcgtcatcacctgtgagggctgcaagggcttcttcagaagaagccagcgctgcaatgctgcctacagctgcacccggcagcagaactgccccatcgacaggaccagcaggaaccgctgccagcactgccgcctgcagaagtgcctggccctgggcatgagcagagatgctgtgaagtttggccgcatgagcaagaagcagagggacagcctgcatgctgaggtgcagaagcagctgcagcagaggcagcagcagcagcaggagcctgtggtgaagaccccacctgctggggcccagggcgctgacaccctgacctacaccctgggcctgcctgatggccagctgcccctgggcagcagcccagacctgcctgaggccagcgcctgccccccaggcctgctgaaggccagcggcagcggccccagctacagcaacaacctggccaaggccggcctgaatggagccagctgccacctggagtacagccctgagcggggcaaggccgagggccgggagagcttctacagcacaggcagccagctgaccccagacagatgtggcctgcgctttgaggagcaccgccaccctggcctgggggagctgggccagggccctgacagctatggcagccccagcttccgcagcaccccagaggccccctatgccagcctgacagaaattgagcacctggtgcagagcgtgtgcaagagctaccgggagacctgccagctgcggctggaggacctgctgcggcagaggagcaacatcttcagccgggaggaggtgacaggctaccagaggaagtccatgtgggagatgtgggagcgctgtgcccaccacctgacagaggccatccagtatgtggtggagtttgccaagaggctgagcggcttcatggagctgtgccagaatgaccagatcgtgctgctgaaggccggggccatggaggtggtgctggtgaggatgtgccgggcctacaatgctgacaacagaacagtgttctttgagggcaagtatggaggcatggagctgttccgggccctgggctgcagcgagctgatcagcagcatctttgacttcagccacagcctgagcgccctgcacttctctgaagatgagatcgccctgtacacagccctggtgctgatcaatgcccaccggcccggcctgcaggagaagaggaaggtggagcagctgcagtacaacctggagctggccttccaccaccacctgtgcaagacccaccggcagagcatcctggccaagctgccccccaagggcaagctgcggagcctgtgcagccagcacgtggagcggctgcagatcttccagcacctgcaccccatcgtggtgcaggccgccttcccccccctgtacaaggagctgttcagcacagaaacagagagccctgtgggcctgagcaagtag

SEQ ID NO: 167174 - DNA, 1719 bp, Artificial Sequence
  Description of Artificial Sequence: Synthetic coding sequence
atgtggggcaccggccccagcgctgggaaggacaggatgagcggccggccctggccccacccctggagcaagagcggcaccccatctgagcaggacagaagagccaccggcctggtgtcctgtgaacatggaggcggcaagtttgagggccagagccaccaggcccctggccccccaggcggcggccgcacaggctgcctggagctgctggccgccaagaagacccacaccagccagatcgaggtgatcccctgcaagatctgtggggacaagagcagcggcatccactatggagtcatcacctgtgagggctgcaagggcttcttccgccgcagccagcgctgcaatgctgcctacagctgcacccggcagcagaactgccccatcgacaggaccagcaggaaccgctgccagcactgccgcctgcagaagtgcctggccctgggcatgagcagagatgctgtgaagtttggaaggatgagcaagaagcagagggacagcctgcacgccgaggtgcagaagcagctgcagcagaggcagcagcagcagcaggagcctgtggtgaagaccccacctgctggggcccagggcgctgacaccctgacctacaccctgggcctgcctgatggccagctgcccctgggcagcagcccagacctgcctgaggccagcgcctgccccccaggcctgctgaaggccagcggcagcggccccagctacagcaacaacctggccaaggccggcctgaatggagccagctgccacctggagtacagccctgagcggggcaaggccgagggccgggagagcttctacagcacaggcagccagctgaccccagacagatgtggcctgcgctttgaggagcaccgccaccctggcctgggggagctgggccagggccctgacagctatggcagccccagcttccgcagcaccccagaggccccctatgccagcctgacagaaattgagcacctggtgcagagcgtgtgcaagagctaccgggagacctgccagctgcggctggaggacctgctgcggcagaggagcaacatcttcagccgggaggaggtgacaggctaccagaggaagtccatgtgggagatgtgggagcgctgtgcccaccacctgacagaggccatccagtatgtggtggagtttgccaagaggctgagcggcttcatggagctgtgccagaatgaccagatcgtgctgctgaaggccggggccatggaggtggtgctggtgaggatgtgccgggcctacaatgctgacaacagaacagtgttctttgagggcaagtatggaggcatggagctgttccgggccctgggctgcagcgagctgatcagcagcatctttgacttcagccacagcctgagcgccctgcacttctctgaagatgaaattgccctgtacacagccctggtgctgatcaatgcccacaggcctggcctgcaggagaagaggaaggtggagcagctgcagtacaacctggagctggccttccaccaccacctgtgcaagacccaccggcagagcatcctggccaagctgccccccaagggcaagctgcggagcctgtgcagccagcacgtggagcggctgcagatcttccagcacctgcaccccatcgtggtgcaggccgccttcccccccctgtacaaggagctgttcagcacagaaacagagagccctgtgggcctgagcaagtag

SEQ ID NO: 167175 - DNA, 2835 bp, Artificial Sequence
  Description of Artificial Sequence: Synthetic coding sequence
atgctggacagcttcagccaggagagcaccctgcccttccgggaggccaggaagaggaccagcttccagcctgtgcaggtgtggaggaacttcaccgccagccagaccacagagagccctgcctgcagcggggccagcctgggggagatgacagcctggaccatgggcgcccggggcctggacaagaggggcagcttcttcaagctgattgacaccatcgccagcgagattggagagctgaagcaggagatggtgaggacagatgtgaacctggagaatggcctggagcctgctgagacccacagcatggtgcgccacaaggatggcggctacagcgaggaggaggatgtgaagacctgtgcccgggacagcggctatgacagcctgagcaaccggctgagcatcctggaccggctgctgcacacccaccccatctggctgcagctgagcctgtctgaggaggaggccgctgaggtgctgcaggcccagcccccaggcatcttcctggtgcacaagagcaccaagatgcagaagaaggtgctgagcctgcggctgccctgtgaatttggagcccccctgaaggagtttgccatcaaggagagcacctacaccttcagcctggagggcagcggcatcagctttgctgacctcttccggctgattgccttctactgcatcagcagagatgtgctgcccttcaccctgaagctgccctatgccatcagcacagccaagtctgaggcccagctggaggagctggcccagatgggcctgaacttctggagcagccctgctgacagcaagccacccaacctgcccccaccccaccggcccctgagcagtgatggagtgtgcccagccagcctgcggcagctgtgcctgatcaacggggtgcacagcatcaagaccaggaccccatctgagctggagtgcagccagaccaatggagccctgtgcttcatcaaccccctcttcctgaaggtgcacagccaggacctgagcggcggcctgaagaggcccagcaccaggaccccaaatgccaacggcacagagaggaccaggagccccccaccccggcccccacctccagccatcaacagcctgcacaccagcccccggctggccaggacagagacccagacctccatgcctgagaccgtgaaccacaacaagcacggcaatgtggccctgcccggcaccaagcccacccccatccccccaccccggctgaagaagcaggccagcttcctggaggccgagggcggggccaagaccctgagcggcggccggcctggagctggccctgagctggagctgggcacagctggcagccctggaggagcccctcctgaggccgcccctggggactgcacccgggcccccccacccagcagcgagagcaggcctccctgccacggcggccggcagaggctgagtgacatgagcatcagcaccagcagcagtgacagcctggagtttgaccgctccatgcccctgtttggctatgaggccgacaccaacagcagcctggaggactatgaaggagagagtgaccaggagaccatggccccacccatcaagagcaagaagaagaggagcagcagctttgtgctgcccaagctggtgaagagccagctgcagaaggtgtctggagtcttcagcagcttcatgaccccagagaagaggatggtgagaagaattgctgagctgagccgggacaagtgcacctacttcggctgcctggtgcaggactatgtgtccttcctgcaggagaacaaggagtgccacgtgagcagcacagacatgctgcagaccatccggcagttcatgacccaggtgaagaactacctgagccagagcagcgagctggacccccccatcgagagcctcatccctgaggaccagattgatgtggtgctggagaaggccatgcacaagtgcatcctgaagcccctgaagggccacgtggaggccatgctgaaggacttccacatggctgatggctcctggaagcagctgaaggagaacctgcagctggtgcggcagaggaacccccaggagctgggcgtgtttgcccccaccccagactttgtggatgtggagaagatcaaggtgaagttcatgaccatgcagaagatgtacagccctgagaagaaggtgatgctgctgctgcgggtgtgcaagctgatctacacagtgatggagaacaacagcggccgcatgtacggggctgatgacttcctgcctgtgctgacctacgtgattgcccagtgtgacatgctggagctggacacagaaattgagtacatgatggagctgctggaccccagcctgctgcacggggagggcggctactacctgaccagcgcctatggagccctgagcctcatcaagaacttccaggaggagcaggccgcccggctgctgagcagcgagacccgggacaccctgcggcagtggcacaagaggaggaccaccaacagaaccatccccagcgtggatgacttccagaactacctgcgggtggccttccaggaggtgaacagcggctgcaccgggaagaccctgctggtgcggccctacatcaccacagaagatgtgtgccagatctgtgccgagaagttcaaggtgggggaccctgaggagtacagcctcttcctgtttgtggatgagacctggcagcagctggccgaggacacctacccccagaagatcaaggccgagctgcacagccggccccagccccacatcttccactttgtgtacaagaggatcaagaatgacccctacggcatcatcttccagaatggagaggaggacctgaccaccagctag

SEQ ID NO: 167176 - DNA, 1389 bp, Artificial Sequence
  Description of Artificial Sequence: Synthetic coding sequence
atgacagcctggaccatgggcgcccggggcctggacaagaggggcagcttcttcaagctgattgacaccatcgccagcgagatcggggagctgaagcaggagatggtgaggacagatgtgaacctggagaatggcctggagcctgctgagacccacagcatggtgcgccacaaggatggcggctacagcgaggaggaggatgtgaagacctgtgcccgggacagcggctatgacagcctgagcaaccggctgagcatcctggaccggctgctgcacacccaccccatctggctgcagctgagcctgtctgaggaggaggccgctgaggtgctgcaggcccagcccccaggcatcttcctggtgcacaagagcaccaagatgcagaagaaggtgctgagcctgcggctgccctgtgaatttggagcccccctgaaggagtttgccatcaaggagagcacctacaacgtggtgctggagaaggccatgcacaagtgcatcctgaagcccctgaagggccacgtggaggccatgctgaaggacttccacatggctgatggctcctggaagcagctgaaggagaacctgcagctggtgcggcagaggaacccccaggagctgggcgtgtttgcccccaccccagactttgtggatgtggagaagatcaaggtgaagttcatgaccatgcagaagatgtacagccctgagaagaaggtgatgctgctgctgcgggtgtgcaagctgatctacacagtgatggagaacaacagcggccgcatgtacggggctgatgacttcctgcctgtgctgacctacgtgattgcccagtgtgacatgctggagctggacacagaaattgagtacatgatggagctgctggaccccagcctgctgcacggggagggcggctactacctgaccagcgcctatggagccctgagcctcatcaagaacttccaggaggagcaggccgcccggctgctgagcagcgagacccgggacaccctgcggcagtggcacaagaggaggaccaccaacagaaccatccccagcgtggatgacttccagaactacctgcgggtggccttccaggaggtgaacagcggctgcaccgggaagaccctgctggtgcggccctacatcaccacagaagatgtgtgccagatctgtgccgagaagttcaaggtgggggaccctgaggagtacagcctcttcctgtttgtggatgagacctggcagcagctggccgaggacacctacccccagaagatcaaggccgagctgcacagccggccccagccccacatcttccactttgtgtacaagaggatcaagaatgacccctacggcatcatcttccagaatggagaggaggacctgaccaccagctag

SEQ ID NO: 167177 - DNA, 717 bp, Artificial Sequence
  Description of Artificial Sequence: Synthetic coding sequence
atgagcagcggctacagcagcctggaggaggatgctgaggacttcttcttcaccgcccggaccagcttcttcagaagagccccccagggcaagcccaggagcggccagcaggatgtggagaaggagaaggagacccacagctacctgagcaaggaggagatcaaggagaaggtgcacaagtacaacctggccgtgacagacaagctgaagatgaccctgaacagcaatggcatctacacaggcttcatcaaggtgcagatggagctgtgcaagccaccccagaccagccccaacagcggcaagctgagccccagcagcaatggctgcatgaacaccctgcacatcagcagcaccaacacagtgggggaggtgattgaggccctgctgaagaagttcctggtgacagagagccctgccaagtttgccctgtacaagcgctgccaccgggaggaccaggtgtatgcctgcaagctgagtgaccgggagcaccccctgtacctgcggctggtggccggccccaggacagacaccctgagctttgtgctgcgggagcatgaaattggagagtgggaggccttcagcctgcctgagctgcagaacttcctgcgcatcctggacaaggaggaggatgagcagctgcagaacctgaagaggcgctacacagcctaccggcagaagctggaggaggccctgcgggaggtgtggaagccagactag

SEQ ID NO: 167178 - DNA, 507 bp, Artificial Sequence
  Description of Artificial Sequence: Synthetic coding sequence
atgaccctgaacagcaatggcatctacacaggcttcatcaaggtgcagatggagctgtgcaagccaccccagaccagccccaacagcggcaagctgagccccagcagcaatggctgcatgaacaccctgcacatcagcagcaccaacacagtgggggaggtgattgaggccctgctgaagaagttcctggtgacagagagccctgccaagtttgccctgtacaagcgctgccaccgggaggaccaggtgtatgcctgcaagctgagtgaccgggagcaccccctgtacctgcggctggtggccggccccaggacagacaccctgagctttgtgctgcgggagcatgaaattggagagtgggaggccttcagcctgcctgagctgcagaacttcctgcgcatcctggacaaggaggaggatgagcagctgcagaacctgaagaggcgctacacagcctaccggcagaagctggaggaggccctgcgggaggtgtggaagccagactag

SEQ ID NO: 167179 - DNA, 717 bp, Artificial Sequence; identical to SEQ ID NO: 167177
  Description of Artificial Sequence: Synthetic coding sequence

SEQ ID NO: 167180 - DNA, 1014 bp, Artificial Sequence
  Description of Artificial Sequence: Synthetic coding sequence
atgaccatgatggcccaccagtaccccagctggatcttcatcaatgagaagaccttcatcacccgggagcagctgaacagcctgctgaagacctacaacatcttctatgagaaccagaagaacctgcacatcctgtatggagaaacagaagatggcaagctgattgtggagggcatgctggacatcttctggggcgtgaagaggcccatccagctgaagatccaggatgagaagcccttcagcagcttcacctccatgaagagcagtgatgtgttcagcagcaagggcatgacccgctggggcgagtttgatgacctgtaccgcatcagcgagctggacaggacccagatccccatgtctgagaagaggaacagccaggaggactacctgagctaccacagcaacaccctgaagccccacgccaaggatgagccagacagccctgtgctgtaccgcaccatgtctgaggccgccctggtgaggaagaggatgaagcccctgatgatggacaggaaggagcggcagaagaacagagccagcatcaatggccacttctacaaccacgagaccagcatcttcatcccagcctttgaaagtgagaccaaggtgcgggtgaacagcaacatgaggacagaggaggtgatcaagcagctgctgcagaagttcaagattgagaacagcccccaggactttgccctgcacatcatctttgccactggagagcagaggcggctgaagaagacagacatccccctgctgcagaggctgctgcagggccccagcgagaagaatgcccgcatcttcctgatggacaaggatgctgaggagatcagcagtgatgtggcccagtacatcaacttccacttcagcctgctggagagcatcctgcagaggctgaatgaggaggagaagcgggagatccagagaattgtgaccaagttcaacaaggagaaggccatcatcctgaagtgcctgcagaacaagctggtgatcaagacagagaccaccgtgtag

SEQ ID NO: 167181 - DNA, 978 bp, Artificial Sequence
  Description of Artificial Sequence: Synthetic coding sequence
atgctgtgggaggagaccggggccgccccagccccagcccgggccagtgacctgccctaccgcatccacttcctgagcagcggcctcatcctggtgacccggcagctgacagaagatggcaagctgattgtggagggcatgctggacatcttctggggcgtgaagaggcccatccagctgaagatccaggatgagaagcccttcagcagcttcacctccatgaagagcagtgatgtgttcagcagcaagggcatgacccgctggggcgagtttgatgacctgtaccgcatcagcgagctggacaggacccagatccccatgtctgagaagaggaacagccaggaggactacctgagctaccacagcaacaccctgaagccccacgccaaggatgagccagacagccctgtgctgtaccgcaccatgtctgaggccgccctggtgaggaagaggatgaagcccctgatgatggacaggaaggagcggcagaagaacagagccagcatcaatggccacttctacaaccacgagaccagcatcttcatcccagcctttgaaagtgagaccaaggtgcgggtgaacagcaacatgaggacagaggaggtgatcaagcagctgctgcagaagttcaagattgagaacagcccccaggactttgccctgcacatcatctttgccactggagagcagaggcggctgaagaagacagacatccccctgctgcagaggctgctgcagggccccagcgagaagaatgcccgcatcttcctgatggacaaggatgctgaggagatcagcagtgatgtggcccagtacatcaacttccacttcagcctgctggagagcatcctgcagaggctgaatgaggaggagaagcgggagatccagagaattgtgaccaagttcaacaaggagaaggccatcatcctgaagtgcctgcagaacaagctggtgatcaagacagagaccaccgtgtag

SEQ ID NO: 167182 - DNA, 1110 bp, Artificial Sequence
  Description of Artificial Sequence: Synthetic coding sequence
atgctgtgggaggagaccggggccgccccagccccagcccgggccagtgacctgccctaccgcatcagcagtgaccacctgaagaaggaggagaagatgaccatgatggcccaccagtaccccagctggatcttcatcaatgagaagaccttcatcacccgggagcagctgaacagcctgctgaagacctacaacatcttctatgagaaccagaagaacctgcacatcctgtatggagaaacagaagatggcaagctgattgtggagggcatgctggacatcttctggggcgtgaagaggcccatccagctgaagatccaggatgagaagcccttcagcagcttcacctccatgaagagcagtgatgtgttcagcagcaagggcatgacccgctggggcgagtttgatgacctgtaccgcatcagcgagctggacaggacccagatccccatgtctgagaagaggaacagccaggaggactacctgagctaccacagcaacaccctgaagccccacgccaaggatgagccagacagccctgtgctgtaccgcaccatgtctgaggccgccctggtgaggaagaggatgaagcccctgatgatggacaggaaggagcggcagaagaacagagccagcatcaatggccacttctacaaccacgagaccagcatcttcatcccagcctttgaaagtgagaccaaggtgcgggtgaacagcaacatgaggacagaggaggtgatcaagcagctgctgcagaagttcaagattgagaacagcccccaggactttgccctgcacatcatctttgccactggagagcagaggcggctgaagaagacagacatccccctgctgcagaggctgctgcagggccccagcgagaagaatgcccgcatcttcctgatggacaaggatgctgaggagatcagcagtgatgtggcccagtacatcaacttccacttcagcctgctggagagcatcctgcagaggctgaatgaggaggagaagcgggagatccagagaattgtgaccaagttcaacaaggagaaggccatcatcctgaagtgcctgcagaacaagctggtgatcaagacagagaccaccgtgtag

SEQ ID NO: 167183 - DNA, 912 bp, Artificial Sequence
  Description of Artificial Sequence: Synthetic coding sequence
atgaccatgatggcccaccagtaccccagctggatcttcatcaatgagaagaccttcatcacccgggagcagctgaacagcctgctgaagacctacaacatcttctatgagaaccagaagaacctgcacatcctgtatggagaaacagaagatggcaagctgattgtggagggcatgctggacatcttctggggcgtgaagaggcccatccagctgaagatccaggatgagaagcccttcagcagcttcacctccatgaagagcagtgatgtgttcagcagcaagggcatgacccgctggggcgagtttgatgacctgtaccgcatcagcgagctggacaggacccagatccccatgtctgagaagaggaacagccaggaggactacctgagctaccacagcaacaccctgaagccccacgccaaggatgagccagacagccctgtgctgtaccgcaccatgtctgaggccgccctggtgaggaagaggatgaagcccctgatgatggacaggaaggagcggcagaagaacagagccagcatcaatggccacttctacaaccacgagattgagaacagcccccaggactttgccctgcacatcatctttgccactggagagcagaggcggctgaagaagacagacatccccctgctgcagaggctgctgcagggccccagcgagaagaatgcccgcatcttcctgatggacaaggatgctgaggagatcagcagtgatgtggcccagtacatcaacttccacttcagcctgctggagagcatcctgcagaggctgaatgaggaggagaagcgggagatccagagaattgtgaccaagttcaacaaggagaaggccatcatcctgaagtgcctgcagaacaagctggtgatcaagacagagaccaccgtgtag

SEQ ID NO: 167184 - DNA, 3141 bp, Artificial Sequence
  Description of Artificial Sequence: Synthetic coding sequence
atgctgagcaggaccctgagctacaagtacagagacctggacagcaccttcagcagcctgggcgccagtgatgatcctgctgagctgagcacccagctgagcgcccctggggtgctgaaggtgtttggagacagcgtgtgcaccggcacccactacaagtctgtgctggccaccggcaccagcagcgcccgggagctggtgaaggaggccctggagagatatgccctggacccccggcaggccggccagtatgtgctgtgtgatgtggtgggccaggccggagatgctggccagcgctggcaggcccgctgcttccgggtgtttggagacagcgagaagcccctgctgatccaggagctgtggaagccccgggagggcctgagcagaagatttgagctgaggaagagaagtgatgtggaggagctggccgccaaggaggtggacaccatcacagctggcatcaatgcccaggcccggcggctgcagaggagccgggccaagggcacccccaccccagccctgggagatgcccggagcagccccccaccccggctgcggaggacagtgtctgagaccagcctgagccctgtgaatgccctgcctgctgctgcccagggccctgaggagcccggcccagatgccatgagatacagcctgtaccagagcccccacctgctgctgctgcagggctacagccagcagcaccctggggtgtgtgcccagcccggccctgcccacggcggccctgctgaccccagcaagcccagcatcagcctgagcgccccagacatcctgcccctgcactgcaccatccggcggcagcccctgcctgattctggccaggccgccggccgcctggtgctggagcccatccctggggcccacatctctgtgaacttcagcgaggtgggccacaggacagtggtgctgcaccacggggacctgctgagcctgggcctgtactacctgctgctcttcaaggaccctgcccaggcccagcccctgcctgcccgggccctggcccggctgcgggctgtgccccagagctgccgcctgtgtggggccgccctgggcgcccggggggccgccagccccacccaggccgccctgccccggcggcagcagctgctgctggagtttgagccccacctggaggacaccctgctgcagaggatcatgaccctcatcgagcctggaggagatgaccacaagctgaccccagccttcctgctgtgcctgtgcatccagcacagcgccacccacttccagcccggcaccttcggccagctgctgctgaagatcgcccggctcatccgggagaccgtgtgggagaagaccaaggagctggccgagaagcaggcccagctgcaggagcccatcagcctggccagctgtgccatggctgacctggtgcctgacctgcagcccatcctcttctggatgagcaacagcattgagctgctgtacttcatccagcagaagtgccccctgtacatgcagagcatggaggagcagctggacatcaccggcagcaaggagagcctcttcagctgcaccctgacagccagcgaggaggccatggctgtgctggaggaggtggtgctgtatgccttccagcagtgtgtgtactacgtgtccaagagcctgtacatctgcctgcctgccctgctggagtgcccccccttccagacagagcggcgggagagctggagcagcgcccctgagctgcctgaggagctgcggcgggtggtgtctgtgtaccaggccgccctggacctgctgcggcagctgcaggtgcaccctgaggtggccagccagatgctggcctacctgttcttcttcagcggcaccctgctgctgaaccagctgctggaccggggccccagcctgagctgcttccactggccccggggcgtgcaggcctgtgcccggctgcagcagctgctggagtggatgaggtctgctggctttggagctgctggggagcacttcttccagaagctgagctgcaccctgaacctgctggccaccccccgggcccagctgatccagatgtcctggacagccctgcgggccgccttccctgccctgagccctgcccagctgcaccggctgctgacccactaccagctggccagcgccatgggccccatgagcacctgggagcccggggcccaggacagccctgaggccttccgctcagaagatgtgctggagagctatgagaaccccccacccatcgtgctgcccagtgatggcttccaggtggacctggaggccaactgcctggatgacagcatctaccagcacctgctgtatgtgcgccacttcctgtggggcctgcggagccgggccagccctggcagccctggccggcccggcagcggggccagccagcctgtgtgcccagagggcatgcaccacgtggtgctggatggccacctggaggcccccagctgccccctggccccccgggaccccggccctgctgcccgggaggtggcccctgagaggaccctgcccctgcggggggccccctgggcccaggcccctcctggccggcagcccagcagaggaggcagccaggccggccccccccacacagacagcagctgcctgctgaccccacccagcacccccctgggccctgagcccggggaccctgactggccagagagcggcggcccctgtgggaaggccctgcctgagcggcagagaaatggcctgagcggcctgcggggagctgcccctgagggggacagcgctgccctggccgaggagagccccccagcccccagcagccgcagcagcagcacagaggacttctgctacgtgttcaccgtggagctggagcggggccccagcggcctgggcatgggcctgattgatggcatgcacacccacctgggcgcccctggcctgtacatccagaccctgctgcccggcagccctgctgctgctgatggccgcctgagcctgggggaccgcatcctggaggtgaatggcagcagcctgctgggcctgggctacctgcgggctgtggacctgatcagacatggaggcaagaagatgaggttcctggtggccaagagtgatgtggagacagccaagaagatccacttccgcaccccacccctgtag

SEQ ID NO: 167185 - DNA, 3228 bp, Artificial Sequence
  Description of Artificial Sequence: Synthetic coding sequence
atgttttatggcacccacttcatcatgagcccccccaccaagagcaagctgaagaggcagagccagctgctgagctccatgctgagcaggaccctgagctacaagtacagagacctggacagcaccttcagcagcctgggcgccagtgatgatcctgctgagctgagcacccagctgagcgcccctggggtgctgaaggtgtttggagacagcgtgtgcaccggcacccactacaagtctgtgctggccaccggcaccagcagcgcccgggagctggtgaaggaggccctggagagatatgccctggacccccggcaggccggccagtatgtgctgtgtgatgtggtgggccaggccggagatgctggccagcgctggcaggcccgctgcttccgggtgtttggagacagcgagaagcccctgctgatccaggagctgtggaagccccgggagggcctgagcagaagatttgagctgaggaagagaagtgatgtggaggagctggccgccaaggaggtggacaccatcacagctggcatcaatgcccaggcccggcggctgcagaggagccgggccaagggcacccccaccccagccctgggagatgcccggagcagccccccaccccggctgcggaggacagtgtctgagaccagcctgagccctgtgaatgccctgcctgctgctgcccagggccctgaggagcccggcccagatgccatgagatacagcctgtaccagagcccccacctgctgctgctgcagggctacagccagcagcacgacagcctggtgtatgtgctgaacagagacagacacacagtgggccagaggacccccagcagcaagcccagcatcagcctgagcgccccagacatcctgcccctgcactgcaccatccggcggcagcccctgcctgacagcggccaggccgccggccgcctggtgctggagcccatccctggggcccacatctctgtgaacttcagcgaggtgggccacaggacagtggtgctgcaccacggggacctgctgagcctgggcctgtactacctgctgctcttcaaggaccctgcccaggcccagcccctgcctgcccgggccctggcccggctgcgggctgtgccccagagctgccgcctgtgtggggccgccctgggcgcccggggagctgccagccccacccaggccgccctgccccggcggcagcagctgctgctggagtttgagccccacctggaggacaccctgctgcagaggatcatgaccctgattgagcctggaggagatgaccacaagctgaccccagccttcctgctgtgcctgtgcatccagcacagcgccacccacttccagcccggcaccttcggccagctgctgctgaagatcgcccggctcatccgggagaccgtgtgggagaagaccaaggagctggccgagaagcaggcccagctgcaggagcccatcagcctggccagctgtgccatggctgacctggtgcctgacctgcagcccatcctcttctggatgagcaacagcattgagctgctgtacttcatccagcagaagtgccccctgtacatgcagagcatggaggagcagctggacatcaccggcagcaaggagagcctcttcagctgcaccctgacagccagcgaggaggccatggctgtgctggaggaggtggtgctgtatgccttccagcagtgtgtgtactacgtgtccaagagcctgtacatctgcctgcctgccctgctggagtgcccccccttccagacagaaagaagagagagctggagcagcgcccctgagctgcctgaggagctgcggcgggtggtgtctgtgtaccaggccgccctggacctgctgcggcagctgcaggtgcaccctgaggtggccagccagatgctggcctacctgttcttcttcagcggcaccctgctgctgaaccagctgctggaccggggccccagcctgagctgcttccactggccccggggcgtgcaggcctgtgcccggctgcagcagctgctggagtggatgaggtctgctggctttggagctgctggggagcacttcttccagaagctgagctgcaccctgaacctgctggccaccccccgggcccagctgatccagatgtcctggacagccctgcgggccgccttccctgccctgagccctgcccagctgcaccggctgctgacccactaccagctggccagcgccatgggccccatgagcacctgggagcccggggcccaggacagccctgaggccttccgctcagaagatgtgctggagagctatgaaaatcctccacccatcgtgctgcccagtgatggcttccaggtggacctggaggccaactgcctggatgacagcatctaccagcacctgctgtatgtgcgccacttcctgtggggcctgcggagccgggccagccctggcagccctggccggcccggcagcggggccagccagcctgtgtgcccagagggcatgcaccacgtggtgctggatggccacctggaggcccccagctgccccctggccccccgggaccccggccctgctgcccgggaggtggcccctgagaggaccctgcccctgcggggggccccctgggcccaggcccctcctggccggcagcccagccggggcggcagccaggccggccccccccacacagacagcagctgcctgctgaccccacccagcacccccctgggccctgagcccggggaccctgactggccagagagcggcggcccctgtgggaaggccctgcctgagcggcagagaaatggcctgagcggcctgcggggggccgcccctgagggggacagcgctgccctggccgaggagagccccccagcccccagcagccgcagcagcagcacagaggacttctgctacgtgttcaccgtggagctggagcggggccccagcggcctgggcatgggcctgattgatggcatgcacacccacctgggcgcccctggcctgtacatccagaccctgctgcccggcagccctgctgctgctgatggccgcctgagcctgggggaccgcatcctggaggtgaatggcagcagcctgctgggcctgggctacctgcgggctgtggacctgatccgccacggcggcaagaagatgaggttcctggtggccaagagtgatgtggagacagccaagaagatccacttccgcaccccacccctgtag

SEQ ID NO: 167186 - DNA, 405 bp, Artificial Sequence
  Description of Artificial Sequence: Synthetic coding sequence
atgttttatggcacccacttcatcatgagcccccccaccaagagcaagctgaagaggcagagccagctgctgagctccatgctgagcaggaccctgagctacaagtacagagacctggacagcaccttcagcagcctgggcgccagtgatgatcctgctgagctgagcacccagctgagcgcccctggggtgctgaaggtgtttggagacagcgtgtgcaccggcacccactacaagtctgtgctggccaccggcaccagcagcgcccgggagctggtgaaggaggccctggagagatatgccctggacccccggcaggccggccagtatgtgctgtgtgatgtggtgggccaggccggagatgctggccagcgctggcaggcccgctgcttccgggtcttctag

SEQ ID NO: 167187 - DNA, 1629 bp, Artificial Sequence
  Description of Artificial Sequence: Synthetic coding sequence
atgttttatggcacccacttcatcatgagcccccccaccaagagcaagctgaagaggcagagccagctgctgagctccatgctgagcaggaccctgagctacaagtacagagacctggacagcaccttcagcagcctgggcgccagtgatgatcctgctgagctgagcacccagctgagcgcccctggggtgctgaaggtgtttggagacagcgtgtgcaccggcacccactacaagtctgtgctggccaccggcaccagcagcgcccgggagctggtgaaggaggccctggagagatatgccctggacccccggcaggccggccagtatgtgctgtgtgatgtggtgggccaggccggagatgctggccagcgctggcaggcccgctgcttccgggtgtttggagacagcgagaagcccctgctgatccaggagctgtggaagccccgggagggcctgagcagaagatttgagctgaggaagagaagtgatgtggaggagctggccgccaaggaggtggacaccatcacagctggcatcaatgcccaggcccggcggctgcagaggagccgggccaagggcacccccaccccagccctgggagatgcccggagcagccccccaccccggctgcggaggacagtgtctgagaccagcctgagccctgtgaatgccctgcctgctgctgcccagggccctgaggagcccggcccagatgccatgagatacagcctgtaccagagcccccacctgctgctgctgcagggctacagccagcagcacgacagcctggtgtatgtgctgaacagagacagacacacagtgggccagaggacccccagcagcaagcccagcatcagcctgagcgccccagacatcctgcccctgcactgcaccatccggcggcagcccctgcctgacagcggccaggccgccggccgcctggtgctggagcccatccctggggcccacatctctgtgaacttcagcgaggtgggccacaggacagtggtgctgcaccacggggacctgctgagcctgggcctgtactacctgctgctcttcaaggaccctgcccaggcccagcccctgcctgcccgggccctggcccggctgcgggctgtgccccagagctgccgcctgtgtggggccgccctgggcgcccggggagctgccagccccacccaggccgccctgccccggcggcagcagctgctgctggagtttgagccccacctggaggacaccctgctgcagaggatcatgaccctgattgagcctggaggagatgaccacaagctgaccccagccttcctgctgtgcctgtgcatccagcacagcgccacccacttccagcccggcaccttcggccagctgctgctgaagatcgcccggctcatccgggagaccgtgtgggagaagaccaaggagctggccgagaagcaggcccagctgctggagggcattgctgtgctgctgcatgctgatggccagaggggcggccacggcggggccggcggcggcggcgctgtgcggctgcctgctgtgcggctgctgtgcctgcaggtgcctgtgcacctgcccccaggcaccccaggagtgcctgccatcccagatggagccccctag

SEQ ID NO: 167188 - DNA, 2508 bp, Artificial Sequence
  Description of Artificial Sequence: Synthetic coding sequence
atgagatacagcctgtaccagagcccccacctgctgctgctgcagggctacagccagcagcacgacagcctggtgtatgtgctgaacagagacagacacacagtgggccagaggacccccagcagcaagcccagcatcagcctgagcgccccagacatcctgcccctgcactgcaccatccggcggcagcccctgcctgacagcggccaggccgccggccgcctggtgctggagcccatccctggggcccacatctctgtgaacttcagcgaggtgggccacaggacagtggtgctgcaccacggggacctgctgagcctgggcctgtactacctgctgctcttcaaggaccctgcccaggcccagcccctgcctgcccgggccctggcccggctgcgggctgtgccccagagctgccgcctgtgtggggccgccctgggcgcccggggagctgccagccccacccaggccgccctgccccggcggcagcagctgctgctggagtttgagccccacctggaggacaccctgctgcagaggatcatgaccctgattgagcctggaggagatgaccacaagctgaccccagccttcctgctgtgcctgtgcatccagcacagcgccacccacttccagcccggcaccttcggccagctgctgctgaagatcgcccggctcatccgggagaccgtgtgggagaagaccaaggagctggccgagaagcaggcccagctgcaggagcccatcagcctggccagctgtgccatggctgacctggtgcctgacctgcagcccatcctcttctggatgagcaacagcattgagctgctgtacttcatccagcagaagtgccccctgtacatgcagagcatggaggagcagctggacatcaccggcagcaaggagagcctcttcagctgcaccctgacagccagcgaggaggccatggctgtgctggaggaggtggtgctgtatgccttccagcagtgtgtgtactacgtgtccaagagcctgtacatctgcctgcctgccctgctggagtgcccccccttccagacagaaagaagagagagctggagcagcgcccctgagctgcctgaggagctgcggcgggtggtgtctgtgtaccaggccgccctggacctgctgcggcagctgcaggtgcaccctgaggtggccagccagatgctggcctacctgttcttcttcagcggcaccctgctgctgaaccagctgctggaccggggccccagcctgagctgcttccactggccccggggcgtgcaggcctgtgcccggctgcagcagctgctggagtggatgaggtctgctggctttggagctgctggggagcacttcttccagaagctgagctgcaccctgaacctgctggccaccccccgggcccagctgatccagatgtcctggacagccctgcgggccgccttccctgccctgagccctgcccagctgcaccggctgctgacccactaccagctggccagcgccatgggccccatgagcacctgggagcccggggcccaggacagccctgaggccttccgctcagaagatgtgctggagagctatgaaaatcctccacccatcgtgctgcccagtgatggcttccaggtggacctggaggccaactgcctggatgacagcatctaccagcacctgctgtatgtgcgccacttcctgtggggcctgcggagccgggccagccctggcagccctggccggcccggcagcggggccagccagcctgtgtgcccagagggcatgcaccacgtggtgctggatggccacctggaggcccccagctgccccctggccccccgggaccccggccctgctgcccgggaggtggcccctgagaggaccctgcccctgcggggggccccctgggcccaggcccctcctggccggcagcccagccggggcggcagccaggccggccccccccacacagacagcagctgcctgctgaccccacccagcacccccctgggccctgagcccggggaccctgactggccagagagcggcggcccctgtgggaaggccctgcctgagcggcagagaaatggcctgagcggcctgcggggggccgcccctgagggggacagcgctgccctggccgaggagagccccccagcccccagcagccgcagcagcagcacagaggacttctgctacgtgttcaccgtggagctggagcggggccccagcggcctgggcatgggcctgattgatggcatgcacacccacctgggcgcccctggcctgtacatccagaccctgctgcccggcagccctgctgctgctgatggccgcctgagcctgggggaccgcatcctggaggtgaatggcagcagcctgctgggcctgggctacctgcgggctgtggacctgatccgccacggcggcaagaagatgaggttcctggtggccaagagtgatgtggagacagccaagaagatccacttccgcaccccacccctgtag

SEQ ID NO: 167189 - DNA, 2085 bp, Artificial Sequence
  Description of Artificial Sequence: Synthetic coding sequence
atgtgcagcacaggcaccggcacccgctgggccagcggccccccaccagccagccctgccagcgccagccagccccccaccagctgcctgtacacagcccccagcgctggcaacagaagcaggacagctgcccggccccggggcggctggctggagcccatccctggggcccacatctctgtgaacttcagcgaggtgggccacaggacagtggtgctgcaccacggggacctgctgagcctgggcctgtactacctgctgctcttcaaggaccctgcccaggcccagcccctgcctgcccgggccctggcccggctgcgggctgtgccccagagctgccgcctgtgtggggccgccctgggcgcccggggagctgccagccccacccaggccgccctgccccggcggcagcagctgctgctggagtttgagccccacctggaggacaccctgctgcagaggatcatgaccctgattgagcctggaggagatgaccacaagctgaccccagccttcctgctgtgcctgtgcatccagcacagcgccacccacttccagcccggcaccttcggccagctgctgctgaagatcgcccggctcatccgggagaccgtgtgggagaagaccaaggagctggccgagaagcaggcccagctgcaggagcccatcagcctggccagctgtgccatggctgacctggtgcctgacctgcagcccatcctcttctggatgagcaacagcattgagctgctgtacttcatccagcagaagtgccccctgtacatgcagagcatggaggagcagctggacatcaccggcagcaaggagagcctcttcagctgcaccctgacagccagcgaggaggccatggctgtgctggaggaggtggtgctgtatgccttccagcagtgtgtgtactacgtgtccaagagcctgtacatctgcctgcctgccctgctggagtgcccccccttccagacagaaagaagagagagctggagcagcgcccctgagctgcctgaggagctgcggcgggtggtgtctgtgtaccaggccgccctggacctgctgcggcagctgcaggtgcaccctgaggtggccagccagatgctggcctacctgttcttcttcagcggcaccctgctgctgaaccagctgctggaccggggccccagcctgagctgcttccactggccccggggcgtgcaggcctgtgcccggctgcagcagctgctggagtggatgaggtctgctggctttggagctgctggggagcacttcttccagaagctgagctgcaccctgaacctgctggccaccccccgggcccagctgatccagatgtcctggacagccctgcgggccgccttccctgccctgagccctgcccagctgcaccggctgctgacccactaccagctggccagcgccatgggccccatgagcacctgggagcccggggcccaggacagccctgaggccttccgctcagaagatgtgctggagagctatgaaaatcctccacccatcgtgctgcccagtgatggcttccaggtggacctggaggccaactgcctggatgacagcatctaccagcacctgctgtatgtgcgccacttcctgtggggcctgcggagccgggccagccctggcagccctggccggcccggcagcggggccagccagcctgtgtgcccagagggcatgcaccacgtggtgctggatggccacctggaggcccccagctgccccctggccccccgggaccccggccctgctgcccgggaggtggcccctgagaggaccctgcccctgcggggggccccctgggcccaggcccctcctggccggcagcccccaggcctgtacatccagaccctgctgcccggcagccctgctgctgctgatggccgcctgagcctgggggaccgcatcctggaggtgaatggcagcagcctgctgggcctgggctacctgcgggctgtggacctgatcagacatggaggcaagaagatgaggttcctggtggccaagagtgatgtggagacagccaagaagatccacttccgcaccccacccctgtag

SEQ ID NO: 167190 - DNA, 369 bp, Artificial Sequence
  Description of Artificial Sequence: Synthetic coding sequence
atgaagctggccgccatgatcaagaagatgtgccccagcgacagcgagctgagcatcccagccaagaactgctacaggatggtgatcctgggcagcagcaaggtgggcaagacagccatcgtgagccgcttcctgaccggccgctttgaagatgcctacacccccaccatcgaggacttccacaggaagttctacagcatccggggggaggtgtaccagctggacatcctggacaccagcggcaaccaccccttccctgccatgaggcggctgagcatcctgacagaccccaggcaccaggtgctgccccaggagcagaaccagggcgagcggggccgggcccctggccacctgcggcagcagggctag

SEQ ID NO: 167191 - DNA, 2394 bp, Artificial Sequence
  Description of Artificial Sequence: Synthetic coding sequence
atgggcaccctgggcaaggcccgggaggcccccaggaagcccagccacggctgccgggccgccagcaaggcccggctggaggccaagccagccaacagccccttccccagccaccccagcctggcccacatcacccagttcaggatgatggtgtccctgggccacctggccaagggggccagcctggatgacctgattgacagctgcatccagagctttgatgctgatggcaacctgtgccgcagcaaccagctgctgcaggtgatgctgaccatgcacagaattgtcatcagcagcgctgagctgctgcagaaggtgatcaccctgtacaaggatgccctggccaagaacagccctggcctgtgcctgaagatctgctactttgtgcgctactggatcacagagttctgggtgatgttcaagatggatgccagcctgacagacaccatggaggagttccaggagctggtgaaggccaagggggaggagctgcactgccgcctgattgacaccacccagatcaatgcccgggactggagcaggaagctgacccagaggatcaagagcaacaccagcaagaagaggaaggtgtccctgctgtttgaccacctggagcctgaggagctgtctgagcacctgacctacctggagttcaagagcttccgccgcatctccttcagtgactaccagaactacctggtgaacagctgtgtgaaggagaaccccaccatggagaggagcatcgccctgtgcaatggcatcagccagtgggtgcagctgatggtgctgagccggcccaccccccagctgcgggcagaggtgttcatcaagttcatccaggtggcccagaagctgcaccagctgcagaacttcaacaccctgatggccgtcatcggcggcctgtgccacagcagcatcagccggctgaaggagaccagcagccacgtgccccatgagatcaacaaggtgctgggggagatgacagagctgctgagcagcagcagaaattatgacaactacagaagagcctacggggagtgcacagacttcaagatccccatcctgggcgtgcacctgaaggacctgatcagcctgtatgaggccatgccagactacctggaggatggcaaggtgaatgtgcacaagctgctggccctgtacaaccacatcagcgagctggtgcagctgcaggaggtggccccacccctggaggccaacaaggacctggtgcacctgctgaccctgagcctggacctgtactacacagaagatgagatctatgagctgtcctatgcccgggagcccaggaaccaccgggccccacccctgacccccagcaagccccctgtggtggtggactgggccagcggcgtgagccccaagccagaccccaagaccatcagcaagcacgtgcagaggatggtggacagcgtcttcaagaactatgaccatgaccaggacggctacatcagccaggaggagtttgagaagattgctgccagcttccccttctccttctgtgtgatggacaaggaccgggagggcctcatcagcagagatgagatcacagcctacttcatgagggccagcagcatctacagcaagctgggcctgggcttcccccacaacttccaggagaccacctacctgaagcccaccttctgtgacaactgtgccggcttcctgtggggcgtcatcaagcagggctaccgctgcaaggactgtggcatgaactgccacaagcagtgcaaggacctggtggtgtttgagtgcaagaagagggccaagaaccctgtggcccccacagagaacaacacctctgtgggccctgtgagcaacctgtgcagcctgggcgccaaggacctgctgcacgcccctgaggagggccccttcaccttccccaatggagaggccgtggagcacggggaggagagcaaggacaggaccatcatgctgatgggcgtgagcagccagaagatcagcctgcggctgaagagagctgtggcccacaaggccacccagacagagagccagccctggattggcagcgagggccccagcggcccctttgtgctgagcagccccaggaagacagcccaggacaccctgtatgtgctgcccagccccaccagcccctgccccagccctgtgctggtgaggaagagggcctttgtgaagtgggagaacaaggacagcctcatcaagagcaaggaggagctgcggcacctgcggctgcccacctaccaggagctggagcaggagatcaacaccctgaaggctgacaatgatgccctgaagatccagctgaagtatgcccagaagaagattgagagcctgcagctggagaagagcaaccacgtgctggcccagatggagcagggcgactgcagctag

SEQ ID NO: 167192 - DNA, 1794 bp, Artificial Sequence
  Description of Artificial Sequence: Synthetic coding sequence
atgggcaccctgggcaaggcccgggaggcccccaggaagcccagccacggctgccgggccgccagcaaggcccggctggaggccaagccagccaacagccccttccccagccaccccagcctggcccacatcacccagttcaggatgatggtgtccctgggccacctggccaagggggccagcctggatgacctgattgacagctgcatccagagctttgatgctgatggcaacctgtgccgcagcaaccagctgctgcaggtgatgctgaccatgcacagaattgtcatcagcagcgctgagctgctgcagaaggtgatcaccctgtacccagatgccctggccaagaacagccctggcctgtgcctgaagatctgctactttgtgcgctactggatcacagagttctgggtgatgttcaagatggatgccagcctgacagacaccatggaggagttccaggagctggtgaaggccaagggggaggagctgcactgccgcctgattgacaccacccagatcaatgcccgggactggagcaggaagctgacccagaggatcaagagcaacaccagcaagaagaggaaggtgtccctgctgtttgaccacctggagcctgaggagctgtctgagcacctgacctacctggagttcaagagcttccgccgcatctccttcagtgactaccagaactacctggtgaacagctgtgtgaaggagaaccccaccatggagaggagcatcgccctgtgcaatggcatcagccagtgggtgcagctgatggtgctgagccggcccaccccccagctgcgggcagaggtgttcatcaagttcatccaggtggcccagaagctgcaccagctgcagaacttcaacaccctgatggccgtcatcggcggcctgtgccacagcagcatcagccggctgaaggagaccagcagccacgtgccccatgagatcaacaaggtgctgggggagatgacagagctgctgagcagcagcagaaattatgacaactacagaagagcctacggggagtgcacagacttcaagatccccatcctgggcgtgcacctgaaggacctgatcagcctgtatgaggccatgccagactacctggaggatggcaaggtgaatgtgcacaagctgctggccctgtacaaccacatcagcgagctggtgcagctgcaggaggtggccccacccctggaggccaacaaggacctggtgcacctgctgaccctgagcctggacctgtactacacagaagatgagatctatgagctgtcctatgcccgggagcccaggaaccaccgggcccccagcgtcttcaagaactatgaccatgaccaggacggctacatcagccaggaggagtttgagaagattgctgccagcttccccttctccttctgtgtgatggacaaggaccgggagggcctcatcagcagagatgagatcacagcctacttcatgagggccagcagcatctacagcaagctgggcctgggcttcccccacaacttccaggagaccacctacctgaagcccaccttctgtgacaactgtgccggcttcctgtggggcgtcatcaagcagggctaccgctgcaaggactgtggcatgaactgccacaagcagtgcaaggacctggtggtgtttgagtgcaagaagagggccaagaaccctgtggcccccacagagaacaacacctctgtgggccctgtgagcaacctgtgcagcctgggcgccaaggacctgctgcacggcaacaagtacagcgagagcaggtag

SEQ ID NO: 167193 - DNA, 1641 bp, Artificial Sequence
  Description of Artificial Sequence: Synthetic coding sequence
atgggcaccctgggcaaggcccgggaggcccccaggaagcccagccacggctgccgggccgccagcaaggcccggctggaggccaagccagccaacagccccttccccagccaccccagcctggcccacatcacccagttcaggatgatggtgtccctgggccacctggccaagggggccagcctggatgacctgattgacagctgcatccagagctttgatgctgatggcaacctgtgccgcagcaaccagctgctgcaggtgatgctgaccatgcacagaattgtcatcagcagcgctgagctgctgcagaaggtgatcaccctgtacccagatgccctggccaagaacagccctggcctgtgcctgaagatctgctactttgtgcgctactggatcacagagttctgggtgatgttcaagatggatgccagcctgacagacaccatggaggagttccaggagctggtgaaggccaagggggaggagctgcactgccgcctgattgacaccacccagatcaatgcccgggactggagcaggaagctgacccagaggatcaagagcaacaccagcaagaagaggaaggtgtccctgctgtttgaccacctggagcctgaggagctgtctgagcacctgacctacctggagttcaagagcttccgccgcatctccttcagtgactaccagaactacctggtgaacagctgtgtgaaggagaaccccaccatggagaggagcatcgccctgtgcaatggcatcagccagtgggtgcagctgatggtgctgagccggcccaccccccagctgcgggcagaggtgttcatcaagttcatccaggtggcccagaagctgcaccagctgcagaacttcaacaccctgatggccgtcatcggcggcctgtgccacagcagcatcagccggctgaaggagaccagcagccacgtgccccatgagatcaacaaggtgctgggggagatgacagagctgctgagcagcagcagaaattatgacaactacagaagagcctacggggagtgcacagacttcaagatccccatcctgggcgtgcacctgaaggacctgatcagcctgtatgaggccatgccagactacctggaggatggcaaggtgaatgtgcacaagctgctggccctgtacaaccacatcagcgagctggtgcagctgcaggaggtggccccacccctggaggccaacaaggacctggtgcacctgctgaccctgagcctggacctgtactacacagaagatgagatctatgagctgtcctatgcccgggagcccaggaaccaccgggcccccagcgtcttcaagaactatgaccatgaccaggacggctacatcagccaggaggagtttgagaagattgctgccagcttccccttctccttctgtgtgatggacaaggaccgggagggcctcatcagcagagatgagatcacagcctacttcatgagggccagcagcatctacagcaagctgggcctgggcttcccccacaacttccaggagaccacctacctgaagcccaccttctgtgacaactgtgccggcttcctgtggggcgtcatcaagcagggctaccgctgcaagggcaacaagtacagcgagagcaggtag

SEQ ID NO: 167194 - DNA, 2289 bp, Artificial Sequence
  Description of Artificial Sequence: Synthetic coding sequence
atgggcaccctgggcaaggcccgggaggcccccaggaagcccagccacggctgccgggccgccagcaaggcccggctggaggccaagccagccaacagccccttccccagccaccccagcctggcccacatcacccagttcaggatgatggtgtccctgggccacctggccaagggggccagcctggatgacctgattgacagctgcatccagagctttgatgctgatggcaacctgtgccgcagcaaccagctgctgcaggtgatgctgaccatgcacagaattgtcatcagcagcgctgagctgctgcagaaggtgatcaccctgtacaaggatgccctggccaagaacagccctggcctgtgcctgaagatctgctactttgtgcgctactggatcacagagttctgggtgatgttcaagatggatgccagcctgacagacaccatggaggagttccaggagctggtgaaggccaagggggaggagctgcactgccgcctgattgacaccacccagatcaatgcccgggactggagcaggaagctgacccagaggatcaagagcaacaccagcaagaagaggaaggtgtccctgctgtttgaccacctggagcctgaggagctgtctgagcacctgacctacctggagttcaagagcttccgccgcatctccttcagtgactaccagaactacctggtgaacagctgtgtgaaggagaaccccaccatggagaggagcatcgccctgtgcaatggcatcagccagtgggtgcagctgatggtgctgagccggcccaccccccagctgcgggcagaggtgttcatcaagttcatccaggtggcccagaagctgcaccagctgcagaacttcaacaccctgatggccgtcatcggcggcctgtgccacagcagcatcagccggctgaaggagaccagcagccacgtgccccatgagatcaacaaggtgctgggggagatgacagagctgctgagcagcagcagaaattatgacaactacagaagagcctacggggagtgcacagacttcaagatccccatcctgggcgtgcacctgaaggacctgatcagcctgtatgaggccatgccagactacctggaggatggcaaggtgaatgtgcacaagctgctggccctgtacaaccacatcagcgagctggtgcagctgcaggaggtggccccacccctggaggccaacaaggacctggtgcacctgctgaccctgagcctggacctgtactacacagaagatgagatctatgagctgtcctatgcccgggagcccaggaaccaccgggcccccagcgtcttcaagaactatgaccatgaccaggacggctacatcagccaggaggagtttgagaagattgctgccagcttccccttctccttctgtgtgatggacaaggaccgggagggcctcatcagcagagatgagatcacagcctacttcatgagggccagcagcatctacagcaagctgggcctgggcttcccccacaacttccaggagaccacctacctgaagcccaccttctgtgacaactgtgccggcttcctgtggggcgtcatcaagcagggctaccgctgcaaggactgtggcatgaactgccacaagcagtgcaaggacctggtggtgtttgagtgcaagaagagggccaagaaccctgtggcccccacagagaacaacacctctgtgggccctgtgagcaacctgtgcagcctgggcgccaaggacctgctgcacgcccctgaggagggccccttcaccttccccaacggggaggccgtggagcacggggaggagagcaaggacaggaccatcatgctgatgggcgtgagcagccagaagatcagcctgcggctgaagagagctgtggcccacaaggccacccagacagagagccagccctggattggcagcgagggccccagcggcccctttgtgctgagcagccccaggaagacagcccaggacaccctgtatgtgctgcccagccccaccagcccctgccccagccctgtgctggtgaggaagagggcctttgtgaagtgggagaacaaggacagcctcatcaagagcaaggaggagctgcggcacctgcggctgcccacctaccaggagctggagcaggagatcaacaccctgaaggctgacaatgatgccctgaagatccagctgaagtatgcccagaagaagattgagagcctgcagctggagaagagcaaccacgtgctggcccagatggagcagggcgactgcagctag

SEQ ID NO: 167195 - DNA, 2250 bp, Artificial Sequence
  Description of Artificial Sequence: Synthetic coding sequence
atgatggtgtccctgggccacctggccaagggggccagcctggatgacctgattgacagctgcatccagagctttgatgctgatggcaacctgtgccgcagcaaccagctgctgcaggtgatgctgaccatgcacagaattgtcatcagcagcgctgagctgctgcagaaggtgatcaccctgtacaaggatgccctggccaagaacagccctggcctgtgcctgaagatctgctactttgtgcgctactggatcacagagttctgggtgatgttcaagatggatgccagcctgacagacaccatggaggagttccaggagctggtgaaggccaagggggaggagctgcactgccgcctgattgacaccacccagatcaatgcccgggactggagcaggaagctgacccagaggatcaagagcaacaccagcaagaagaggaaggtgtccctgctgtttgaccacctggagcctgaggagctgtctgagcacctgacctacctggagttcaagagcttccgccgcatctccttcagtgactaccagaactacctggtgaacagctgtgtgaaggagaaccccaccatggagaggagcatcgccctgtgcaatggcatcagccagtgggtgcagctgatggtgctgagccggcccaccccccagctgcgggcagaggtgttcatcaagttcatccaggtggcccagaagctgcaccagctgcagaacttcaacaccctgatggccgtcatcggcggcctgtgccacagcagcatcagccggctgaaggagaccagcagccacgtgccccatgagatcaacaaggtgctgggggagatgacagagctgctgagcagcagcagaaattatgacaactacagaagagcctacggggagtgcacagacttcaagatccccatcctgggcgtgcacctgaaggacctgatcagcctgtatgaggccatgccagactacctggaggatggcaaggtgaatgtgcacaagctgctggccctgtacaaccacatcagcgagctggtgcagctgcaggaggtggccccacccctggaggccaacaaggacctggtgcacctgctgaccctgagcctggacctgtactacacagaagatgagatctatgagctgtcctatgcccgggagcccaggaaccaccgggccccacccctgacccccagcaagccccctgtggtggtggactgggccagcggcgtgagccccaagccagaccccaagaccatcagcaagcacgtgcagaggatggtggacagcgtcttcaagaactatgaccatgaccaggacggctacatcagccaggaggagtttgagaagattgctgccagcttccccttctccttctgtgtgatggacaaggaccgggagggcctcatcagcagagatgagatcacagcctacttcatgagggccagcagcatctacagcaagctgggcctgggcttcccccacaacttccaggagaccacctacctgaagcccaccttctgtgacaactgtgccggcttcctgtggggcgtcatcaagcagggctaccgctgcaaggactgtggcatgaactgccacaagcagtgcaaggacctggtggtgtttgagtgcaagaagagggccaagaaccctgtggcccccacagagaacaacacctctgtgggccctgtgagcaacctgtgcagcctgggcgccaaggacctgctgcacgcccctgaggagggccccttcaccttccccaatggagaggccgtggagcacggggaggagagcaaggacaggaccatcatgctgatgggcgtgagcagccagaagatcagcctgcggctgaagagagctgtggcccacaaggccacccagacagagagccagccctggattggcagcgagggccccagcggcccctttgtgctgagcagccccaggaagacagcccaggacaccctgtatgtgctgcccagccccaccagcccctgccccagccctgtgctggtgaggaagagggcctttgtgaagtgggagaacaaggacagcctcatcaagagcaaggaggagctgcggcacctgcggctgcccacctaccaggagctggagcaggagatcaacaccctgaaggctgacaatgatgccctgaagatccagctgaagtatgcccagaagaagattgagagcctgcagctggagaagagcaaccacgtgctggcccagatggagcagggcgactgcagctag

SEQ ID NO: 167196 - DNA, 1446 bp, Artificial Sequence
  Description of Artificial Sequence: Synthetic coding sequence
atgggcaccctgggcaaggcccgggaggcccccaggaagcccagccacggctgccgggccgccagcaaggcccggctggaggccaagccagccaacagccccttccccagccaccccagcctggcccacatcacccagttcaggatgatggtgtccctgggccacctggccaagggggccagcctggatgacctgattgacagctgcatccagagctttgatgctgatggcaacctgtgccgcagcaaccagctgctgcaggtgatgctgaccatgcacagaattgtcatcagcagcgctgagctgctgcagaaggtgatcaccctgtacccagatgccctggccaagaacagccctggcctgtgcctgaagatctgctactttgtgcgctactggatcacagagttctgggtgatgttcaagatggatgccagcctgacagacaccatggaggagttccaggagctggtgaaggccaagggggaggagctgcactgccgcctgattgacaccacccagatcaatgcccgggactggagcaggaagctgacccagaggatcaagagcaacaccagcaagaagaggaaggtgtccctgctgtttgaccacctggagcctgaggagctgtctgagcacctgacctacctggagttcaagagcttccgccgcatctccttcagtgactaccagaactacctggtgaacagctgtgtgaaggagaaccccaccatggagaggagcatcgccctgtgcaatggcatcagccagtgggtgcagctgatggtgctgagccggcccaccccccagctgcgggcagaggtgttcatcaagttcatccaggtggcccagaagctgcaccagctgcagaacttcaacaccctgatggccgtcatcggcggcctgtgccacagcagcatcagccggctgaaggagaccagcagccacgtgccccatgagatcaacaaggtgctgggggagatgacagagctgctgagcagcagcagaaattatgacaactacagaagagcctacggggagtgcacagacttcaagatccccatcctgggcgtgcacctgaaggacctgatcagcctgtatgaggccatgccagactacctggaggatggcaaggtgaatgtgcacaagctgctggccctgtacaaccacatcagcgagctggtgcagctgcaggaggtggccccacccctggaggccaacaaggacctggtgcacctgctgaccctgagcctggacctgtactacacagaagatgagatctatgagctgtcctatgcccgggagcccaggaaccaccgggcccccagcgtcttcaagaactatgaccatgaccaggacggctacatcagccaggaggagtttgagaagattgctgccagcttccccttctccttctgtgtgatggacaaggacagaagtggggcctag

SEQ ID NO: 167197 - DNA, 1641 bp, Artificial Sequence
  Description of Artificial Sequence: Synthetic coding sequence
atgggcaccctgggcaaggcccgggaggcccccaggaagcccagccacggctgccgggccgccagcaaggcccggctggaggccaagccagccaacagccccttccccagccaccccagcctggcccacatcacccagttcaggatgatggtgtccctgggccacctggccaagggggccagcctggatgacctgattgacagctgcatccagagctttgatgctgatggcaacctgtgccgcagcaaccagctgctgcaggtgatgctgaccatgcacagaattgtcatcagcagcgctgagctgctgcagaaggtgatcaccctgtacaaggatgccctggccaagaacagccctggcctgtgcctgaagatctgctactttgtgcgctactggatcacagagttctgggtgatgttcaagatggatgccagcctgacagacaccatggaggagttccaggagctggtgaaggccaagggggaggagctgcactgccgcctgattgacaccacccagatcaatgcccgggactggagcaggaagctgacccagaggatcaagagcaacaccagcaagaagaggaaggtgtccctgctgtttgaccacctggagcctgaggagctgtctgagcacctgacctacctggagttcaagagcttccgccgcatctccttcagtgactaccagaactacctggtgaacagctgtgtgaaggagaaccccaccatggagaggagcatcgccctgtgcaatggcatcagccagtgggtgcagctgatggtgctgagccggcccaccccccagctgcgggcagaggtgttcatcaagttcatccaggtggcccagaagctgcaccagctgcagaacttcaacaccctgatggccgtcatcggcggcctgtgccacagcagcatcagccggctgaaggagaccagcagccacgtgccccatgagatcaacaaggtgctgggggagatgacagagctgctgagcagcagcagaaattatgacaactacagaagagcctacggggagtgcacagacttcaagatccccatcctgggcgtgcacctgaaggacctgatcagcctgtatgaggccatgccagactacctggaggatggcaaggtgaatgtgcacaagctgctggccctgtacaaccacatcagcgagctggtgcagctgcaggaggtggccccacccctggaggccaacaaggacctggtgcacctgctgaccctgagcctggacctgtactacacagaagatgagatctatgagctgtcctatgcccgggagcccaggaaccaccgggcccccagcgtcttcaagaactatgaccatgaccaggacggctacatcagccaggaggagtttgagaagattgctgccagcttccccttctccttctgtgtgatggacaaggaccgggagggcctcatcagcagagatgagatcacagcctacttcatgagggccagcagcatctacagcaagctgggcctgggcttcccccacaacttccaggagaccacctacctgaagcccaccttctgtgacaactgtgccggcttcctgtggggcgtcatcaagcagggctaccgctgcaagggcaacaagtacagcgagagcaggtag

SEQ ID NO: 167198 - DNA, 1794 bp, Artificial Sequence
  Description of Artificial Sequence: Synthetic coding sequence
atgggcaccctgggcaaggcccgggaggcccccaggaagcccagccacggctgccgggccgccagcaaggcccggctggaggccaagccagccaacagccccttccccagccaccccagcctggcccacatcacccagttcaggatgatggtgtccctgggccacctggccaagggggccagcctggatgacctgattgacagctgcatccagagctttgatgctgatggcaacctgtgccgcagcaaccagctgctgcaggtgatgctgaccatgcacagaattgtcatcagcagcgctgagctgctgcagaaggtgatcaccctgtacaaggatgccctggccaagaacagccctggcctgtgcctgaagatctgctactttgtgcgctactggatcacagagttctgggtgatgttcaagatggatgccagcctgacagacaccatggaggagttccaggagctggtgaaggccaagggggaggagctgcactgccgcctgattgacaccacccagatcaatgcccgggactggagcaggaagctgacccagaggatcaagagcaacaccagcaagaagaggaaggtgtccctgctgtttgaccacctggagcctgaggagctgtctgagcacctgacctacctggagttcaagagcttccgccgcatctccttcagtgactaccagaactacctggtgaacagctgtgtgaaggagaaccccaccatggagaggagcatcgccctgtgcaatggcatcagccagtgggtgcagctgatggtgctgagccggcccaccccccagctgcgggcagaggtgttcatcaagttcatccaggtggcccagaagctgcaccagctgcagaacttcaacaccctgatggccgtcatcggcggcctgtgccacagcagcatcagccggctgaaggagaccagcagccacgtgccccatgagatcaacaaggtgctgggggagatgacagagctgctgagcagcagcagaaattatgacaactacagaagagcctacggggagtgcacagacttcaagatccccatcctgggcgtgcacctgaaggacctgatcagcctgtatgaggccatgccagactacctggaggatggcaaggtgaatgtgcacaagctgctggccctgtacaaccacatcagcgagctggtgcagctgcaggaggtggccccacccctggaggccaacaaggacctggtgcacctgctgaccctgagcctggacctgtactacacagaagatgagatctatgagctgtcctatgcccgggagcccaggaaccaccgggcccccagcgtcttcaagaactatgaccatgaccaggacggctacatcagccaggaggagtttgagaagattgctgccagcttccccttctccttctgtgtgatggacaaggaccgggagggcctcatcagcagagatgagatcacagcctacttcatgagggccagcagcatctacagcaagctgggcctgggcttcccccacaacttccaggagaccacctacctgaagcccaccttctgtgacaactgtgccggcttcctgtggggcgtcatcaagcagggctaccgctgcaaggactgtggcatgaactgccacaagcagtgcaaggacctggtggtgtttgagtgcaagaagagggccaagaaccctgtggcccccacagagaacaacacctctgtgggccctgtgagcaacctgtgcagcctgggcgccaaggacctgctgcacggcaacaagtacagcgagagcaggtag

SEQ ID NO: 167199 - DNA, 1830 bp, Artificial Sequence
  Description of Artificial Sequence: Synthetic coding sequence
atggccggcaccctggacctggacaagggctgcaccgtggaggagctgctgcggggctgcatcgaggcctttgatgattctgggaaggtgcgggacccccagctggtgaggatgttcctgatgatgcacccctggtacatccccagcagccagctggccgccaagctgctgcacatctaccagcagagcaggaaggacaacagcaacagcctgcaggtgaagacctgccacctggtgcgctactggatcagcgccttccctgctgagtttgacctgaaccctgagctggccgagcagatcaaggagctgaaggccctgctggaccaggagggcaacagaagacacagcagcctgattgatattgattctgtgcccacctacaagtggaagaggcaggtgacccagaggaaccctgtgggccagaagaagaggaagatgagcctgctgtttgaccacctggagcccatggagctggccgagcacctgacctacctggagtaccgctccttctgcaagatcctcttccaggactaccacagctttgtgacccacggctgcaccgtggacaaccctgtgctggagcgcttcatcagcctcttcaacagcgtgtcccagtgggtgcagctgatgatcctgagcaagcccacagccccccagagggccctggtgatcacccactttgtgcacgtggccgagaagctgctgcagctgcagaacttcaacaccctgatggctgtggtgggcggcctgagccacagcagcatcagccggctgaaggagacccacagccacgtgtccccagagaccatcaagctgtgggagggcctgacagagctggtgacagccactggaaactacggcaactacagaagaaggctggccgcctgtgtgggcttccgcttccccatcctgggcgtgcacctgaaggacctggtggccctgcagctggccctgcctgactggctggaccctgcccggacccggctgaatggagccaagatgaagcagctgttcagcatcctggaggagctggccatggtgaccagcctgcggccccctgtgcaggccaacccagacctgctgagcctgctgactgtgtccctggaccagtaccagacagaagatgagctgtaccagctgagcctgcagcgggagcccaggagcaagagcagccccaccagccccaccagctgcaccccaccaccccggccccctgtgctggaggagtggaccagcgctgccaagcccaagctggaccaggccctggtggtggagcacatcgagaagatggtggagagcgtcttcaggaactttgatgtggatggagatggccacatcagccaggaggagttccagatcatccggggcaacttcccctacctgagcgccttcggggacctggaccagaaccaggacggctgcatcagccgggaggagatggtgtcctacttcctgcggagcagctctgtgctgggcggccgcatgggctttgtgcacaacttccaggagagcaacagcctgcggcctgtggcctgccgccactgcaaggccctgatcctgggcatctacaagcagggcctgaagtgccgggcctgtggggtgaactgccacaagcagtgcaaggaccggctgtctgtggagtgcagaagaagagcccagagcgtgtccctggagggcagcgcccccagccccagccccatgcacagccaccaccaccgggccttctccttcagcctgccccggcccggccggcggggcagcaggcctcctgagatccgggaggaggaggtgcagacagtggaggatggagtgtttgacatccacctgtag

SEQ ID NO: 167200 - DNA, 1833 bp, Artificial Sequence
  Description of Artificial Sequence: Synthetic coding sequence
atggccggcaccctggacctggacaagggctgcaccgtggaggagctgctgcggggctgcatcgaggcctttgatgattctgggaaggtgcgggacccccagctggtgaggatgttcctgatgatgcacccctggtacatccccagcagccagctggccgccaagctgctgcacatctaccagcagagcaggaaggacaacagcaacagcctgcaggtgaagacctgccacctggtgcgctactggatcagcgccttccctgctgagtttgacctgaaccctgagctggccgagcagatcaaggagctgaaggccctgctggaccaggagggcaacagaagacacagcagcctgattgatattgattctgtgcccacctacaagtggaagaggcaggtgacccagaggaaccctgtgggccagaagaagaggaagatgagcctgctgtttgaccacctggagcccatggagctggccgagcacctgacctacctggagtaccgctccttctgcaagatcctcttccaggactaccacagctttgtgacccacggctgcaccgtggacaaccctgtgctggagcgcttcatcagcctcttcaacagcgtgtcccagtgggtgcagctgatgatcctgagcaagcccacagccccccagagggccctggtgatcacccactttgtgcacgtggccgagaagctgctgcagctgcagaacttcaacaccctgatggctgtggtgggcggcctgagccacagcagcatcagccggctgaaggagacccacagccacgtgtccccagagaccatcaagctgtgggagggcctgacagagctggtgacagccactggaaactacggcaactacagaagaaggctggccgcctgtgtgggcttccgcttccccatcctgggcgtgcacctgaaggacctggtggccctgcagctggccctgcctgactggctggaccctgcccggacccggctgaatggagccaagatgaagcagctgttcagcatcctggaggagctggccatggtgaccagcctgcggccccctgtgcaggccaacccagacctgctgagcctgctgactgtgtccctggaccagtaccagacagaagatgagctgtaccagctgagcctgcagcgggagcccaggagcaagagcagccccaccagccccaccagctgcaccccaccaccccggccccctgtgctggaggagtggaccagcgctgccaagcccaagctggaccaggccctggtggtggagcacatcgagaagatggtggagagcgtcttcaggaactttgatgtggatggagatggccacatcagccaggaggagttccagatcatccggggcaacttcccctacctgagcgccttcggggacctggaccagaaccaggacggctgcatcagccgggaggagatggtgtcctacttcctgcggagcagctctgtgctgggcggccgcatgggctttgtgcacaacttccaggagagcaacagcctgcggcctgtggcctgccgccactgcaaggccctgatcctgggcatctacaagcagggcctgaagtgccgggcctgtggggtgaactgccacaagcagtgcaaggaccggctgtctgtggagtgcagaagaagagcccagagcgtgtccctggagggcagcgcccccagccccagccccatgcacagccaccaccaccgggccttctccttcagcctgccccggcccggccggcggggcagcaggcctcctgctgagatccgggaggaggaggtgcagacagtggaggatggagtgtttgacatccacctgtag

SEQ ID NO: 167201 - DNA, 1830 bp, Artificial Sequence; identical to SEQ ID NO: 167199
  Description of Artificial Sequence: Synthetic coding sequence

SEQ ID NO: 167202 - DNA, 1830 bp, Artificial Sequence; identical to SEQ ID NO: 167199
  Description of Artificial Sequence: Synthetic coding sequence

SEQ ID NO: 167203 - DNA, 432 bp, Artificial Sequence
  Description of Artificial Sequence: Synthetic coding sequence
atggccggcaccctggacctggacaagggctgcaccgtggaggagctgctgcggggctgcatcgaggcctttgatgattctgggaaggtgcgggacccccagctggtgaggatgttcctgatgatgcacccctggtacatccccagcagccagctggccgccaagctgctgcacatctaccagcagagcaggaaggacaacagcaacagcctgcaggtgaagacctgccacctggtgcgctactggatcagcgccttccctgctgagtttgacctgaaccctgagctggccgagcagatcaaggagctgaaggccctgctggaccaggagggcaacagaagacacagcagcctgattgatattgattctgtgtgtgtgggggagcaccggggcctgggcggccacagcgtgtcctacaccatctgtgcctag

SEQ ID NO: 167204 - DNA, 1731 bp, Artificial Sequence
  Description of Artificial Sequence: Synthetic coding sequence
atgaacaggaaggacagcaagaggaagagccaccaggagtgcaccgggaagattggaggccggggccggccccggcaggtgcggcggcacaagacctgccccagcccccgggagatcagcaaggtgatggcctccatgaacctgggcctgctgtctgagggcggctgcagtgaagatgagctgctggagaagtgcatccagagctttgattctgctggcagcctgtgccacgaggaccacatgctgaacatggtgctggccatgcacagctgggtgctgcccagcgctgacctggccgcccggctgctgaccagctaccagaaggccaccggggacacccaggagctgcggcggctgcagatctgccacctggtgcgctactggctgatgaggcaccctgaggtgatgcaccaggacccccagctggaggaggtgattggccgcttctgggccaccgtggcccgggagggcaacagcgcccagaggcggctgggggacagcagtgacctgctgagccctgggggccctggcccccccctgcccatgagcagccctggcctgggcaagaagaggaaggtgtccctgctgtttgaccacctggagaccggggagctggcccagcacctgacctacctggagttccgctccttccaggccatcacagccctgctggagctgacagagctgctggccagccacaacaactatgcccgctacagaaggacctgggccggctgtgccggcttccggctgcctgtgctgggcgtgcacctgaaggacctggtgtccctgcacgaggcccagcctgaccggctgcctgatggccgcctgcacctgcccaagctgaacaacctgtacctgcggctgcaggagctggtggccctgcagggccagcaccccccctgcagcgccaatgaagacctgctgcacctgctgaccctgagcctggacctcttctacacagaagatgagatctatgagctgtcctatgcccgggagccccgctgccccaagagcctgccccccagccccttcaatgcccccctggtggtggagtgggcccctggggtgacccccaagccagacagagtgaccctgggcagacatgtggagcagctggtggagagcgtcttcaagaactatgaccctgagggccggggcaccatcagccaggaggactttgagcggctgagcggcaacttcccctttgcctgccacggcctgcaccccccaccccggcagggccggggcagcttcagccgggaggagctgaccggctacctgctgcgggccagcgccatctgcagcaagctgggcctggccttcctgcacaccttccacgaggtgaccttcaggaagcccaccttctgtgacagctgcagcggcttcctgtggggcgtgaccaagcagggctaccgctgccgggagtgtggcctgtgctgccacaagcactgccgggaccaggtgaaggtggagtgcaagaagaggcctggggccaagggagatgctggccccccaggggcccctgtgcccagcaccccagcccctcatgccagctgtggcagcgaggagaaccacagctacaccctgagcctggagcctgagaccggctgccagctgcggcatgcctggacccagacagagagcccccaccccagctgggagacagacacagtgccctgccctgtgatggacccccccagcacagccagcagcaagctggacagctag

SEQ ID NO: 167205 - DNA, 1854 bp, Artificial Sequence
  Description of Artificial Sequence: Synthetic coding sequence
atgaacaggaaggacagcaagaggaagagccaccaggagtgcaccgggaagattggaggccggggccggccccggcaggtgcggcggcacaagacctgccccagcccccgggagatcagcaaggtgatggcctccatgaacctgggcctgctgtctgagggcggctgcagtgaagatgagctgctggagaagtgcatccagagctttgattctgctggcagcctgtgccacgaggaccacatgctgaacatggtgctggccatgcacagctgggtgctgcccagcgctgacctggccgcccggctgctgaccagctaccagaaggccaccggggacacccaggagctgcggcggctgcagatctgccacctggtgcgctactggctgatgaggcaccctgaggtgatgcaccaggacccccagctggaggaggtgattggccgcttctgggccaccgtggcccgggagggcaacagcgcccagaggcggctgggggacagcagtgacctgctgagccctgggggccctggcccccccctgcccatgagcagccctggcctgggcaagaagaggaaggtgtccctgctgtttgaccacctggagaccggggagctggcccagcacctgacctacctggagttccgctccttccaggccatcaccccccaggacctgcggagctatgtgctgcagggctctgtgcggggctgcccagccctggagggctctgtgggcctgagcaacagcgtgagccgctgggtgcaggtgatggtgctgagccggcccggccccctgcagagggcccaggtgctggacaagttcatccacgtggcccagaggctgcaccagctgcagaacttcaacaccctgatggctgtgactggaggcctgtgccacagcgccatcagccggctgaaggacagccacgcccacctgagcccagacagcaccaaggccctgctggagctgacagagctgctggccagccacaacaactatgcccgctacagaaggacctgggccggctgtgccggcttccggctgcctgtgctgggcgtgcacctgaaggacctggtgtccctgcacgaggcccagcctgaccggctgcctgatggccgcctgcacctgcccaagctgaacaacctgtacctgcggctgcaggagctggtggccctgcagggccagcaccccccctgcagcgccaatgaagacctgctgcacctgctgaccctgagcctggacctcttctacacagaagatgagatctatgagctgtcctatgcccgggagccccgctgccccaagagcctgccccccagccccttcaatgcccccctggtggtggagtgggcccctggggtgacccccaagccagacagagtgaccctgggccgccacgtggagcagctggtggagagcgtcttcaagaactatgaccctgagggccggggcaccatcagccaggaggactttgagcggctgagcggcaacttcccctttgcctgccacggcctgcaccccccaccccggcagggccggggcagcttcagccgggaggagctgaccggctacctgctgcgggccagcgccatctgcagcaagctgggcctggccttcctgcacaccttccacgaggtgaccttcaggaagcccaccttctgtgacagctgcagcggcttcctgtggggcgtgaccaagcagggctaccgctgccgcggggagtggggcgtgtctgagtgggagggcagcctgggcccccaggccggccgcatggatgacacagacaggaccccagctgctgccttcccccagagcgctggctgtgtggccaccaacacagctgagaccaggtag

SEQ ID NO: 167206 - DNA, 1455 bp, Artificial Sequence
  Description of Artificial Sequence: Synthetic coding sequence
atgaacaggaaggacagcaagaggaagagccaccaggagtgcaccgggaagattggaggccggggccggccccggcaggtgcggcggcacaagacctgccccagcccccgggagatcagcaaggtgatggcctccatgaacctgggcctgctgtctgagggcggctgcagtgaagatgagctgctggagaagtgcatccagagctttgattctgctggcagcctgtgccacgaggaccacatgctgaacatggtgctggccatgcacagctgggtgctgcccagcgctgacctggccgcccggctgctgaccagctaccagaaggccaccggggacacccaggagctgcggcggctgcagatctgccacctggtgcgctactggctgatgaggcaccctgaggtgatgcaccaggacccccagctggaggaggtgattggccgcttctgggccaccgtggcccgggagggcaacagcgcccagaggcggctgggggacagcagtgacctgctgagccctgggggccctggcccccccctgcccatgagcagccctggcctgggcaagaagaggaaggtgtccctgctgtttgaccacctggagaccggggagctggcccagcacctgacctacctggagttccgctccttccaggccatcaccctgagcctggacctcttctacacagaagatgagatctatgagctgtcctatgcccgggagccccgctgccccaagagcctgccccccagccccttcaatgcccccctggtggtggagtgggcccctggggtgacccccaagccagacagagtgaccctgggcagacatgtggagcagctggtggagagcgtcttcaagaactatgaccctgagggccggggcaccatcagccaggaggactttgagcggctgagcggcaacttcccctttgcctgccacggcctgcaccccccaccccggcagggccggggcagcttcagccgggaggagctgaccggctacctgctgcgggccagcgccatctgcagcaagctgggcctggccttcctgcacaccttccacgaggtgaccttcaggaagcccaccttctgtgacagctgcagcggcttcctgtggggcgtgaccaagcagggctaccgctgccgggagtgtggcctgtgctgccacaagcactgccgggaccaggtgaaggtggagtgcaagaagaggcctggggccaagggagatgctggccccccaggggcccctgtgcccagcaccccagcccctcatgccagctgtggcagcgaggagaaccacagctacaccctgagcctggagcctgagaccggctgccagctgcggcatgcctggacccagacagagagcccccaccccagctgggagacagacacagtgccctgccctgtgatggacccccccagcacagccagcagcaagctggacagctag

SEQ ID NO: 167207 - DNA, 1746 bp, Artificial Sequence
  Description of Artificial Sequence: Synthetic coding sequence
atgaacaggaaggacagcaagaggaagagccaccaggagtgcaccgggaagattggaggccggggccggccccggcaggtgcggcggcacaagacctgccccagcccccgggagatcagcaaggtgatggcctccatgaacctgggcctgctgtctgagggcggctgcagtgaagatgagctgctggagaagtgcatccagagctttgattctgctggcagcctgtgccacgaggaccacatgctgaacatggtgctggccatgcacagctgggtgctgcccagcgctgacctggccgcccggctgctgaccagctaccagaaggccaccggggacacccaggagctgcggcggctgcagatctgccacctggtgcgctactggctgatgaggcaccctgaggtgatgcaccaggacccccagctggaggaggtgattggccgcttctgggccaccgtggcccgggagggcaacagcgcccagaggcggctgggggacagcagtgacctgctgagccctgggggccctggcccccccctgcccatgagcagccctggcctgggcaagaagaggaaggtgtccctgctgtttgaccacctggagaccggggagctggcccagcacctgacctacctggagttccgctccttccaggccatcaccccccaggacctgcggagctatgtgctgcagggctctgtgcggggctgcccagccctggagggctctgtgggcctgagcaacagcgtgagccgctgggtgcaggtgatggtgctgagccggcccggccccctgcagagggcccaggtgctggacaagttcatccacgtggcccagaggctgcaccagctgcagaacttcaacaccctgatggctgtgactggaggcctgtgccacagcgccatcagccggctgaaggacagccacgcccacctgagcccagacagcaccaagctgagcctggacctcttctacacagaagatgagatctatgagctgtcctatgcccgggagccccgctgccccaagagcctgccccccagccccttcaatgcccccctggtggtggagtgggcccctggggtgacccccaagccagacagagtgaccctgggccgccacgtggagcagctggtggagagcgtcttcaagaactatgaccctgagggccggggcaccatcagccaggaggactttgagcggctgagcggcaacttcccctttgcctgccacggcctgcaccccccaccccggcagggccggggcagcttcagccgggaggagctgaccggctacctgctgcgggccagcgccatctgcagcaagctgggcctggccttcctgcacaccttccacgaggtgaccttcaggaagcccaccttctgtgacagctgcagcggcttcctgtggggcgtgaccaagcagggctaccgctgcagagaatgtggcctgtgctgccacaagcactgccgggaccaggtgaaggtggagtgcaagaagaggcctggggccaagggagatgctggccccccaggggcccctgtgcccagcaccccagccccccacgccagctgtggcagcgaggagaaccacagctacaccctgagcctggagcctgagaccggctgccagctgcggcatgcctggacccagacagagagcccccaccccagctgggagacagacacagtgccctgccctgtgatggacccccccagcacagccagcagcaagctggacagctag

SEQ ID NO: 167208 - DNA, 2022 bp, Artificial Sequence
  Description of Artificial Sequence: Synthetic coding sequence
atgaacaggaaggacagcaagaggaagagccaccaggagtgcaccgggaagattggaggccggggccggccccggcaggtgcggcggcacaagacctgccccagcccccgggagatcagcaaggtgatggcctccatgaacctgggcctgctgtctgagggcggctgcagtgaagatgagctgctggagaagtgcatccagagctttgattctgctggcagcctgtgccacgaggaccacatgctgaacatggtgctggccatgcacagctgggtgctgcccagcgctgacctggccgcccggctgctgaccagctaccagaaggccaccggggacacccaggagctgcggcggctgcagatctgccacctggtgcgctactggctgatgaggcaccctgaggtgatgcaccaggacccccagctggaggaggtgattggccgcttctgggccaccgtggcccgggagggcaacagcgcccagaggcggctgggggacagcagtgacctgctgagccctgggggccctggcccccccctgcccatgagcagccctggcctgggcaagaagaggaaggtgtccctgctgtttgaccacctggagaccggggagctggcccagcacctgacctacctggagttccgctccttccaggccatcaccccccaggacctgcggagctatgtgctgcagggctctgtgcggggctgcccagccctggagggctctgtgggcctgagcaacagcgtgagccgctgggtgcaggtgatggtgctgagccggcccggccccctgcagagggcccaggtgctggacaagttcatccacgtggcccagaggctgcaccagctgcagaacttcaacaccctgatggctgtgactggaggcctgtgccacagcgccatcagccggctgaaggacagccacgcccacctgagcccagacagcaccaaggccctgctggagctgacagagctgctggccagccacaacaactatgcccgctacagaaggacctgggccggctgtgccggcttccggctgcctgtgctgggcgtgcacctgaaggacctggtgtccctgcacgaggcccagcctgaccggctgcctgatggccgcctgcacctgcccaagctgaacaacctgtacctgcggctgcaggagctggtggccctgcagggccagcaccccccctgcagcgccaatgaagacctgctgcacctgctgaccctgagcctggacctcttctacacagaagatgagatctatgagctgtcctatgcccgggagccccgctgccccaagagcctgccccccagccccttcaatgcccccctggtggtggagtgggcccctggggtgacccccaagccagacagagtgaccctgggccgccacgtggagcagctggtggagagcgtcttcaagaactatgaccctgagggccggggcaccatcagccaggaggactttgagcggctgagcggcaacttcccctttgcctgccacggcctgcaccccccaccccggcagggccggggcagcttcagccgggaggagctgaccggctacctgctgcgggccagcgccatctgcagcaagctgggcctggccttcctgcacaccttccacgaggtgaccttcaggaagcccaccttctgtgacagctgcagcggcttcctgtggggcgtgaccaagcagggctaccgctgcagagaatgtggcctgtgctgccacaagcactgccgggaccaggtgaaggtggagtgcaagaagaggcctggggccaagggagatgctggccccccaggggcccctgtgcccagcaccccagccccccacgccagctgtggcagcgaggagaaccacagctacaccctgagcctggagcctgagaccggctgccagctgcggcatgcctggacccagacagagagcccccaccccagctgggagacagacacagtgccctgccctgtgatggacccccccagcacagccagcagcaagctggacagctag

SEQ ID NO: 167209 - DNA, 1980 bp, Artificial Sequence
  Description of Artificial Sequence: Synthetic coding sequence
atgaacaggaaggacagcaagaggaagagccaccaggagtgcaccgggaagattggaggccggggccggccccggcaggtgcggcggcacaagacctgccccagcccccgggagatcagcaaggtgatggcctccatgaacctgggcctgctgtctgagggcggctgcagtgaagatgagctgctggagaagtgcatccagagctttgattctgctggcagcctgtgccacgaggaccacatgctgaacatggtgctggccatgcacagctgggtgctgcccagcgctgacctggccgcccggctgctgaccagctaccagaaggccaccggggacacccaggagctgcggcggctgcagatctgccacctggtgcgctactggctgatgaggcaccctgaggtgatgcaccaggacccccagctggaggaggtgattggccgcttctgggccaccgtggcccgggagggcaacagcgcccagaggcggctgggggacagcagtgacctgcccggcctgggcaagaagaggaaggtgtccctgctgtttgaccacctggagaccggggagctggcccagcacctgacctacctggagttccgctccttccaggccatcaccccccaggacctgcggagctatgtgctgcagggctctgtgcggggctgcccagccctggagggctctgtgggcctgagcaacagcgtgagccgctgggtgcaggtgatggtgctgagccggcccggccccctgcagagggcccaggtgctggacaagttcatccacgtggcccagaggctgcaccagctgcagaacttcaacaccctgatggctgtgactggaggcctgtgccacagcgccatcagccggctgaaggacagccacgcccacctgagcccagacagcaccaaggccctgctggagctgacagagctgctggccagccacaacaactatgcccgctacagaaggacctgggccggctgtgccggcttccggctgcctgtgctgggcgtgcacctgaaggacctggtgtccctgcacgaggcccagcctgaccggctgcctgatggccgcctgcacctgcccaagctgaacaacctgtacctgcggctgcaggagctggtggccctgcagggccagcaccccccctgcagcgccaatgaagacctgctgcacctgctgaccctgagcctggacctcttctacacagaagatgagatctatgagctgtcctatgcccgggagccccgctgccccaagagcctgccccccagccccttcaatgcccccctggtggtggagtgggcccctggggtgacccccaagccagacagagtgaccctgggccgccacgtggagcagctggtggagagcgtcttcaagaactatgaccctgagggccggggcaccatcagccaggaggactttgagcggctgagcggcaacttcccctttgcctgccacggcctgcaccccccaccccggcagggccggggcagcttcagccgggaggagctgaccggctacctgctgcgggccagcgccatctgcagcaagctgggcctggccttcctgcacaccttccacgaggtgaccttcaggaagcccaccttctgtgacagctgcagcggcttcctgtggggcgtgaccaagcagggctaccgctgcagagaatgtggcctgtgctgccacaagcactgccgggaccaggtgaaggtggagtgcaagaagaggcctggggccaagggagatgctggccccccaggggcccctgtgcccagcaccccagccccccacgccagctgtggcagcgaggagaaccacagctacaccctgagcctggagcctgagaccggctgccagctgcggcatgcctggacccagacagagagcccccaccccagctgggagacagacacagtgccctgccctgtgatggacccccccagcacagccagcagcaagctggacagctag

SEQ ID NO: 167210 - DNA, 1815 bp, Artificial Sequence
  Description of Artificial Sequence: Synthetic coding sequence
atgaacaggaaggacagcaagaggaagagccaccaggagtgcaccgggaagattggaggccggggccggccccggcaggtgcggcggcacaagacctgccccagcccccgggagatcagcaaggtgatggcctccatgaacctgggcctgctgtctgagggcggctgcagtgaagatgagctgctggagaagtgcatccagagctttgattctgctggcagcctgtgccacgaggaccacatgctgaacatggtgctggccatgcacagctgggtgctgcccagcgctgacctggccgcccggctgctgaccagctaccagaaggccaccggggacacccaggagctgcggcggctgcagatctgccacctggtgcgctactggctgatgaggcaccctgaggtgatgcaccaggacccccagctggaggaggtgattggccgcttctgggccaccgtggcccgggagggcaacagcgcccagaggcggctgggggacagcagtgacctgctgagccctgggggccctggcccccccctgcccatgagcagccctggcctgggcaagaagaggaaggtgtccctgctgtttgaccacctggagaccggggagctggcccagcacctgacctacctggagttccgctccttccaggccatcaccccccaggacctgcggagctatgtgctgcagggctctgtgcggggctgcccagccctggagggctctgtgggcctgagcaacagcgtgagccgctgggtgcaggtgatggtgctgagccggcccggccccctgcagagggcccaggtgctggacaagttcatccacgtggcccagaggctgcaccagctgcagaacttcaacaccctgatggctgtgactggaggcctgtgccacagcgccatcagccggctgaaggacagccacgcccacctgagcccagacagcaccaaggagctggtggccctgcagggccagcaccccccctgcagcgccaatgaagacctgctgcacctgctgaccctgagcctggacctcttctacacagaagatgagatctatgagctgtcctatgcccgggagccccgctgccccaagagcctgccccccagccccttcaatgcccccctggtggtggagtgggcccctggggtgacccccaagccagacagagtgaccctgggcagacatgtggagcagctggtggagagcgtcttcaagaactatgaccctgagggccggggcaccatcagccaggaggactttgagcggctgagcggcaacttcccctttgcctgccacggcctgcaccccccaccccggcagggccggggcagcttcagccgggaggagctgaccggctacctgctgcgggccagcgccatctgcagcaagctgggcctggccttcctgcacaccttccacgaggtgaccttcaggaagcccaccttctgtgacagctgcagcggcttcctgtggggcgtgaccaagcagggctaccgctgccgggagtgtggcctgtgctgccacaagcactgccgggaccaggtgaaggtggagtgcaagaagaggcctggggccaagggagatgctggccccccaggggcccctgtgcccagcaccccagcccctcatgccagctgtggcagcgaggagaaccacagctacaccctgagcctggagcctgagaccggctgccagctgcggcatgcctggacccagacagagagcccccaccccagctgggagacagacacagtgccctgccctgtgatggacccccccagcacagccagcagcaagctggacagctag

SEQ ID NO: 167211 - DNA, 1857 bp, Artificial Sequence
  Description of Artificial Sequence: Synthetic coding sequence
atgaagaaggatgtgcgcatcctgctggtgggggagccccgggtgggcaagaccagcctcatcatgagcctggtgtctgaggagttccctgaggaggtgccccccagggctgaggagatcaccatcccagcagatgtgaccccagagcgggtgcccacccacatcgtggactacagcgaggccgagcagagtgatgagcagctgcaccaggagatcagccaggccaacgtcatctgcatcgtgtatgctgtgaacaacaagcacagcattgacaaggtgaccagccgctggatccccctcatcaatgaaagaacagacaaggacagccggctgcccctcatcctggtgggcaacaagagtgacctggtggagtacagctccatggagaccatcctgcccatcatgaaccagtacacagaaattgagacctgtgtggagtgcagcgccaagaacctgaagaacatcagcgagctgttctactatgcccagaaggctgtgctgcaccccaccggccccctgtactgcccagaggagaaggagatgaagccagcctgcatcaaggccctgacccgcatcttcaagatcagtgaccaggacaatgatggcaccctgaatgatgctgagctgaacttcttccagaggatctgcttcaacacccccctggccccccaggccctggaggatgtgaagaatgtggtgaggaagcacatcagtgatggagtggccgacagcggcctgaccctgaagggcttcctgttcctgcacaccctcttcatccagagaggaagacatgagaccacctggacagtgctgcggcgcttcggctatgatgatgacctggacctgaccccagagtacctgttccccctgctgaagatccccccagactgcaccacagagctgaaccaccacgcctacctgttcctgcagagcacctttgacaagcatgacctggaccgggactgtgccctgagcccagatgagctgaaggacctcttcaaggtgttcccctacatcccctggggcccagatgtgaacaacacagtgtgcaccaatgaaagaggctggatcacctaccagggcttcctgagccagtggaccctgaccacctacctggatgtgcagcgctgcctggagtacctgggctacctgggctacagcatcctgacagagcaggagagccaggccagcgctgtgacagtgacccgggacaagaagattgacctgcagaagaagcagacccagagaaatgtgttccgctgcaacgtcatcggcgtgaagaactgtgggaagagcggcgtgctgcaggccctgctgggcaggaacctgatgaggcagaagaagatccgggaggaccacaagagctactatgccatcaacacagtgtatgtgtatggccaggagaagtacctgctgctgcatgacatcagcgagagcgagttcctgacagaagctgagatcatctgtgatgtggtgtgcctggtgtatgatgtgagcaaccccaagagctttgagtactgtgcccgcatcttcaagcagcacttcatggacagccgcatcccctgcctgattgtggccgccaagagtgacctgcacgaggtgaagcaggagtacagcatcagccccacagacttctgcaggaagcacaagatgcccccaccccaggccttcacctgcaacacagcagatgcccccagcaaggacatctttgtgaagctgaccaccatggccatgtacccccacgtgacccaggccgacctgaagagcagcaccttctggctgcgggccagctttggagccaccgtgtttgctgtgctgggctttgccatgtacaaggccctgctgaagcagaggtag

SEQ ID NO: 167212 - DNA, 1980 bp, Artificial Sequence
  Description of Artificial Sequence: Synthetic coding sequence
atgaagaaggatgtgcgcatcctgctggtgggggagccccgggtgggcaagaccagcctcatcatgagcctggtgtctgaggagttccctgaggaggtgccccccagggctgaggagatcaccatcccagcagatgtgaccccagagcgggtgcccacccacatcgtggactacagcgaggccgagcagagtgatgagcagctgcaccaggagatcagccaggccaacgtcatctgcatcgtgtatgctgtgaacaacaagcacagcattgacaaggtgaccagccgctggatccccctcatcaatgaaagaacagacaaggacagccggctgcccctcatcctggtgggcaacaagagtgacctggtggagtacagctccatggagaccatcctgcccatcatgaaccagtacacagaaattgagacctgtgtggagtgcagcgccaagaacctgaagaacatcagcgagctgttctactatgcccagaaggctgtgctgcaccccaccggccccctgtactgcccagaggagaaggagatgaagccagcctgcatcaaggccctgacccgcatcttcaagatcagtgaccaggacaatgatggcaccctgaatgatgctgagctgaacttcttccagaggatctgcttcaacacccccctggccccccaggccctggaggatgtgaagaatgtggtgaggaagcacatcagtgatggagtggccgacagcggcctgaccctgaagggcttcctgttcctgcacaccctcttcatccagagaggaagacatgagaccacctggacagtgctgcggcgcttcggctatgatgatgacctggacctgaccccagagtacctgttccccctgctgaagatccccccagactgcaccacagagctgaaccaccacgcctacctgttcctgcagagcacctttgacaagcatgacctggaccgggactgtgccctgagcccagatgagctgaaggacctcttcaaggtgttcccctacatcccctggggcccagatgtgaacaacacagtgtgcaccaatgaaagaggctggatcacctaccagggcttcctgagccagtggaccctgaccacctacctggatgtgcagcgctgcctggagtacctgggctacctgggctacagcatcctgacagagcaggagagccaggccagcgctgtgacagtgacccgggacaagaagattgacctgcagaagaagcagacccagagaaatgtgttccgctgcaacgtcatcggcgtgaagaactgtgggaagagcggcgtgctgcaggccctgctgggcaggaacctgatgaggcagaagaagatccgggaggaccacaagagctactatgccatcaacacagtgtatgtgtatggccaggagaagtacctgctgctgcatgacatcagcgagagcgagttcctgacagaagctgagatcatctgtgatgtggtgtgcctggtgtatgatgtgagcaaccccaagagctttgagtactgtgcccgcatcttcaagcagcacttcatggacagccgcatcccctgcctgattgtggccgccaagagtgacctgcacgaggtgaagcaggagtacagcatcagccccacagacttctgcaggaagcacaagatgcccccaccccaggccttcacctgcaacacagcagatgcccccagcaaggacatctttgtgaagctgaccaccatggccatgtacccccacgcccggctgcgctgcatgtgcacctgcaaccgctgcaccttctgcatctgccagaacttcctgaacagcgacctgctgcagagcgtgaagaacaagatcttcaccgctgtgctgaacagacatgtgacccaggccgacctgaagagcagcaccttctggctgcgggccagctttggagccaccgtgtttgctgtgctgggctttgccatgtacaaggccctgctgaagcagaggtag

SEQ ID NO: 167213 - DNA, 2076 bp, Artificial Sequence
  Description of Artificial Sequence: Synthetic coding sequence
atgaagaaggatgtgcgcatcctgctggtgggggagccccgggtgggcaagaccagcctcatcatgagcctggtgtctgaggagttccctgaggaggtgccccccagggctgaggagatcaccatcccagcagatgtgaccccagagcgggtgcccacccacatcgtggactacagcgaggccgagcagagtgatgagcagctgcaccaggagatcagccaggccaacgtcatctgcatcgtgtatgctgtgaacaacaagcacagcattgacaaggtgaccagccgctggatccccctcatcaatgaaagaacagacaaggacagccggctgcccctcatcctggtgggcaacaagagtgacctggtggagtacagctccatggagaccatcctgcccatcatgaaccagtacacagaaattgagacctgtgtggagtgcagcgccaagaacctgaagaacatcagcgagctgttctactatgcccagaaggctgtgctgcaccccaccggccccctgtactgcccagaggagaaggagatgaagccagcctgcatcaaggccctgacccgcatcttcaagatcagtgaccaggacaatgatggcaccctgaatgatgctgagctgaacttcttccagaggatctgcttcaacacccccctggccccccaggccctggaggatgtgaagaatgtggtgaggaagcacatcagtgatggagtggccgacagcggcctgaccctgaagggcttcctgttcctgcacaccctcttcatccagagaggaagacatgagaccacctggacagtgctgcggcgcttcggctatgatgatgacctggacctgaccccagagtacctgttccccctgctgaagatccccccagactgcaccacagagctgaaccaccacgcctacctgttcctgcagagcacctttgacaagcatgacctggaccgggactgtgccctgagcccagatgagctgaaggacctcttcaaggtgttcccctacatcccctggggcccagatgtgaacaacacagtgtgcaccaatgaaagaggctggatcacctaccagggcttcctgagccagtggaccctgaccacctacctggatgtgcagcgctgcctggagtacctgggctacctgggctacagcatcctgacagagcaggagagccaggccagcgctgtgacagtgacccgggacaagaagattgacctgcagaagaagcagacccagagaaatgtgttccgctgcaacgtcatcggcgtgaagaactgtgggaagagcggcgtgctgcaggccctgctgggcaggaacctgatgaggcagaagaagatccgggaggaccacaagagctactatgccatcaacacagtgtatgtgtatggccaggagaagtacctgctgctgcatgacatcagcgagagcgagttcctgacagaagctgagatcatctgtgatgtggtgtgcctggtgtatgatgtgagcaaccccaagagctttgagtactgtgcccgcatcttcaagcagcacttcatggacagccgcatcccctgcctgattgtggccgccaagagtgacctgcacgaggtgaagcaggagtacagcatcagccccacagacttctgcaggaagcacaagatgcccccaccccaggccttcacctgcaacacagcagatgcccccagcaaggacatctttgtgaagctgaccaccatggccatgtacccagaggaccactacagagaccggctgagccgggacatgggccacacagacagaattgagaacctgaggaagatctgggtgttcctgaagacagccttccacgcccggctgcgctgcatgtgcacctgcaaccgctgcaccttctgcatctgccagaacttcctgaacagcgacctgctgcagagcgtgaagaacaagatcttcaccgctgtgctgaacagacatgtgacccaggccgacctgaagagcagcaccttctggctgcgggccagctttggagccaccgtgtttgctgtgctgggctttgccatgtacaaggccctgctgaagcagaggtag

SEQ ID NO: 167214 - DNA, 1953 bp, Artificial Sequence
  Description of Artificial Sequence: Synthetic coding sequence
atgaagaaggatgtgcgcatcctgctggtgggggagccccgggtgggcaagaccagcctcatcatgagcctggtgtctgaggagttccctgaggaggtgccccccagggctgaggagatcaccatcccagcagatgtgaccccagagcgggtgcccacccacatcgtggactacagcgaggccgagcagagtgatgagcagctgcaccaggagatcagccaggccaacgtcatctgcatcgtgtatgctgtgaacaacaagcacagcattgacaaggtgaccagccgctggatccccctcatcaatgaaagaacagacaaggacagccggctgcccctcatcctggtgggcaacaagagtgacctggtggagtacagctccatggagaccatcctgcccatcatgaaccagtacacagaaattgagacctgtgtggagtgcagcgccaagaacctgaagaacatcagcgagctgttctactatgcccagaaggctgtgctgcaccccaccggccccctgtactgcccagaggagaaggagatgaagccagcctgcatcaaggccctgacccgcatcttcaagatcagtgaccaggacaatgatggcaccctgaatgatgctgagctgaacttcttccagaggatctgcttcaacacccccctggccccccaggccctggaggatgtgaagaatgtggtgaggaagcacatcagtgatggagtggccgacagcggcctgaccctgaagggcttcctgttcctgcacaccctcttcatccagagaggaagacatgagaccacctggacagtgctgcggcgcttcggctatgatgatgacctggacctgaccccagagtacctgttccccctgctgaagatccccccagactgcaccacagagctgaaccaccacgcctacctgttcctgcagagcacctttgacaagcatgacctggaccgggactgtgccctgagcccagatgagctgaaggacctcttcaaggtgttcccctacatcccctggggcccagatgtgaacaacacagtgtgcaccaatgaaagaggctggatcacctaccagggcttcctgagccagtggaccctgaccacctacctggatgtgcagcgctgcctggagtacctgggctacctgggctacagcatcctgacagagcaggagagccaggccagcgctgtgacagtgacccgggacaagaagattgacctgcagaagaagcagacccagagaaatgtgttccgctgcaacgtcatcggcgtgaagaactgtgggaagagcggcgtgctgcaggccctgctgggcaggaacctgatgaggcagaagaagatccgggaggaccacaagagctactatgccatcaacacagtgtatgtgtatggccaggagaagtacctgctgctgcatgacatcagcgagagcgagttcctgacagaagctgagatcatctgtgatgtggtgtgcctggtgtatgatgtgagcaaccccaagagctttgagtactgtgcccgcatcttcaagcagcacttcatggacagccgcatcccctgcctgattgtggccgccaagagtgacctgcacgaggtgaagcaggagtacagcatcagccccacagacttctgcaggaagcacaagatgcccccaccccaggccttcacctgcaacacagcagatgcccccagcaaggacatctttgtgaagctgaccaccatggccatgtacccagaggaccactacagagaccggctgagccgggacatgggccacacagacagaattgagaacctgaggaagatctgggtgttcctgaagacagccctgcacgtgacccaggccgacctgaagagcagcaccttctggctgcgggccagctttggagccaccgtgtttgctgtgctgggctttgccatgtacaaggccctgctgaagcagaggtag

SEQ ID NO: 167215 - DNA, 744 bp, Artificial Sequence
  Description of Artificial Sequence: Synthetic coding sequence
atgaagaaggatgtgcgcatcctgctggtgggggagccccgggtgggcaagaccagcctcatcatgagcctggtgtctgaggagttccctgaggaggtgccccccagggctgaggagatcaccatcccagcagatgtgaccccagagcgggtgcccacccacatcgtggactacagcgaggccgagcagagtgatgagcagctgcaccaggagatcagccaggccaacgtcatctgcatcgtgtatgctgtgaacaacaagcacagcattgacaaggtgaccagccgctggatccccctcatcaatgaaagaacagacaaggacagccggctgcccctcatcctggtgggcaacaagagtgacctggtggagtacagctccatggagaccatcctgcccatcatgaaccagtacacagaaattgagacctgtgtggagtgcagcgccaagaacctgaagaacatcagcgagctgttctactatgcccagaaggctgtgctgcaccccaccggccccctgtactgcccagaggagaaggagatgaagccagcctgcatcaaggccctgacccgcatcttcaagatcagtgaccaggacaatgatggcaccctgaatgatgctgagctgaacttcttccagaggatctgcttcaacacccccctggcccccaggtttggatttgagcaggtgctggtgctgctcttcctgcagttctgggccctgctgtgcaccaagcactactag

SEQ ID NO: 167216 - DNA, 1857 bp, Artificial Sequence
  Description of Artificial Sequence: Synthetic coding sequence
atgagaagagatgtgcgcatcctgctgctgggggaggcccaggtgggcaagaccagcctcatcctgagcctggtgggggaggagttccctgaggaggtgccccccagggctgaggagatcaccatcccagcagatgtgaccccagagaaggtgcccacccacatcgtggactacagcgaggccgagcagacagatgaggagctgcgggaggagatccacaaggccaacgtggtgtgtgtggtgtatgatgtgtctgaggaggccaccatcgagaagatccgcaccaagtggatccccctggtgaatggaggcaccacccagggcccccgggtgcccatcatcctggtgggcaacaagagtgacctgcggagcggcagctccatggaggccgtgctgcccatcatgagccagtttcctgagattgagacctgtgtggagtgcagcgccaagaacctgaggaacatcagcgagctgttctactatgcccagaaggctgtgctgcaccccacagcccccctgtatgaccctgaggccaagcagctgcggcctgcctgtgcccaggccctgacccgcatcttccggctgagtgaccaggacctggaccaggccctgagtgatgaggagctgaatgccttccagaagagctgcttcggccaccccctggccccccaggccctggaggatgtgaagacagtggtgtgcagaaatgtggccggcggcgtgagagaagatcggctgaccctggatggcttcctgttcctgaacaccctcttcatccagagaggaagacatgagaccacctggaccatcctgcggcgcttcggctacagtgatgccctggagctgacagctgactacctgagccccctcatccacgtgcccccaggctgcagcacagagctgaaccacctgggctaccagtttgtgcagagggtgtttgagaagcatgaccaggacagagatggagccctgagccctgtggagctgcagagcctcttcagcgtcttccctgctgccccctggggccctgagctgcccaggacagtgaggacagaagctggccgcctgcccctgcacggctacctgtgccagtggaccctggtgacctacctggatgtgcgcagctgcctgggccacctgggctacctgggctaccccaccctgtgtgagcaggaccaggcccacgccatcaccgtgacccgggagaagaggctggaccaggagaagggccagacccagaggtctgtgctgctgtgcaaggtggtgggcgcccggggcgtgggcaagagcgccttcctgcaggccttcctgggccggggcctgggccaccaggacacccgggagcagcccccaggctacgccatcgacacagtgcaggtgaatggccaggagaagtacctgatcctgtgtgaggtgggcacagatggcctgctggccaccagcctggatgccacctgtgatgtggcctgcctgatgtttgatggcagtgaccccaagagctttgcccactgtgcctctgtgtacaagcaccactacatggatggccagaccccctgcctgtttgtgagcagcaaggctgacctgcctgagggcgtggccgtgtctggccccagccctgctgagttctgcaggaagcaccggctgcctgcccctgtgcccttcagctgtgccggccctgctgagcccagcaccaccatcttcacccagctggccaccatggccgccttcccccacctggtgcacgccgagctgcaccccagcagcttctggctgcggggcctgctgggcgtggtgggcgctgctgtggccgctgtgctgtccttcagcctgtacagagtgctggtgaagagccagtag

SEQ ID NO: 167217 - DNA, 777 bp, Artificial Sequence
  Description of Artificial Sequence: Synthetic coding sequence
atgccaccccagcagggcgaccctgccttcccagacagatgtgaggcccctcctgtgcccccccggcgggagcggggcggccggggcggccggggccctggagagcccggcggccggggccgggccggcggcgctgagggccggggcgtgaagtgtgtgctggtgggagatggagctgtgggcaagaccagcctggtggtgtcctacaccaccaacggctaccccacagagtacatccccacagcctttgacaacttctctgctgtggtgtctgtggatggccggcctgtgcggctgcagctgtgtgacacagctggccaggatgaatttgacaagctgcggcccctgtgctacaccaacacagacatcttcctgctgtgcttctctgtggtgagccccagcagcttccagaatgtgtctgagaagtgggtgcctgagatccgctgccactgccccaaggcccccatcatcctggtgggcacccagagcgacctgagagaagatgtgaaggtgctgattgagctggacaagtgcaaggagaagcctgtgcctgaggaggccgccaagctgtgtgccgaggagatcaaggccgccagctacatcgagtgcagcgccctgacccagaagaacctgaaggaggtgtttgatgctgccatcgtggccggcatccagtacagcgacacccagcagcagcccaagaagagcaagagcaggaccccagacaagatgaagaacctgagcaagtcctggtggaagaagtactgctgctttgtgtag

SEQ ID NO: 167218 - DNA, 1527 bp, Artificial Sequence
  Description of Artificial Sequence: Synthetic coding sequence
atggaccacctgggcgccagcctgtggccccaggtgggcagcctgtgcctgctgctggccggggccgcctgggcccccccacccaacctgcctgaccccaagtttgagagcaaggccgccctgctggccgcccggggccctgaggagctgctgtgcttcacagagcggctggaggacctggtgtgcttctgggaggaggccgccagcgctggggtgggccctggcaactacagcttctcctaccagctggaggatgagccctggaagctgtgccgcctgcaccaggcccccacagcccggggagctgtgcgcttctggtgcagcctgcccacagctgacaccagcagctttgtgcccctggagctgcgggtgacagctgccagcggggccccccgctaccacagggtcatccacatcaatgaggtggtgctgctggatgcccctgtgggcctggtggcccggctggctgatgaaagtggccacgtggtgctgcgctggctgcccccacctgagacccccatgaccagccacatccgctatgaggtggatgtgtctgctggaaatggagctggctctgtgcagagggtggagatcctggagggccgcacagaatgtgtgctgagcaacctgcggggccgcacccgctacacctttgctgtgcgggccaggatggccgagcccagctttggaggcttctggagcgcctggagcgagcctgtgtccctgctgacccccagcgacctggaccccctcatcctgaccctgagcctcatcctggtggtgatcctggtgctgctgactgtgctggccctgctgagccacagaagagccctgaagcagaagatctggccaggcatccccagccctgagagcgagtttgagggcctcttcaccacccacaagggcaacttccagctgtggctgtaccagaatgatggctgcctgtggtggagcccctgcacccccttcacagaagatcctccagccagcctggaggtgctgtctgagcgctgctggggcaccatgcaggccgtggagcctggaacagatgatgagggccccctgctggagcctgtgggcagcgagcacgcccaggacacctacctggtgctggacaagtggctgctgcccaggaaccccccatctgaggacctgcccggccctgggggctctgtggacatcgtggccatggatgagggcagcgaggccagcagctgcagcagcgccctggccagcaagcccagccctgagggcgccagcgctgccagctttgagtacaccatcctggaccccagcagccagctgctgcggccctggaccctgtgcccagagctgccccccaccccaccccacctgaagtacctgtacctggtggtgtctgacagcggcatcagcacagactacagcagcggggacagccagggcgcccagggcggcctgagtgatggcccctacagcaacccctatgagaacagcctcatcccagctgctgagcccctgcccccatcctatgtggcctgcagctag

SEQ ID NO: 167219 - DNA, 2550 bp, Artificial Sequence
  Description of Artificial Sequence: Synthetic coding sequence
atggctgctgctgccccagctgctgctgctgccagcagcgaggccccagctgccagcgccacagctgagcctgaggccggggaccaggacagccgggaggtgcgggtgctgcagagcctgcggggcaagatctgtgaggccaagaacctgctgccctacctgggcccccacaagatgagggactgcttctgcaccatcaacctggaccaggaggaggtgtaccgcacccaggtggtggagaagagcctgagccccttcttcagcgaggagttctactttgagatccccaggaccttccagtacctgtccttctacgtgtatgacaagaatgtgctgcagagggacctgcgcatcggcaaggtggccatcaagaaggaggacctgtgcaaccacagcggcaaggagacctggttcagcctgcagcctgtggacagcaacagcgaggtgcagggcaaggtgcacctggagctgaagctgaatgagctgatcacagaaaatggcaccgtgtgccagcagctggtggtgcacatcaaggcctgccacggcctgcccctcatcaatggccagagctgtgacccctatgccaccgtgtccctggtgggccccagcagaaatgaccagaagaagaccaaggtgaagaagaagaccagcaacccccagttcaatgagatcttctactttgaggtgaccaggagcagcagctacaccaggaagagccagttccaggtggaggaggaggacatcgagaagctggagatcagaattgacctgtggaacaacggcaacctggtgcaggatgtgttcctgggggagatcaaggtgcctgtgaatgtgctgaggacagacagcagccaccaggcctggtacctgctgcagccccgggacaatggaaacaagagcagcaagacagatgacctgggcagcctgcggctgaacatctgctacacagaagattatgtgctgcccagcgagtactacggccccctgaagaccctgctgctgaagagcccagatgtgcagcccatcagcgccagcgctgcctacatcctgtctgagatctgccgggacaagaatgatgctgtgctgcccctggtgcggctgctgctgcaccacgacaagctggtgccctttgccacagctgtggccgagctggacctgaaggacacccaggatgccaacaccatcttccggggcaacagcctggccacccgctgcctggatgagatgatgaagatcgtgggcggccactacctgaaggtgaccctgaagcccatcctggatgagatctgtgacagcagcaagagctgtgaaattgaccccatcaagctgaaggagggggacaacgtggagaacaacaaggagaacctgcgctactacgtggacaagctgttcaacaccatcgtgaagagctccatgagctgccccaccgtgatgtgtgacatcttctacagcctgcggcagatggccacccagcgcttccccaatgacccccacgtgcagtacagcgctgtgagcagctttgtgttcctgcgcttctttgctgtggccgtggtgagcccccacaccttccacctgcggccccaccacccagatgcccagaccatccgcaccctgaccctcatcagcaagaccatccagaccctgggctcctggggcagcctgagcaagagcaagagcagcttcaaggagaccttcatgtgtgagttcttcaagatgttccaggaggagggctacatcatcgctgtgaagaagttcctggatgagatcagcagcacagagaccaaggagagcagcggcaccagcgagcctgtgcacctgaaggagggggagatgtacaagagggcccagggccgcaccagaattggcaagaagaacttcaagaagcgctggttctgcctgaccagccgggagctgacctaccacaagcagcccgggaaggatgccatctacaccatccctgtgaagaacatcctggccgtggagaagctggaggagagcagcttcaacaagaagaacatgttccaggtgatccacacagagaagcccctgtatgtgcaggccaacaactgtgtggaggccaatgagtggattgatgtgctgtgccgggtgagccgctgcaaccagaaccggctgtccttctaccaccccagcgtgtacctgaatggaaactggctgtgctgccaggagaccggggagaacaccctgggctgcaagccctgcacagctggggtgcctgctgacatccagattgatattgatgaggaccgggagacagagcgcatctacagcctcttcaccctgagcctgctgaagctgcagaagatggaggaggcctgtggcaccatcgctgtgtaccagggcccccagaaggagccagatgactacagcaactttgtgattgaagattctgtgaccaccttcaagaccatccagcagatcaagagcatcatcgagaagctggatgagccccatgagaagtacaggaagaagaggagcagcagcgccaagtatggcagcaaagaaaaccccatcgtgggcaaggccagctag

SEQ ID NO: 167220 - DNA, 834 bp, Artificial Sequence
  Description of Artificial Sequence: Synthetic coding sequence
atgatgaagatcgtgggcggccactacctgaaggtgaccctgaagcccatcctggatgagatctgtgacagcagcaagagctgtgaaattgaccccatcaagctgaaggagggggacaacgtggagaacaacaaggagaacctgcgctactacgtggacaagctgttcaacaccatcgtgaagagctccatgagctgccccaccgtgatgtgtgacatcttctacagcctgcggcagatggccacccagcgcttccccaatgacccccacgtgcagtacagcgctgtgagcagctttgtgttcctgcgcttctttgctgtggccgtggtgagcccccacaccttccacctgcggccccaccacccagatgcccagaccatccgcaccctgaccctcatcagcaagaccatccagaccctgggctcctggggcagcctgagcaagagcaagagcagcttcaaggagaccttcatgtgtgagttcttcaagatgttccaggaggagggctacatcatcgctgtgaagaagttcctggatgagatcagcagcacagagaccaaggagagcagcggcaccagcgagcctgtgcacctgaaggagggggagatgtacaagagggcccagggccgcaccagaattggcaagaagaacttcaagaagcgctggttctgcctgaccagccgggagctgacctaccacaagcagcccggcagctgtgtgtatgccctgctgtggggcttctcctggttctctgtgaaggtgtccctgcccctgattgtgaccctggtgaaccccttcagcaacatcaccgtggtgtatggcttcagccactag

SEQ ID NO: 167221 - DNA, 2553 bp, Artificial Sequence
  Description of Artificial Sequence: Synthetic coding sequence
atggctgctgctgccccagctgctgctgctgccagcagcgaggccccagctgccagcgccacagctgagcctgaggccggggaccaggacagccgggaggtgcgggtgctgcagagcctgcggggcaagatctgtgaggccaagaacctgctgccctacctgggcccccacaagatgagggactgcttctgcaccatcaacctggaccaggaggaggtgtaccgcacccaggtggtggagaagagcctgagccccttcttcagcgaggagttctactttgagatccccaggaccttccagtacctgtccttctacgtgtatgacaagaatgtgctgcagagggacctgcgcatcggcaaggtggccatcaagaaggaggacctgtgcaaccacagcggcaaggagacctggttcagcctgcagcctgtggacagcaacagcgaggtgcagggcaaggtgcacctggagctgaagctgaatgagctgatcacagaaaatggcaccgtgtgccagcagctggtggtgcacatcaaggcctgccacggcctgcccctcatcaatggccagagctgtgacccctatgccaccgtgtccctggtgggccccagcagaaatgaccagaagaagaccaaggtgaagaagaagaccagcaacccccagttcaatgagatcttctactttgaggtgaccaggagcagcagctacaccaggaagagccagttccaggtggaggaggaggacatcgagaagctggagatcagaattgacctgtggaacaacggcaacctggtgcaggatgtgttcctgggggagatcaaggtgcctgtgaatgtgctgaggacagacagcagccaccaggcctggtacctgctgcagccccgggacaatggaaacaagagcagcaagacagatgacctgggcagcctgcggctgaacatctgctacacagaagattatgtgctgcccagcgagtactacggccccctgaagaccctgctgctgaagagcccagatgtgcagcccatcagcgccagcgctgcctacatcctgtctgagatctgccgggacaagaatgatgctgtgctgcccctggtgcggctgctgctgcaccacgacaagctggtgccctttgccacagctgtggccgagctggacctgaaggacacccaggatgccaacaccatcttccggggcaacagcctggccacccgctgcctggatgagatgatgaagatcgtgggcggccactacctgaaggtgaccctgaagcccatcctggatgagatctgtgacagcagcaagagctgtgaaattgaccccatcaagctgaaggagggggacaacgtggagaacaacaaggagaacctgcgctactacgtggacaagctgttcaacaccatcgtgaagagctccatgagctgccccaccgtgatgtgtgacatcttctacagcctgcggcagatggccacccagcgcttccccaatgacccccacgtgcagtacagcgctgtgagcagctttgtgttcctgcgcttctttgctgtggccgtggtgagcccccacaccttccacctgcggccccaccacccagatgcccagaccatccgcaccctgaccctcatcagcaagaccatccagaccctgggctcctggggcagcctgagcaagagcaagagcagcttcaaggagaccttcatgtgtgagttcttcaagatgttccaggaggagggctacatcatcgctgtgaagaagttcctggatgagatcagcagcacagagaccaaggagagcagcggcaccagcgagcctgtgcacctgaaggagggggagatgtacaagagggcccagggccgcaccagaattggcaagaagaacttcaagaagcgctggttctgcctgaccagccgggagctgacctaccacaagcagcccggcagcaaggatgccatctacaccatccctgtgaagaacatcctggccgtggagaagctggaggagagcagcttcaacaagaagaacatgttccaggtgatccacacagagaagcccctgtatgtgcaggccaacaactgtgtggaggccaatgagtggattgatgtgctgtgccgggtgagccgctgcaaccagaaccggctgtccttctaccaccccagcgtgtacctgaatggaaactggctgtgctgccaggagactggagagaacaccctgggctgcaagccctgcacagctggggtgcctgctgacatccagattgatattgatgaagatcgggagacagagcgcatctacagcctcttcaccctgagcctgctgaagctgcagaagatggaggaggcctgtggcaccatcgctgtgtaccagggcccccagaaggagccagatgactacagcaactttgtgattgaggacagcgtgaccaccttcaagaccatccagcagatcaagagcatcatcgagaagctggatgagccccatgagaagtacaggaagaagaggagcagcagcgccaagtatggcagcaaggagaaccccatcgtgggcaaggccagctag

SEQ ID NO: 167222 - DNA, 2505 bp, Artificial Sequence
  Description of Artificial Sequence: Synthetic coding sequence
atggctgtggaggatgagggcctgcgggtcttccagagcgtgaagatcaagatcggggaggccaagaacctgcccagctacccaggccccagcaagatgagggactgctactgcaccgtgaacctggaccaggaggaggtgttccgcaccaagatcgtggagaagagcctgtgccccttctatggagaggacttctactgtgagatccccaggagcttccgccacctgtccttctacatctttgacagagatgtgttcagaagagacagcatcatcggcaaggtggccatccagaaggaggacctgcagaagtaccacaacagagacacctggttccagctgcagcacgtggatgctgacagcgaggtgcagggcaaggtgcacctggagctgcggctgtctgaggtgatcacagacaccggggtggtgtgccacaagctggccaccagaattgtggagtgccagggcctgcccatcgtgaatggccagtgtgacccctatgccaccgtgaccctggccggccccttccgctctgaggccaagaagaccaaggtgaagaggaagaccaacaacccccagtttgatgaggtgttctactttgaggtgacccggccctgcagctacagcaagaagagccactttgattttgaggaggaggatgtggacaagctggagatccgggtggacctgtggaatgccagcaacctgaagtttggagatgagttcctgggggagctgcgcatccccctgaaggtgctgcggcagagcagcagctatgaggcctggtacttcctgcagccccgggacaatggcagcaagagcctgaagccagatgacctgggcagcctgcggctgaatgtggtgtacacagaagatcatgtgttcagcagtgactactacagccccctgcgggacctgctgctgaagtctgcagatgtggagcctgtgtctgccagcgctgcccacatcctgggggaggtgtgccgggagaagcaggaggccgctgtgcccctggtgcggctcttcctgcactacggccgggtggtgcccttcatcagcgccatcgccagcgctgaggtgaagaggacccaggaccccaacaccatcttccggggcaacagcctggccagcaagtgcattgatgagaccatgaagctggccggcatgcactacctgcacgtgaccctgaagccagccatcgaggagatctgccagagccacaagccctgtgaaattgatcctgtgaagctgaaggatggagagaacctggagaacaacatggagaacctgcggcagtatgtggacagagtcttccacgccatcacagagagcggcgtgtcctgccccaccgtgatgtgtgacatcttcttcagcctgcgggaggccgccgccaagcgcttccaggatgatcctgatgtgcgctacacagctgtgagcagcttcatcttcctgcgcttctttgccccagccatcctgagccccaacctcttccagctgaccccccaccacacagacccccagaccagcaggaccctgaccctcatcagcaagacagtgcagaccctgggcagcctgagcaagagcaagagcgccagcttcaaggagagctacatggccaccttctatgagttcttcaatgagcagaagtatgcagatgctgtgaagaacttcctggacctgatcagcagcagcggccggcgggaccccaagtctgtggagcagcccatcgtgctgaaggagggcttcatgatcaagagggcccagggcaggaagagatttggcatgaagaacttcaagaagcgctggttccggctgaccaaccacgagttcacctaccacaagagcaagggggaccagcccctgtacagcatccccatcgagaacatcctggccgtggagaagctggaggaggagagcttcaagatgaagaacatgttccaggtgatccagcctgagcgggccctgtacatccaggccaacaactgtgtggaggccaaggactggattgacatcctgaccaaggtgtcccagtgcaaccagaagaggctgactgtgtaccaccccagcgcctacctgagcggccactggctgtgctgccgggcccccagcgacagcgcccctggctgcagcccctgcacaggaggcctgcctgccaacatccagctggacattgatggagaccgggagacagagcgcatctacagcctcttcaacctgtacatgagcaagctggagaagatgcaggaggcctgtggcagcaagtctgtgtatgatggccctgagcaggaggagtacagcacctttgtgattgatgacccccaggagacctacaagaccctgaagcaggtgattgctggggtgggcgccctggagcaggagcacgcccagtacaagagggacaagttcaagaagaccaagtatggcagccaggagcaccccatcggggacaagagcttccagaactacatccggcagcagagcgagaccagcacccacagcatctag

SEQ ID NO: 167223 - DNA, 2409 bp, Artificial Sequence
  Description of Artificial Sequence: Synthetic coding sequence
atgagggactgctactgcaccgtgaacctggaccaggaggaggtgttccgcaccaagatcgtggagaagagcctgtgccccttctatggagaggacttctactgtgagatccccaggagcttccgccacctgtccttctacatctttgacagagatgtgttcagaagagacagcatcatcggcaaggtggccatccagaaggaggacctgcagaagtaccacaacagagacacctggttccagctgcagcacgtggatgctgacagcgaggtgcagggcaaggtgcacctggagctgcggctgtctgaggtgatcacagacaccggggtggtgtgccacaagctggccaccagaattgtggagtgccagggcctgcccatcgtgaatggccagtgtgacccctatgccaccgtgaccctggccggccccttccgctctgaggccaagaagaccaaggtgaagaggaagaccaacaacccccagtttgatgaggtgttctactttgaggtgacccggccctgcagctacagcaagaagagccactttgattttgaggaggaggatgtggacaagctggagatccgggtggacctgtggaatgccagcaacctgaagtttggagatgagttcctgggggagctgcgcatccccctgaaggtgctgcggcagagcagcagctatgaggcctggtacttcctgcagccccgggacaatggcagcaagagcctgaagccagatgacctgggcagcctgcggctgaatgtggtgtacacagaagatcatgtgttcagcagtgactactacagccccctgcgggacctgctgctgaagtctgcagatgtggagcctgtgtctgccagcgctgcccacatcctgggggaggtgtgccgggagaagcaggaggccgctgtgcccctggtgcggctcttcctgcactacggccgggtggtgcccttcatcagcgccatcgccagcgctgaggtgaagaggacccaggaccccaacaccatcttccggggcaacagcctggccagcaagtgcattgatgagaccatgaagctggccggcatgcactacctgcacgtgaccctgaagccagccatcgaggagatctgccagagccacaagccctgtgaaattgatcctgtgaagctgaaggatggagagaacctggagaacaacatggagaacctgcggcagtatgtggacagagtcttccacgccatcacagagagcggcgtgtcctgccccaccgtgatgtgtgacatcttcttcagcctgcgggaggccgccgccaagcgcttccaggatgatcctgatgtgcgctacacagctgtgagcagcttcatcttcctgcgcttctttgccccagccatcctgagccccaacctcttccagctgaccccccaccacacagacccccagaccagcaggaccctgaccctcatcagcaagacagtgcagaccctgggcagcctgagcaagagcaagagcgccagcttcaaggagagctacatggccaccttctatgagttcttcaatgagcagaagtatgcagatgctgtgaagaacttcctggacctgatcagcagcagcggccggcgggaccccaagtctgtggagcagcccatcgtgctgaaggagggcttcatgatcaagagggcccagggcaggaagagatttggcatgaagaacttcaagaagcgctggttccggctgaccaaccacgagttcacctaccacaagagcaagggggaccagcccctgtacagcatccccatcgagaacatcctggccgtggagaagctggaggaggagagcttcaagatgaagaacatgttccaggtgatccagcctgagcgggccctgtacatccaggccaacaactgtgtggaggccaaggactggattgacatcctgaccaaggtgtcccagtgcaaccagaagaggctgactgtgtaccaccccagcgcctacctgagcggccactggctgtgctgccgggcccccagcgacagcgcccctggctgcagcccctgcacaggaggcctgcctgccaacatccagctggacattgatggagaccgggagacagagcgcatctacagcctcttcaacctgtacatgagcaagctggagaagatgcaggaggcctgtggcagcaagtctgtgtatgatggccctgagcaggaggagtacagcacctttgtgattgatgacccccaggagacctacaagaccctgaagcaggtgattgctggggtgggcgccctggagcaggagcacgcccagtacaagagggacaagttcaagaagaccaagtatggcagccaggagcaccccatcggggacaagagcttccagaactacatccggcagcagagcgagaccagcacccacagcatctag

SEQ ID NO: 167224 - DNA, 399 bp, Artificial Sequence
  Description of Artificial Sequence: Synthetic coding sequence
atggctgtggaggatgagggcctgcgggtcttccagagcgtgaagatcaagatcggggaggccaagaacctgcccagctacccaggccccagcaagatgagggactgctactgcaccgtgaacctggaccaggaggaggtgttccgcaccaagatcgtggagaagagcctgtgccccttctatggagaggacttctactgtgagatccccaggagcttccgccacctgtccttctacatctttgacagagatgtgttcagaagagacagcatcatcggccagagcgcccctggagctgctgctgagcggggccaccaccgccactggggccgcctgccccaggcccggcacacccaccggcgggtgcccggccccccccaccgggagtgggccatgtag

SEQ ID NO: 167225 - DNA, 2412 bp, Artificial Sequence
  Description of Artificial Sequence: Synthetic coding sequence
atggccaagaggagcagcctgtacatcagaattgtggagggcaagaacctgcctgccaaggacatcaccggcagcagtgacccctactgcatcgtgaaggtggacaatgagcccatcatcagaacagccaccgtgtggaagaccctgtgccccttctggggcgaggagtaccaggtgcacctgccccccaccttccacgctgtggccttctacgtgatggatgaagatgccctgagcagagatgatgtgattggcaaggtgtgcctgacccgggacaccatcgccagccaccccaagggcttcagcggctgggcccacctgacagaggtggaccctgatgaggaggtgcagggcgagatccacctgcggctggaggtgtggccaggggcccgggcctgccgcctgcgctgcagcgtgctggaggcccgggacctggcccccaaggacagaaatggcaccagtgacccctttgtgcgggtgcgctacaagggccgcacccgggagaccagcatcgtgaagaagagctgctacccccgctggaatgagacctttgaatttgagctgcaggagggcgccatggaggccctgtgtgtggaggcctgggactgggacctggtgtccagaaatgacttcctgggcaaggtggtgattgatgtgcagaggctgcgggtggtgcagcaggaggagggctggttccggctgcagcctgaccagagcaagagcagaagacatgatgagggcaacctgggcagcctgcagctggaggtgcggctgagagatgagaccgtgctgcccagcagctactaccagcccctggtgcacctgctgtgccacgaggtgaagctgggcatgcagggccctggccagctgatccccctcatcgaggagaccaccagcacagaatgtcggcaggatgtggccaccaacctgctgaagctgttcctgggccagggcctggccaaggacttcctggacctgctcttccagctggagctgagcaggaccagcgagaccaacaccctcttccgcagcaacagcctggccagcaagtccatggagagcttcctgaaggtggccggcatgcagtacctgcatggagtgctgggccccatcatcaacaaggtgtttgaggagaagaagtatgtggagctggaccccagcaaggtggaggtgaaggatgtgggctgcagcggcctgcaccggccccagacagaggccgaggtgctggagcagagcgcccagaccctgcgggcccacctgggcgccctgctgagcgccctgagccgctctgtgcgggcctgcccagctgtggtgcgggccaccttccggcagctgttcagaagagtgcgggagcgcttccctggggcccagcatgaaaatgtgcccttcatcgctgtgaccagcttcctgtgcctgcgcttcttctccccagccatcatgagccccaagctgttccacctgcgggagagacatgctgatgcccggaccagcaggaccctgctgctgctggccaaggctgtgcagaatgtgggcaacatggacaccccagccagccgggccaaggaggcctggatggagcccctgcagcccaccgtgcggcagggcgtggcccagctgaaggacttcatcaccaagctggtggacatcgaggagaaggatgagctggacctgcagaggaccctgagcctgcaggcccctcctgtgaaggagggccccctcttcatccacaggaccaagggcaagggccccctgatgagcagcagcttcaagaagctgtacttcagcctgaccacagaggccctgagctttgccaagacccccagcagcaagaagagcgccctgatcaagctggccaacatccgggctgctgagaaggtggaggagaagagctttggaggcagccacgtgatgcaggtgatctacacagatgatgctggccggccccagacagcctacctgcagtgcaagtgtgtgaatgagctgaaccagtggctgagcgccctgaggaaggtgtccatcaacaacacaggcctgctgggcagctaccaccctggggtcttccggggggacaagtggagctgctgccaccagaaggagaagacaggccagggctgtgacaagaccaggagccgggtgaccctgcaggagtggaatgaccccctggaccatgacctggaggcccagctgatctaccgccacctgctgggcgtggaggccatgctgtgggagcggcaccgggagctgtctggaggagctgaggccggcaccgtgcccaccagccctgggaaggtgcctgaggacagcctggcccggctgctgcgggtgctgcaggacctgcgggaggcccacagcagcagccctgctggcagccccccatctgagcccaactgcctgctggagctgcagacctag

SEQ ID NO: 167226 - DNA, 2274 bp, Artificial Sequence
  Description of Artificial Sequence: Synthetic coding sequence
atggccaagaggagcagcctgtacatcagaattgtggagggcaagaacctgcctgccaaggacatcaccggcagcagtgacccctactgcatcgtgaaggtggacaatgagcccatcatcagaacagccaccgtgtggaagaccctgtgccccttctggggcgaggagtaccaggtgcacctgccccccaccttccacgctgtggccttctacgtgatggatgaagatgccctgagcagagatgatgtgattggcaaggtgtgcctgacccgggacaccatcgccagccaccccaagggcttcagcggctgggcccacctgacagaggtggaccctgatgaggaggtgcagggcgagatccacctgcggctggaggtgtggccaggggcccgggcctgccgcctgcgctgcagcgtgctggaggcccgggacctggcccccaaggacagaaatggcaccagtgacccctttgtgcgggtgcgctacaagggccgcacccgggagaccagcatcgtgaagaagagctgctacccccgctggaatgagacctttgaatttgagctgcaggagggcgccatggaggccctgtgtgtggaggcctgggactgggacctggtgtccagaaatgacttcctgggcaaggtggtgattgatgtgcagaggctgcgggtggtgcagcaggaggagggctggttccggctgcagcctgaccagagcaagagcagaagacatgatgagggcaacctgggcagcctgcagctggaggtgcggctgagagatgagaccgtgctgcccagcagctactaccagcccctggtgcacctgctgtgccacgaggtgaagctgggcatgcagggccctggccagctgatccccctcatcgaggagaccaccagcacagaatgtcggcaggatgtggccaccaacctgctgaagctgttcctgggccagggcctggccaaggacttcctggacctgctcttccagctggagctgagcaggaccagcgagaccaacaccctcttccgcagcaacagcctggccagcaagtccatggagagcttcctgaaggtggccggcatgcagtacctgcatggagtgctgggccccatcatcaacaaggtgtttgaggagaagaagtatgtggagctggaccccagcaaggtggaggtgaaggatgtgggctgcagcggcctgcaccggccccagacagaggccgaggtgctggagcagagcgcccagaccctgcgggcccacctgggcgccctgctgagcgccctgagccgctctgtgcgggcctgcccagctgtggtgcgggccaccttccggcagctgttcagaagagtgcgggagcgcttccctggggcccagcatgaaaatgtgcccttcatcgctgtgaccagcttcctgtgcctgcgcttcttctccccagccatcatgagccccaagctgttccacctgcgggagagacatgctgatgcccggaccagcaggaccctgctgctgctggccaaggctgtgcagaatgtgggcaacatggacaccccagccagccgggccaaggaggcctggatggagcccctgcagcccaccgtgcggcagggcgtggcccagctgaaggacttcatcaccaagctggtggacatcgaggagaaggatgagctggacctgcagaggaccctgagcctgcaggcccctcctgtgaaggagggccccctcttcatccacaggaccaagggcaagggccccctgatgagcagcagcttcaagaagctgtacttcagcctgaccacagaggccctgagctttgccaagacccccagcagcaaatgtgtgaatgagctgaaccagtggctgagcgccctgaggaaggtgtccatcaacaacacaggcctgctgggcagctaccaccctggggtcttccggggggacaagtggagctgctgccaccagaaggagaagacaggccagggctgtgacaagaccaggagccgggtgaccctgcaggagtggaatgaccccctggaccatgacctggaggcccagctgatctaccgccacctgctgggcgtggaggccatgctgtgggagcggcaccgggagctgtctggaggagctgaggccggcaccgtgcccaccagccctgggaaggtgcctgaggacagcctggcccggctgctgcgggtgctgcaggacctgcgggaggcccacagcagcagccctgctggcagccccccatctgagcccaactgcctgctggagctgcagacctag

SEQ ID NO: 167227 - DNA, 2196 bp, Artificial Sequence
  Description of Artificial Sequence: Synthetic coding sequence
atggatgaagatgccctgagcagagatgatgtgattggcaaggtgtgcctgacccgggacaccatcgccagccaccccaagggcttcagcggctgggcccacctgacagaggtggaccctgatgaggaggtgcagggcgagatccacctgcggctggaggtgtggccaggggcccgggcctgccgcctgcgctgcagcgtgctggaggcccgggacctggcccccaaggacagaaatggcaccagtgacccctttgtgcgggtgcgctacaagggccgcacccgggagaccagcatcgtgaagaagagctgctacccccgctggaatgagacctttgaatttgagctgcaggagggcgccatggaggccctgtgtgtggaggcctgggactgggacctggtgtccagaaatgacttcctgggcaaggtggtgattgatgtgcagaggctgcgggtggtgcagcaggaggagggctggttccggctgcagcctgaccagagcaagagcagaagacatgatgagggcaacctgggcagcctgcagctggaggtgcggctgagagatgagaccgtgctgcccagcagctactaccagcccctggtgcacctgctgtgccacgaggtgaagctgggcatgcagggccctggccagctgatccccctcatcgaggagaccaccagcacagaatgtcggcaggatgtggccaccaacctgctgaagctgttcctgggccagggcctggccaaggacttcctggacctgctcttccagctggagctgagcaggaccagcgagaccaacaccctcttccgcagcaacagcctggccagcaagtccatggagagcttcctgaaggtggccggcatgcagtacctgcatggagtgctgggccccatcatcaacaaggtgtttgaggagaagaagtatgtggagctggaccccagcaaggtggaggtgaaggatgtgggctgcagcggcctgcaccggccccagacagaggccgaggtgctggagcagagcgcccagaccctgcgggcccacctgggcgccctgctgagcgccctgagccgctctgtgcgggcctgcccagctgtggtgcgggccaccttccggcagctgttcagaagagtgcgggagcgcttccctggggcccagcatgaaaatgtgcccttcatcgctgtgaccagcttcctgtgcctgcgcttcttctccccagccatcatgagccccaagctgttccacctgcgggagagacatgctgatgcccggaccagcaggaccctgctgctgctggccaaggctgtgcagaatgtgggcaacatggacaccccagccagccgggccaaggaggcctggatggagcccctgcagcccaccgtgcggcagggcgtggcccagctgaaggacttcatcaccaagctggtggacatcgaggagaaggatgagctggacctgcagaggaccctgagcctgcaggcccctcctgtgaaggagggccccctcttcatccacaggaccaagggcaagggccccctgatgagcagcagcttcaagaagctgtacttcagcctgaccacagaggccctgagctttgccaagacccccagcagcaagaagagcgccctgatcaagctggccaacatccgggctgctgagaaggtggaggagaagagctttggaggcagccacgtgatgcaggtgatctacacagatgatgctggccggccccagacagcctacctgcagtgcaagtgtgtgaatgagctgaaccagtggctgagcgccctgaggaaggtgtccatcaacaacacaggcctgctgggcagctaccaccctggggtcttccggggggacaagtggagctgctgccaccagaaggagaagacaggccagggctgtgacaagaccaggagccgggtgaccctgcaggagtggaatgaccccctggaccatgacctggaggcccagctgatctaccgccacctgctgggcgtggaggccatgctgtgggagcggcaccgggagctgtctggaggagctgaggccggcaccgtgcccaccagccctgggaaggtgcctgaggacagcctggcccggctgctgcgggtgctgcaggacctgcgggaggcccacagcagcagccctgctggcagccccccatctgagcccaactgcctgctggagctgcagacctag

SEQ ID NO: 167228 - DNA, 2415 bp, Artificial Sequence
  Description of Artificial Sequence: Synthetic coding sequence
atggccaagagcagcagcctgaatgtgcgggtggtggagggccgggccctgcctgccaaggatgtgtctggcagcagtgacccctactgcctggtgaaggtggatgatgaggtggtggccaggacagccaccgtgtggaggagcctgggccccttctggggcgaggagtacacagtgcacctgcccctggacttccaccagctggccttctacgtgctggatgaagatactgtgggccatgatgacatcatcggcaagatcagcctgagccgggaggccatcacagctgacccccggggcatcgacagctggatcaacctgagccgggtggaccctgatgctgaggtgcagggcgagatctgcctgtctgtgcagatgctggaggatggccagggccgctgcctgcgctgccacgtgctgcaggcccgggacctggccccccgggacatcagcggcaccagtgacccctttgcccgggtcttctggggcagccagagcctggagaccagcaccatcaagaagacccgcttcccccactgggatgaggtgctggagctgcgggagatgcctggggcccccagccccctgcgggtggagctgtgggactgggacatggtgggcaagaatgacttcctgggcatggtggagttcagccccaagaccctgcagcagaagccacccaagggctggttccggctgctgcccttccccagggcagaagaagattctgggggcaacctgggcgccctgcgggtgaaggtgcggctgattgaggacagagtgctgcccagccagtgctaccagcccctgatggagctgctgatggagagcgtgcagggccctgctgaggaggacacagccagccccctggccctgctggaggagctgaccctgggggactgccggcaggacctggccaccaagctggtgaagctgttcctgggccggggcctggccggccgcttcctggactacctgacccggcgggaggtggcccggaccatggaccccaacaccctcttccgcagcaacagcctggccagcaagtccatggagcagttcatgaagctggtgggcatgccctacctgcacgaggtgctgaagcctgtgatcagccgggtgtttgaggagaagaagtacatggagctggacccctgcaagatggacctgggccgcacccggcgcatctccttcaagggggccctgtctgaggagcagatgagggagaccagcctgggcctgctgaccggctacctgggccccatcgtggatgccatcgtgggctctgtgggccgctgccccccagccatgaggctggccttcaagcagctgcaccggcgggtggaggagcgcttcccccaggccgagcaccaggatgtgaagtacctggccatcagcggcttcctgttcctgcgcttctttgccccagccatcctgacccccaagctgtttgacctgcgggaccagcacgccgacccccagaccagccgcagcctgctgctgctggccaaggctgtgcagagcatcggcaacctgggccagcagctgggccagggcaaggagctgtggatggcccccctgcaccccttcctgctgcagtgtgtgtcccgggtgcgggacttcctggaccggctggtggatgtggatggagatgaagctggggtgcctgcccgggccctcttcccccccagcgccatcgtgcgggagggctacctgctgaagaggaaggaggagcccgccggcctggccaccaggtttgccttcaagaagcgctacgtgtggctgagcggggagaccctgtccttcagcaagagccctgagtggcagatgtgccacagcatccctgtgagccacatccgggctgtggagcgggtggatgagggcgccttccagctgccccacgtgatgcaggtggtgacccaggacggcaccggggccctgcacaccacctacctgcagtgcaagaatgtgaatgagctgaaccagtggctgagcgccctgaggaaggccagcgcccccaaccccaacaagctggccgcctgccaccctggggccttccgcagcgcccgctggacctgctgcctgcaggccgagaggtctgctgctggctgcagcaggacccacagcgctgtgaccctgggggactggagcgaccccctggaccctgatgctgaggcccagacagtgtaccggcagctgctgctgggccgggaccagctgcggctgaagctgctggaggacagcaacatggacaccaccctggaggccgacaccggggcctgcccagaggtgctggcccggcagagagctgccacagcccggctgctggaggtgctggccgacctggaccgggcccacgaggagttccagcagcaggagcggggcaaggccgccctgggccccctgggcccctag

SEQ ID NO: 167229 - DNA, 2331 bp, Artificial Sequence
  Description of Artificial Sequence: Synthetic coding sequence
atggccaagagcagcagcctgaatgtgcgggtggtggagggccgggccctgcctgccaaggatgtgtctggcagcagtgacccctactgcctggtgaaggtggatgatgaggtggtggccaggacagccaccgtgtggaggagcctgggccccttctggggcgaggagtacacagtgcacctgcccctggacttccaccagctggccttctacgtgctggatgaagatactgtgggccatgatgacatcatcggcaagatcagcctgagccgggaggccatcacagctgacccccggggcatcgacagctggatcaacctgagccgggtggaccctgatgctgaggtgcagggcgagatctgcctgtctgtgcagatgctggaggatggccagggccgctgcctgcgctgccacgtgctgcaggcccgggacctggccccccgggacatcagcggcaccagtgacccctttgcccgggtcttctggggcagccagagcctggagaccagcaccatcaagaagacccgcttcccccactgggatgaggtgctggagctgcgggagatgcctggggcccccagccccctgcgggtggagctgtgggactgggacatggtgggcaagaatgacttcctgggcatggtggagttcagccccaagaccctgcagcagaagccacccaagggctggttccggctgctgcccttccccagggcagaagaagattctgggggcaacctgggcgccctgcgggtgaaggtgcggctgattgaggacagagtgctgcccagccagtgctaccagcccctgatggagctgctgatggagagcgtgcagggccctgctgaggaggacacagccagccccctggccctgctggaggagctgaccctgggggactgccggcaggacctggccaccaagctggtgaagctgttcctgggccggggcctggccggccgcttcctggactacctgacccggcgggaggtggcccggaccatggaccccaacaccctcttccgcagcaacagcctggccagcaagtccatggagcagttcatgaagctggtgggcatgccctacctgcacgaggtgctgaagcctgtgatcagccgggtgtttgaggagaagaagtacatggagctggacccctgcaagatggacctgggccgcacccggcgcatctccttcaagggggccctgtctgaggagcagatgagggagaccagcctgggcctgctgaccggctacctgggccccatcgtggatgccatcgtgggctctgtgggccgctgccccccagccatgaggctggccttcaagcagctgcaccggcgggtggaggagcgcttcccccaggccgagcaccaggatgtgaagtacctggccatcagcggcttcctgttcctgcgcttctttgccccagccatcctgacccccaagctgtttgacctgcgggaccagcacgccgacccccagaccagccgcagcctgctgctgctggccaaggctgtgcagagcatcggcaacctgggccagcagctgggccagggcaaggagctgtggatggcccccctgcaccccttcctgctgcagtgtgtgtcccgggtgcgggacttcctggaccggctggtggatgtggatggagatgaagctggggtgcctgcccgggccctcttcccccccagcgccatcgtgcgggagggctacctgctgaagaggaaggaggagcccgccggcctggccaccaggtttgccttcaagaagcgctacgtgtggctgagcggggagaccctgtccttcagcaagagccctgagtggcaggtggtgacccaggacggcaccggggccctgcacaccacctacctgcagtgcaagaatgtgaatgagctgaaccagtggctgagcgccctgaggaaggccagcgcccccaaccccaacaagctggccgcctgccaccctggggccttccgcagcgcccgctggacctgctgcctgcaggccgagaggtctgctgctggctgcagcaggacccacagcgctgtgaccctgggggactggagcgaccccctggaccctgatgctgaggcccagacagtgtaccggcagctgctgctgggccgggaccagctgcggctgaagctgctggaggacagcaacatggacaccaccctggaggccgacaccggggcctgcccagaggtgctggcccggcagagagctgccacagcccggctgctggaggtgctggccgacctggaccgggcccacgaggagttccagcagcaggagcggggcaaggccgccctgggccccctgggcccctag

SEQ ID NO: 167230 - DNA, 2421 bp, Artificial Sequence
  Description of Artificial Sequence: Synthetic coding sequence
atggccaagagcagcagcctgaatgtgcgggtggtggagggccgggccctgcctgccaaggatgtgtctggcagcagtgacccctactgcctggtgaaggtggatgatgaggtggtggccaggacagccaccgtgtggaggagcctgggccccttctggggcgaggagtacacagtgcacctgcccctggacttccaccagctggccttctacgtgctggatgaagatactgtgggccatgatgacatcatcggcaagatcagcctgagccgggaggccatcacagctgacccccggggcatcgacagctggatcaacctgagccgggtggaccctgatgctgaggtgcagggcgagatctgcctgtctgtgcagatgctggaggatggccagggccgctgcctgcgctgccacgtgctgcaggcccgggacctggccccccgggacatcagcggcaccagtgacccctttgcccgggtcttctggggcagccagagcctggagaccagcaccatcaagaagacccgcttcccccactgggatgaggtgctggagctgcgggagatgcctggggcccccagccccctgcgggtggagctgtgggactgggacatggtgggcaagaatgacttcctgggcatggtggagttcagccccaagaccctgcagcagaagccacccaagggctggttccggctgctgcccttccccagggcagaagaagattctgggggcaacctgggcgccctgcgggtgaaggtgcggctgattgaggacagagtgctgcccagccagtgctaccagcccctgatggagctgctgatggagagcgtgcagggccctgctgaggaggacacagccagccccctggccctgctggaggagctgaccctgggggactgccggcaggacctggccaccaagctggtgaagctgttcctgggccggggcctggccggccgcttcctggactacctgacccggcgggaggtggcccggaccatggaccccaacaccctcttccgcagcaacagcctggccagcaagtccatggagcagttcatgaagctggtgggcatgccctacctgcacgaggtgctgaagcctgtgatcagccgggtgtttgaggagaagaagtacatggagctggacccctgcaagatggacctgggccgcacccggcgcatctccttcaagggggccctgtctgaggagcagatgagggagaccagcctgggcctgctgaccggctacctgggccccatcgtggatgccatcgtgggctctgtgggccgctgccccccagccatgaggctggccttcaagcagctgcaccggcgggtggaggagcgcttcccccaggccgagcaccagcaggatgtgaagtacctggccatcagcggcttcctgttcctgcgcttctttgccccagccatcctgacccccaagctgtttgacctgcgggaccagcacgccgacccccagaccagccgcagcctgctgctgctggccaaggctgtgcagagcatcggcaacctgggccagcagctgggccagggcaaggagctgtggatggcccccctgcaccccttcctgctgcagtgtgtgtcccgggtgcgggacttcctggaccggctggtggatgtggatggagatgaggaggccggcgtgcctgcccgggccctcttcccccccagcgccatcgtgcgggagggctacctgctgaagaggaaggaggagcccgccggcctggccaccaggtttgccttcaagaagcgctacgtgtggctgagcggggagaccctgtccttcagcaagagccctgagtggcagatgtgccacagcatccctgtgagccacatccgggctgtggagcgggtggatgagggcgccttccagctgccccacgtgatgcaggtggtgacccaggacggcaccggggccctgcacaccacctacctgcagtgcaagaatgtgaatgagctgaaccagtggctgagcgccctgaggaaggccagcgcccccaaccccaacaagctggccgcctgccaccctggggccttccgcagcgcccgctggacctgctgcctgcaggccgagaggtctgctgctggctgcagcaggacccacagcgctgtgaccctgggggactggagcgaccccctggaccctgatgctgaggcccagacagtgtaccggcagctgctgctgggccgggaccagctgcggctgaagctgctggaggacagcaacatggacaccaccctggaggccgacaccggggcctgcccagaggtgctggcccggcagagagctgccacagcccggctgctggaggtgctggccgacctggaccgggcccacgaggagttccagcagcaggagcggggcaaggccgccctgggccccctgggcccctag

SEQ ID NO: 167231 - DNA, 3714 bp, Artificial Sequence
  Description of Artificial Sequence: Synthetic coding sequence
atgcagaagtctgtgcgctacaatgaaggacatgccctgtacctggccttcctggccaggaaggagggcaccaagaggggcttcctgagcaagaagacagctgaggccagccgctggcatgagaagtggtttgccctgtaccagaatgtgctcttctactttgaaggagagcagagctgcaggcctgctggcatgtacctgctggagggctgcagctgtgagaggaccccagccccaccccgggccggggccggccagggcggcgtgagagatgccctggacaagcagtactacttcaccgtgctgtttggacatgagggccagaagcccctggagctgcgctgtgaggaggagcaggacggcaaggagtggatggaggccatccaccaggccagctatgctgacatcctgattgaaagagaggtgctgatgcagaagtacatccacctggtgcagatcgtggagacagagaagattgctgccaaccagctgcggcaccagctggaggaccaggacacagaaattgagcggctgaagtctgagatcatcgccctgaacaagaccaaggagaggatgaggccctaccagagcaaccaggaggatgaggaccctgacatcaagaagatcaagaaggtgcagagcttcatgaggggctggctgtgcaggaggaagtggaagaccatcgtgcaggactacatctgcagcccccacgccgagagcatgaggaagaggaaccagatcgtgttcaccatggtggaggccgagagtgaatatgtgcaccagctgtacatcctggtgaatggcttcctgcggcccctgaggatggccgccagcagcaagaagccacccatcagccatgatgatgtgagcagcatcttcctgaacagcgagaccatcatgttcctgcacgagatcttccaccagggcctgaaggcccgcatcgccaactggcccaccctcatcctggccgacctgtttgacatcctgctgcccatgctgaacatctaccaggagtttgtgaggaaccaccagtacagcctgcaggtgctggccaactgcaagcagaacagagactttgacaagctgctgaagcagtatgaggccaacccagcctgtgagggccgcatgctggagaccttcctgacctaccccatgttccagatcccccgctacatcatcaccctgcacgagctgctggcccacacccctcatgagcacgtggagaggaagagcctggagtttgccaagagcaagctggaggagctgagccgggtgatgcatgatgaggtgtctgacacagagaacatcaggaagaacctggccatcgagaggatgattgtggagggctgtgacatcctgctggacaccagccagaccttcatccggcagggcagcctcatccaggtgcccagcgtggagcggggcaagctgagcaaggtgcggctgggcagcctgagcctgaagaaggagggggagcggcagtgcttcctgttcaccaagcacttcctgatctgcaccaggagcagcggcggcaagctgcacctgctgaagacaggaggagtgctgagcctgattgactgcaccctcatcgaggagccagatgccagtgatgatgacagcaaaggaagtggccaggtgtttggccacctggacttcaagatcgtggtggagcccccagatgctgctgccttcaccgtggtgctgctggcccccagccggcaggagaaggccgcctggatgtctgacatcagccagtgtgtggacaacatccgctgcaatggcctgatgaccatcgtgtttgaggagaacagcaaggtgacagtgccccacatgatcaagagtgatgcccggctgcacaaggatgacacagacatctgcttcagcaagaccctgaacagctgcaaggtgccccagatccgctatgcctctgtggagcggctgctggagcggctgacagacctgcgcttcctgagcattgacttcctgaacaccttcctgcacacctaccgcatcttcaccacagctgctgtggtgctgggcaagctgagtgacatctacaagaggcccttcaccagcatccctgtgcgcagcctggagctgttctttgccaccagccagaacaacagaggagagcacctggtggatggcaagagcccccggctgtgcaggaagttcagcagccccccacccctggccgtgtccaggaccagcagccctgtgcgggccaggaagctgagcctgaccagccccctgaacagcaagattggagccctggacctgaccaccagcagcagccccaccaccaccacccagagccctgctgccagccccccaccccacacaggccagatccccctggacctgagccggggcctgagcagccctgagcagagccctggcaccgtggaggagaatgtggacaacccccgggtggacctgtgcaacaagctgaagaggagcatccagaaggctgtgctggagagcgccccagctgaccgggccggcgtggagagcagccctgctgctgacaccacagagctgagcccctgccgcagccccagcacccccaggcacctgcgctaccggcagcccggcggccagacagctgacaatgcccactgcagcgtgtccccagccagcgcctttgccatcgccacagctgctgctggccacggcagccccccaggcttcaacaacacagagaggacctgtgacaaggagttcatcatcagaagaacagccaccaacagagtgctgaatgtgctgcggcactgggtgtccaagcacgcccaggactttgagctgaacaatgagctgaagatgaatgtgctgaacctgctggaggaggtgctgcgggaccctgacctgctgccccaggagaggaaggccgccgccaacatcctgcgggccctgagccaggatgaccaggatgacatccacctgaagctggaggacatcatccagatgacagactgcatgaaggccgagtgctttgagagcctgagcgccatggagctggccgagcagatcaccctgctggaccacgtgatcttccgcagcatcccctatgaggagttcctgggccagggctggatgaagctggacaagaatgaaagaacaccctacatcatgaagaccagccagcacttcaatgacatgagcaacctggtggccagccagatcatgaactatgcagatgtgagcagccgggccaatgccatcgagaagtgggtggccgtggccgacatctgccgctgcctgcacaactacaatggagtgctggagatcaccagcgccctgaacagaagtgccatctaccgcctgaagaagacctgggccaaggtgtccaagcagaccaaggccctgatggacaagctgcagaagacagtgagcagcgagggccgcttcaagaacctgcgggagaccctgaagaactgcaaccccccagctgtgccctacctgggcatgtacctgacagacctggccttcatcgaggagggcacccccaacttcacagaggagggcctggtgaacttcagcaagatgaggatgatcagccacatcatccgggagatccggcagttccagcagaccagctacagaattgaccaccagcccaaggtggcccagtacctgctggacaaggacctgatcattgatgaggacaccctgtatgagctgagcctgaagattgagccccggctgcctgcctag

SEQ ID NO: 167232 - DNA, 4431 bp, Artificial Sequence
  Description of Artificial Sequence: Synthetic coding sequence
atgaccagcagcagccctgctggcctggagggcagtgacctgagcagcatcaacaccatgatgtctgctgtgatgtctgtgggcaaggtgacagaaaatggaggcagcccccagggcatcaagagccccagcaagcccccaggccccaaccgcatcggcagaagaaaccaggagaccaaggaggagaagagcagctacaactgccccctgtgtgagaagatctgcaccacccagcaccagctgaccatgcacatccggcagcacaacacagacaccggcggcgctgaccacagctgcagcatctgtgggaagagcctgagcagcgccagcagcctggacagacacatgctggtgcacagcggggagcggccctacaagtgcaccgtgtgtggccagagcttcaccaccaatggaaacatgcaccgccacatgaagatccacgagaaggaccccaacagcgccacagccacagccccacccagccccctgaagagaagaaggctgagcagcaagaggaagctgagccatgatgctgagagcgagagagaagatcctgccccagccaagaagatggtggaggatggccagagcggggacctggagaagaaggcagatgaggtgttccactgccctgtgtgcttcaaggagtttgtgtgcaagtatggcctggagacccacatggagacccacagcgacaaccccctgcgctgtgacatctgctgcgtgaccttccgcacccaccggggcctgctgcggcacaatgccctggtgcacaagcagctgcccagagatgccatgggccggcccttcatccagaacaaccccagcatcccagctggcttccatgacctgggcttcacagacttcagctgcaggaagttcccccgcatcagccaggcctggtgtgagaccaacctgcggcgctgcatcagcgagcagcacagatttgtgtgtgacacctgtgacaaggccttccccatgctgtgcagcctggccctgcacaagcagacccacgtggccgctgaccagggccaggagaagccccaggccacccccctgcctggagatgccctggaccagaagggcttcctggccctgctgggcctgcagcacaccaaggatgtgcggcctgccccagctgaggagcccctgcctgatgacaaccaggccatccagctgcagaccctgaagtgccagctgccccaggaccccggctgcaccaacctgctgagcctgagcccctttgaagctgccagcctgggcggcagcctgactgtgctgcctgccaccaaggacagcatcaagcacctgagcctgcagcccttccagaagggcttcatcatccagcctgacagcagcatcgtggtgaagcccatcagcggggagagcgccatcgagctggccgacatccagcagatcctgaagatggccgccagcgccccaccccagatcagcctgccccccttcagcaaggccccagctgcccccctgcaggccatcttcaagcacatgccacccctgaagcccaagcccctggtgacccccaggacagtggtggccaccagcaccccacctcctctcatcaatgcccagcaggccagccctggctgcatcagccccagcctgcccccaccacccctgaagctgctgaagggctctgtggaggccgccagcaatgcccacctgctgcagagcaagagcggcacccagccccatgctgccacccggctgagcctgcagcagcccagggctgagctgcccggccagcctgagatgaagacccagctggagcaggacagcatcatcgaggccctgctgcccctgtccatggaggccaagatcaagcaggagatcacagaaggagagctgaaggccttcatgacagcccctgggggcaagaagaccccagccatgaggaaggtgctgtacccctgccgcttctgcaaccaggtgtttgccttctctggagtgctgcgggcccacgtgcgcagccacctgggcatcagcccctaccagtgcaacatctgtgactacatcgctgctgacaaggccgccctgatccgccacctgcggacccacagcggggagcggccctacatctgcaagatctgccactaccccttcaccgtgaaggccaactgtgagcggcacctgaggaagaagcacctgaaggccaccaggaaggacatcgagaagaacatcgagtatgtgagcagcagcgctgctgagctggtggatgccttctgtgccccagacacagtgtgccgcctgtgtggggaggacctgaagcactaccgggccctgcgcatccacatgaggacccactgcggccggggcctgggcggcggccacaagggcaggaagccctttgagtgcaaggagtgcagcgctgcctttgctgccaagaggaactgcatccaccacatcctgaagcagcacctgcacgtgcctgagcaggacatcgagagctatgtgctggccgcagatggcctgggccctgctgaggccccagctgctgaggccagcggccgcggggaggacagcggctgtgccgccctgggggactgcaagcccctgacagccttcctggagccccagaatggcttcctgcaccggggccccacccagcccccacctcctcatgtgtccatcaagctggagcccgccagcagctttgctgtggacttcaatgagcccctggacttcagccagaagggcctggccctggtgcaggtgaagcaggagaacatctccttcctgagccccagcagcctggtgccctatgactgcagcatggagcccatcgacctgagcatccccaagaacttcagaaaaggagacaaggacctggccacccccagcgaggccaagaagccagaggaggaggccggcagcagcgagcagcccagcccctgcccagcccctggccccagcctgcctgtgaccctgggccccagcggcatcctggagagccccatggccccagccccagctgccaccccagagcccccagcccagcccctgcagggccctgtgcagctggccgtgcccatctacagcagcgccctggtgagcagcccccccctggtgggcagcagcgccctgctgtctggaacagccctgctgcggcccctgcggcccaagccacccctgctgctgcccaagccccctgtgacagaggagctgccccccctggccagcatcgcccagatcatcagctctgtgtcctctgcccccaccctgctgaagaccaaggtggccgaccccggccctgccagcacaggcagcaacaccacagccagtgacagcctgggcggctctgtgcccaaggccgccaccacagccaccccagctgccaccaccagccccaaggagagcagcgagcccccagccccagccagcagccctgaggccgccagccccacagagcagggccctgctggcaccagcaagaagaggggcaggaagaggggcatgaggagccggccccgggccaacagcggaggagtggacctggacagcagtggagaatttgccagcattgagaagatgctggccaccacagacaccaacaagttcagccccttcctgcagacagctgaggacaacacccaggatgaggtggccggggccccagctgaccaccacggccccagtgatgaggagcagggcagccccccagaggacaagctgctgcgggccaagaggaacagctacaccaactgcctgcagaagatcacctgcccccactgccccagggtcttcccctgggccagcagcctgcagaggcacatgctgacccacacaggccagaagcccttcccctgccagaagtgtgatgccttcttcagcaccaagagcaactgtgagcggcaccagctgaggaagcatggagtgaccacctgcagcctgcggagaaatggcctcatcccccagagcaaggagagtgatgtgggcagccatgacagcactggagagcggccctacaagtgccagacctgtgagaggaccttcaccctgaagcacagcctggtgcgccaccagaggatccaccagaaggcccggcatgccaagcaccacggcaaggacagcgacaaggaggagcggggggaggaggacagtgaaaatgaaagcacccacagcggcaacaatgctgtgtctgaaaatgaagctgagctggccccaaatgccagcaaccacatggctgtgaccaggagcaggaaggagggcctggccagcgccaccaaggactgcagccaccgggaggagaaggtgacagctggctggcccagcgagcccggccagggcgacctgaaccctgagagccctgctgccctgggccaggacctgctggagcccaggagcaagaggcctgcccaccccatcctggccacagcagatggagccagccagctggtgggcatggagtag

SEQ ID NO: 167233 - DNA, 5064 bp, Artificial Sequence
  Description of Artificial Sequence: Synthetic coding sequence
atgaccagcagcagccctgctggcctggagggcagtgacctgagcagcatcaacaccatgatgtctgctgtgatgtctgtgggcaaggtgacagaaaatggaggcagcccccagggcatcaagagccccagcaagcccccaggccccaaccgcatcggcagaagaaaccaggagaccaaggaggagaagagcagctacaactgccccctgtgtgagaagatctgcaccacccagcaccagctgaccatgcacatccggcagcacaacacagacaccggcggcgctgaccacagctgcagcatctgtgggaagagcctgagcagcgccagcagcctggacagacacatgctggtgcacagcggggagcggccctacaagtgcaccgtgtgtggccagagcttcaccaccaatggaaacatgcaccgccacatgaagatccacgagaaggaccccaacagcgccacagccacagccccacccagccccctgaagagaagaaggctgagcagcaagaggaagctgagccatgatgctgagagcgagagagaagatcctgccccagccaagaagatggtggaggatggccagagcggggacctggagaagaaggcagatgaggtgttccactgccctgtgtgcttcaaggagtttgtgtgcaagtatggcctggagacccacatggagacccacagcgacaaccccctgcgctgtgacatctgctgcgtgaccttccgcacccaccggggcctgctgcggcacaatgccctggtgcacaagcagctgcccagagatgccatgggccggcccttcatccagaacaaccccagcatcccagctggcttccatgacctgggcttcacagacttcagctgcaggaagttcccccgcatcagccaggcctggtgtgagaccaacctgcggcgctgcatcagcgagcagcacagatttgtgtgtgacacctgtgacaaggccttccccatgctgtgcagcctggccctgcacaagcagacccacgtggccgctgaccagggccaggagaagccccaggccacccccctgcctggagatgccctggaccagaagggcttcctggccctgctgggcctgcagcacaccaaggatgtgcggcctgccccagctgaggagcccctgcctgatgacaaccaggccatccagctgcagaccctgaagtgccagctgccccaggaccccggctgcaccaacctgctgagcctgagcccctttgaagctgccagcctgggcggcagcctgactgtgctgcctgccaccaaggacagcatcaagcacctgagcctgcagcccttccagaagggcttcatcatccagcctgacagcagcatcgtggtgaagcccatcagcggggagagcgccatcgagctggccgacatccagcagatcctgaagatggccgccagcgccccaccccagatcagcctgccccccttcagcaaggccccagctgcccccctgcaggccatcttcaagcacatgccacccctgaagcccaagcccctggtgacccccaggacagtggtggccaccagcaccccacctcctctcatcaatgcccagcaggccagccctggctgcatcagccccagcctgcccccaccacccctgaagctgctgaagggctctgtggaggccgccagcaatgcccacctgctgcagagcaagagcggcacccagccccatgctgccacccggctgagcctgcagcagcccagggctgagctgcccggccagcctgagatgaagacccagctggagcaggacagcatcatcgaggccctgctgcccctgtccatggaggccaagatcaagcaggagatcacagaaggagagctgaaggccttcatgacagcccctgggggcaagaagaccccagccatgaggaaggtgctgtacccctgccgcttctgcaaccaggtgtttgccttctctggagtgctgcgggcccacgtgcgcagccacctgggcatcagcccctaccagtgcaacatctgtgactacatcgctgctgacaaggccgccctgatccgccacctgcggacccacagcggggagcggccctacatctgcaagatctgccactaccccttcaccgtgaaggccaactgtgagcggcacctgaggaagaagcacctgaaggccaccaggaaggacatcgagaagaacatcgagtatgtgagcagcagcgctgctgagctggtggatgccttctgtgccccagacacagtgtgccgcctgtgtggggaggacctgaagcactaccgggccctgcgcatccacatgaggacccactgcggccggggcctgggcggcggccacaagggcaggaagccctttgagtgcaaggagtgcagcgctgcctttgctgccaagaggaactgcatccaccacatcctgaagcagcacctgcacgtgcctgagcaggacatcgagagctatgtgctggccgcagatggcctgggccctgctgaggccccagctgctgaggccagcggccgcggggaggacagcggctgtgccgccctgggggactgcaagcccctgacagccttcctggagccccagaatggcttcctgcaccggggccccacccagcccccacctcctcatgtgtccatcaagctggagcccgccagcagctttgctgtggacttcaatgagcccctggacttcagccagaagggcctggccctggtgcaggtgaagcaggagaacatctccttcctgagccccagcagcctggtgccctatgactgcagcatggagcccatcgacctgagcatccccaagaacttcagaaaaggagacaaggacctggccacccccagcgaggccaagaagccagaggaggaggccggcagcagcgagcagcccagcccctgcccagcccctggccccagcctgcctgtgaccctgggccccagcggcatcctggagagccccatggccccagccccagctgccaccccagagcccccagcccagcccctgcagggccctgtgcagctggccgtgcccatctacagcagcgccctggtgagcagcccccccctggtgggcagcagcgccctgctgtctggaacagccctgctgcggcccctgcggcccaagccacccctgctgctgcccaagccccctgtgacagaggagctgccccccctggccagcatcgcccagatcatcagctctgtgtcctctgcccccaccctgctgaagaccaaggtggccgaccccggccctgccagcacaggcagcaacaccacagccagtgacagcctgggcggctctgtgcccaaggccgccaccacagccaccccagctgccaccaccagccccaaggagagcagcgagcccccagccccagccagcagccctgaggccgccagccccacagagcagggccctgctggcaccagcaagaagaggggcaggaagaggggcatgaggagccggccccgggccaacagcggaggagtggacctggacagcagtggagaatttgccagcattgagaagatgctggccaccacagacaccaacaagttcagccccttcctgcagacagctgaggacaacacccaggatgaggtggccggggccccagctgaccaccacggccccagtgatgaggagcagggcagccccccagaggacaagctgctgcgggccaagaggaacagctacaccaactgcctgcagaagatcacctgcccccactgccccagggtcttcccctgggccagcagcctgcagaggcacatgctgacccacacagacagccagagtgatgctgagacagctgctgctgctggggaggtgctggacctgaccagccgggaccgggagcagcccagcgagggcgccacagagctgcggcaggtggccggagatgcccctgtggagcaggccacagctgagacagccagccctgtgcaccgggaggagcacggccgcggggagagccatgagcctgaggaggagcacggcacagaggagagcactggagatgctgatggagcagaagaagatgccagcagcaaccagagcctggacctggactttgccaccaagctgatggacttcaagctggccgagggagatggagaggccggggccggcggggccgccagccaggagcagaagctggcctgtgacacctgtgggaagagcttcaagttcctgggcaccctgagccgccacaggaaggcccacggccggcaggagcccaaggatgagaagggagatggagccagcacagctgaggagggcccccagcctgcccctgagcaggaggagaagcccccagagaccccagctgaggtggtggagagcgcccctggagctggggaggccccagctgagaagctggccgaggagacagagggccccagtgatggagagagcgctgctgagaagaggagcagcgagaagagtgatgatgacaagaagcccaagacagacagccccaagtctgtggccagcaaggctgacaagaggaagaaggtgtgcagcgtgtgcaacaagcgcttctggagcctgcaggacctgaccaggcacatgaggagccacactggagagcggccctacaagtgccagacctgtgagaggaccttcaccctgaagcacagcctggtgcgccaccagaggatccaccagaaggcccggcatgccaagcaccacggcaaggacagcgacaaggaggagcggggggaggaggacagtgaaaatgaaagcacccacagcggcaacaatgctgtgtctgaaaatgaggccgagctggccccaaatgccagcaaccacatggctgtgaccaggagcaggaaggagggcctggccagcgccaccaaggactgcagccaccgggaggagaaggtgacagctggctggcccagcgagcccggccagggcgacctgaaccctgagagccctgctgccctgggccaggacctgctggagcccaggagcaagaggcctgcccaccccatcctggccacagcagatggagccagccagctggtgggcatggagtag

SEQ ID NO: 167234 - DNA, 5064 bp, Artificial Sequence; identical to SEQ ID NO: 167233
  Description of Artificial Sequence: Synthetic coding sequence

SEQ ID NO: 167235 - DNA, 5229 bp, Artificial Sequence
  Description of Artificial Sequence: Synthetic coding sequence
atgaccagcagcagccctgctggcctggagggcagtgacctgagcagcatcaacaccatgatgtctgctgtgatgtctgtgggcaaggtgacagaaaatggaggcagcccccagggcatcaagagccccagcaagcccccaggccccaaccgcatcggcagaagaaaccaggagaccaaggaggagaagagcagctacaactgccccctgtgtgagaagatctgcaccacccagcaccagctgaccatgcacatccggcagcacaacacagacaccggcggcgctgaccacagctgcagcatctgtgggaagagcctgagcagcgccagcagcctggacagacacatgctggtgcacagcggggagcggccctacaagtgcaccgtgtgtggccagagcttcaccaccaatggaaacatgcaccgccacatgaagatccacgagaaggaccccaacagcgccacagccacagccccacccagccccctgaagagaagaaggctgagcagcaagaggaagctgagccatgatgctgagagcgagagagaagatcctgccccagccaagaagatggtggaggatggccagagcggggacctggagaagaaggcagatgaggtgttccactgccctgtgtgcttcaaggagtttgtgtgcaagtatggcctggagacccacatggagacccacagcgacaaccccctgcgctgtgacatctgctgcgtgaccttccgcacccaccggggcctgctgcggcacaatgccctggtgcacaagcagctgcccagagatgccatgggccggcccttcatccagaacaaccccagcatcccagctggcttccatgacctgggcttcacagacttcagctgcaggaagttcccccgcatcagccaggcctggtgtgagaccaacctgcggcgctgcatcagcgagcagcacagatttgtgtgtgacacctgtgacaaggccttccccatgctgtgcagcctggccctgcacaagcagacccacgtggccgctgaccagggccaggagaagccccaggccacccccctgcctggagatgccctggaccagaagggcttcctggccctgctgggcctgcagcacaccaaggatgtgcggcctgccccagctgaggagcccctgcctgatgacaaccaggccatccagctgcagaccctgaagtgccagctgccccaggaccccggctgcaccaacctgctgagcctgagcccctttgaagctgccagcctgggcggcagcctgactgtgctgcctgccaccaaggacagcatcaagcacctgagcctgcagcccttccagaagggcttcatcatccagcctgacagcagcatcgtggtgaagcccatcagcggggagagcgccatcgagctggccgacatccagcagatcctgaagatggccgccagcgccccaccccagatcagcctgccccccttcagcaaggccccagctgcccccctgcaggccatcttcaagcacatgccacccctgaagcccaagcccctggtgacccccaggacagtggtggccaccagcaccccacctcctctcatcaatgcccagcaggccagccctggctgcatcagccccagcctgcccccaccacccctgaagctgctgaagggctctgtggaggccgccagcaatgcccacctgctgcagagcaagagcggcacccagccccatgctgccacccggctgagcctgcagcagcccagggctgagctgcccggccagcctgagatgaagacccagctggagcaggacagcatcatcgaggccctgctgcccctgtccatggaggccaagatcaagcaggagatcacagaaggagagctgaaggccttcatgacagcccctgggggcaagaagaccccagccatgaggaaggtgctgtacccctgccgcttctgcaaccaggtgtttgccttctctggagtgctgcgggcccacgtgcgcagccacctgggcatcagcccctaccagtgcaacatctgtgactacatcgctgctgacaaggccgccctgatccgccacctgcggacccacagcggggagcggccctacatctgcaagatctgccactaccccttcaccgtgaaggccaactgtgagcggcacctgaggaagaagcacctgaaggccaccaggaaggacatcgagaagaacatcgagtatgtgagcagcagcgctgctgagctggtggatgccttctgtgccccagacacagtgtgccgcctgtgtggggaggacctgaagcactaccgggccctgcgcatccacatgaggacccactgcggccggggcctgggcggcggccacaagggcaggaagccctttgagtgcaaggagtgcagcgctgcctttgctgccaagaggaactgcatccaccacatcctgaagcagcacctgcacgtgcctgagcaggacatcgagagctatgtgctggccgcagatggcctgggccctgctgaggccccagctgctgaggccagcggccgcggggaggacagcggctgtgccgccctgggggactgcaagcccctgacagccttcctggagccccagaatggcttcctgcaccggggccccacccagcccccacctcctcatgtgtccatcaagctggagcccgccagcagctttgctgtggacttcaatgagcccctggacttcagccagaagggcctggccctggtgcaggtgaagcaggagaacatctccttcctgagccccagcagcctggtgccctatgactgcagcatggagcccatcgacctgagcatccccaagaacttcagaaaaggagacaaggacctggccacccccagcgaggccaagaagccagaggaggaggccggcagcagcgagcagcccagcccctgcccagcccctggccccagcctgcctgtgaccctgggccccagcggcatcctggagagccccatggccccagccccagctgccaccccagagcccccagcccagcccctgcagggccctgtgcagctggccgtgcccatctacagcagcgccctggtgagcagcccccccctggtgggcagcagcgccctgctgtctggaacagccctgctgcggcccctgcggcccaagccacccctgctgctgcccaagccccctgtgacagaggagctgccccccctggccagcatcgcccagatcatcagctctgtgtcctctgcccccaccctgctgaagaccaaggtggccgaccccggccctgccagcacaggcagcaacaccacagccagtgacagcctgggcggctctgtgcccaaggccgccaccacagccaccccagctgccaccaccagccccaaggagagcagcgagcccccagccccagccagcagccctgaggccgccagccccacagagcagggccctgctggcaccagcaagaagaggggcaggaagaggggcatgaggagccggccccgggccaacagcggaggagtggacctggacagcagtggagaatttgccagcattgagaagatgctggccaccacagacaccaacaagttcagccccttcctgcagacagctgaggacaacacccaggatgaggtggccggggccccagctgaccaccacggccccagtgatgaggagcagggcagccccccagaggacaagctgctgcgggccaagaggaacagctacaccaactgcctgcagaagatcacctgcccccactgccccagggtcttcccctgggccagcagcctgcagaggcacatgctgacccacacaggccagaagcccttcccctgccagaagtgtgatgccttcttcagcaccaagagcaactgtgagcggcaccagctgaggaagcatggagtgaccacctgcagcctgcggagaaatggcctcatcccccagagcaaggagagtgatgtgggcagccatgacagcacagacagccagagtgatgctgagacagctgctgctgctggggaggtgctggacctgaccagccgggaccgggagcagcccagcgagggcgccacagagctgcggcaggtggccggagatgcccctgtggagcaggccacagctgagacagccagccctgtgcaccgggaggagcacggccgcggggagagccatgagcctgaggaggagcacggcacagaggagagcactggagatgctgatggagctgaggaggatgccagcagcaaccagagcctggacctggactttgccaccaagctgatggacttcaagctggccgagggagatggagaggccggggccggcggggccgccagccaggagcagaagctggcctgtgacacctgtgggaagagcttcaagttcctgggcaccctgagccgccacaggaaggcccacggccggcaggagcccaaggatgagaagggagatggagccagcacagctgaggagggcccccagcctgcccctgagcaggaggagaagcccccagagaccccagctgaggtggtggagagcgcccctggggccggggaggccccagctgagaagctggccgaggagacagagggccccagtgatggagagagcgctgctgagaagaggagcagcgagaagagtgatgatgacaagaagcccaagacagacagccccaagtctgtggccagcaaggctgacaagaggaagaaggtgtgcagcgtgtgcaacaagcgcttctggagcctgcaggacctgaccaggcacatgaggagccacactggagagcggccctacaagtgccagacctgtgagaggaccttcaccctgaagcacagcctggtgcgccaccagaggatccaccagaaggcccggcatgccaagcaccacggcaaggacagcgacaaggaggagcggggggaggaggacagtgaaaatgaaagcacccacagcggcaacaatgctgtgtctgaaaatgaagctgagctggccccaaatgccagcaaccacatggctgtgaccaggagcaggaaggagggcctggccagcgccaccaaggactgcagccaccgggaggagaaggtgacagctggctggcccagcgagcccggccagggcgacctgaaccctgagagccctgctgccctgggccaggacctgctggagcccaggagcaagaggcctgcccaccccatcctggccacagcagatggagccagccagctggtgggcatggagtag

SEQ ID NO: 167236 - DNA, 15 bp, Artificial Sequence
  Description of Artificial Sequence: Synthetic coding sequence
atgaccagcagctag

SEQ ID NO: 167237 - DNA, 495 bp, Artificial Sequence
  Description of Artificial Sequence: Synthetic coding sequence
atgaccagcagcagccctgctggcctggagggcagtgacctgagcagcatcaacaccatgatgtctgctgtgatgtctgtgggcaaggtgacagaaaatggaggcagcccccagggcatcaagagccccagcaagcccccaggccccaaccgcatcggcagaagaaaccaggagaccaaggaggagaagagcagctacaactgccccctgtgtgagaagatctgcaccacccagcaccagctgaccatgcacatccggcagcacaacacagacaccggcggcgctgaccacagctgcagcatctgtgggaagagcctgagcagcgccagcagcctggacagacacatgctggtgcacagcggggagcggccctacaagtgcaccgtgtgtggccagagcttcaccaccaatggaaacatgcaccgccacatgaagatccacgagaaggaccccaacagcgccacagccacagccccacccagccccctgaagtag

SEQ ID NO: 167238 - DNA, 2337 bp, Artificial Sequence
  Description of Artificial Sequence: Synthetic coding sequence
atgaccagcagcagccctgctggcctggagggcagtgacctgagcagcatcaacaccatgatgtctgctgtgatgtctgtgggcaaggtgacagaaaatggaggcagcccccagggcatcaagagccccagcaagcccccaggccccaaccgcatcggcagaagaaaccaggagaccaaggaggagaagagcagctacaactgccccctgtgtgagaagatctgcaccacccagcaccagctgaccatgcacatccggcagcacaacacagacaccggcggcgctgaccacagctgcagcatctgtgggaagagcctgagcagcgccagcagcctggacagacacatgctggtgcacagcggggagcggccctacaagtgcaccgtgtgtggccagagcttcaccaccaatggaaacatgcaccgccacatgaagatccacgagaaggaccccaacagcgccacagccacagccccacccagccccctgaagagaagaaggctgagcagcaagaggaagctgagccatgatgctgagagcgagagagaagatcctgccccagccaagaagatggtggaggatggccagagcggggacctggagaagaaggcagatgaggtgttccactgccctgtgtgcttcaaggagtttgtgtgcaagtatggcctggagacccacatggagacccacagcgacaaccccctgcgctgtgacatctgctgcgtgaccttccgcacccaccggggcctgctgcggcacaatgccctggtgcacaagcagctgcccagagatgccatgggccggcccttcatccagaacaaccccagcatcccagctggcttccatgacctgggcttcacagacttcagctgcaggaagttcccccgcatcagccaggcctggtgtgagaccaacctgcggcgctgcatcagcgagcagcacagatttgtgtgtgacacctgtgacaaggccttccccatgctgtgcagcctggccctgcacaagcagacccacgtggccgctgaccagggccaggagaagccccaggccacccccctgcctggagatgccctggaccagaagggcttcctggccctgctgggcctgcagcacaccaaggatgtgcggcctgccccagctgaggagcccctgcctgatgacaaccaggccatccagctgcagaccctgaagtgccagctgccccaggaccccggctgcaccaacctgctgagcctgagcccctttgaagctgccagcctgggcggcagcctgactgtgctgcctgccaccaaggacagcatcaagcacctgagcctgcagcccttccagaagggcttcatcatccagcctgacagcagcatcgtggtgaagcccatcagcggggagagcgccatcgagctggccgacatccagcagatcctgaagatggccgccagcgccccaccccagatcagcctgccccccttcagcaaggccccagctgcccccctgcaggccatcttcaagcacatgccacccctgaagcccaagcccctggtgacccccaggacagtggtggccaccagcaccccacctcctctcatcaatgcccagcaggccagccctggctgcatcagccccagcctgcccccaccacccctgaagctgctgaagggctctgtggaggccgccagcaatgcccacctgctgcagagcaagagcggcacccagccccatgctgccacccggctgagcctgcagcagcccagggctgagctgcccggccagcctgagatgaagacccagctggagcaggacagcatcatcgaggccctgctgcccctgtccatggaggccaagatcaagcaggagatcacagaaggagagctgaaggccttcatgacagcccctgggggcaagaagaccccagccatgaggaaggtgctgtacccctgccgcttctgcaaccaggtgtttgccttctctggagtgctgcgggcccacgtgcgcagccacctgggcatcagcccctaccagtgcaacatctgtgactacatcgctgctgacaaggccgccctgatccgccacctgcggacccacagcggggagcggccctacatctgcaagatctgccactaccccttcaccgtgaaggccaactgtgagcggcacctgaggaagaagcacctgaaggccaccaggaaggacatcgagaagaacatcgagtatgtgagcagcagcgctgctgagctggtggatgccttctgtgccccagacacagtgtgccgcctgtgtggggaggacctgaagcactaccgggccctgcgcatccacatgaggacccactgcggccgctag

SEQ ID NO: 167239 - DNA, 411 bp, Artificial Sequence
  Description of Artificial Sequence: Synthetic coding sequence
atgaccagcagcagccctgctggcctggagggcagtgacctgagcagcatcaacaccatgatgtctgctgtgatgtctgtgggcaaggtgacagaaaatggaggcagcccccagggcatcaagagccccagcaagcccccaggccccaaccgcatcggcagaagaaaccaggagaccaaggaggagaagagcagctacaactgccccctgtgtgagaagatctgcaccacccagcaccagctgaccatgcacatccggcagcacaacacagacaccggcggcgctgaccacagctgcagcatctgtgggaagagcctgagcagcgccagcagcctggacagacacatgctggtgcacagcggggagcggccctacaagtgcaccgtgtgtggccagagcttcaccacctag

SEQ ID NO: 167240 - DNA, 189 bp, Artificial Sequence
  Description of Artificial Sequence: Synthetic coding sequence
atgaccagcagcagccctgctggcctggagggcagtgacctgagcagcatcaacaccatgatgtctgctgtgatgtctgtgggcaaggtgacagaaaatggaggcagcccccagggcatcaagagccccagcaagcccccaggccccaaccgcatcggcagaagaaaccaggtgtctgtgcacacctag

SEQ ID NO: 167241 - DNA, 834 bp, Artificial Sequence
  Description of Artificial Sequence: Synthetic coding sequence
atgagcaagagcctgaagaagctggtggaggagagccgggagaagaaccagcctgaggtggacatgtctgaccggggcatcagcaacatgctggatgtgaatggcctcttcaccctgagccacatcacccagctggtgctgagccacaacaagctgaccatggtgccccccaacattgctgagctgaagaacctggaggtgctgaacttcttcaacaaccagatcgaggagctgcccacccagatcagcagcctgcagaagctgaagcacctgaacctgggcatgaaccggctgaacaccctgccccggggcttcggcagcctgcctgccctggaggtgctggacctgacctacaacaacctgtctgagaacagcctgcccggcaacttcttctacctgaccaccctgcgggccctgtacctgagtgacaatgactttgagatcctgcccccagacatcggcaagctgaccaagctgcagatcctgagcctgcgggacaatgacctgatcagcctgcccaaggagatcggggagctgacccagctgaaggagctgcacatccagggcaaccggctgactgtgctgcccccagagctgggcaacctggacctgaccggccagaagcaggtgttcaaggccgagaacaacccctgggtgacccccatcgctgaccagttccagctgggcgtgagccacgtgtttgagtacatccgctctgagacctacaagtacctgtatggccgccacatgcaggccaaccctgagccccccaagaagaacaatgacaagagcaagaagatcagcaggaagcccctggccgccaagaacagatag

SEQ ID NO: 167242 - DNA, 675 bp, Artificial Sequence
  Description of Artificial Sequence: Synthetic coding sequence
atggtgccccccaacattgctgagctgaagaacctggaggtgctgaacttcttcaacaaccagatcgaggagctgcccacccagatcagcagcctgcagaagctgaagcacctgaacctgggcatgaaccggctgaacaccctgccccggggcttcggcagcctgcctgccctggaggtgctggacctgacctacaacaacctgtctgagaacagcctgcccggcaacttcttctacctgaccaccctgcgggccctgtacctgagtgacaatgactttgagatcctgcccccagacatcggcaagctgaccaagctgcagatcctgagcctgcgggacaatgacctgatcagcctgcccaaggagattggagagctgacccagctgaaggagctgcacatccagggcaaccggctgactgtgctgcccccagagctgggcaacctggacctgaccggccagaagcaggtgttcaaggccgagaacaacccctgggtgacccccatcgctgaccagttccagctgggcgtgagccacgtgtttgagtacatccgctctgagacctacaagtacctgtatggccgccacatgcaggccaaccctgagccccccaagaagaacaatgacaagagcaagaagatcagcaggaagcccctggccgccaagaacagatag

SEQ ID NO: 167243 - DNA, 834 bp, Artificial Sequence; identical to SEQ ID NO: 167241
  Description of Artificial Sequence: Synthetic coding sequence

SEQ ID NO: 167244 - DNA, 945 bp, Artificial Sequence
  Description of Artificial Sequence: Synthetic coding sequence
atggccgccacagccagcgctggagctgggggcattgatggcaagcccaggaccagccccaagtctgtgaagttcctgtttggaggcctggccggcatgggcgccaccgtgtttgtgcagcccctggacctggtgaagaacaggatgcagctgagcggggagggcgccaagacccgggagtacaagaccagcttccacgccctgaccagcatcctgaaggccgagggcctgcggggcatctacacaggcctgtctgctggcctgctgcggcaggccacctacaccaccacccggctgggcatctacacagtgctgtttgagcggctgaccggggctgatggcaccccacctggcttcctgctgaaggctgtgattggcatgacagctggggccaccggggcctttgtgggcaccccagctgaggtggccctgatccgcatgacagcagatggccgcctgcctgctgaccagaggcggggctacaagaatgtgttcaatgccctgatccgcatcacccgggaggagggcgtgctgaccctgtggaggggctgcatccccaccatggcccgggctgtggtggtgaatgctgcccagctggccagctacagccagagcaagcagttcctgctggacagcggctacttcagtgacaacatcctgtgccacttctgtgcctccatgatcagcggcctggtgaccacagctgcctccatgcctgtggacatcgccaagacccgcatccagaacatgaggatgattgatggcaagccagagtacaagaatggcctggatgtgctcttcaaggtggtgcgctatgagggcttcttcagcctgtggaagggcttcaccccctactatgcccggctgggcccccacacagtgctgaccttcatcttcctggagcagatgaacaaggcctacaagaggctcttcctgtctggatag

SEQ ID NO: 167245 - DNA, 1530 bp, Artificial Sequence; identical to SEQ ID NO: 144100
  Description of Artificial Sequence: Synthetic coding sequence

SEQ ID NO: 167246 - DNA, 600 bp, Artificial Sequence
  Description of Artificial Sequence: Synthetic coding sequence
atggccaagtctgctgaggtgaagctggccatcttcggccgggccggcgtgggcaagagcgccctggtggtgcgcttcctgaccaagcgcttcatctgggagtatgaccccaccctggagagcacctaccgccaccaggccaccattgatgatgaggtggtgtccatggagatcctggacacagctggccaggaggacaccatccagcgggagggccacatgcgctggggcgagggctttgtgctggtgtatgacatcacagaccggggcagctttgaggaggtgctgcccctgaagaacatcctggatgagatcaagaagcccaagaatgtgaccctcatcctggtgggcaacaaggctgacctggaccacagccggcaggtgtccacagaggagggggagaagctggccacagagctggcctgtgccttctatgagtgcagcgcctgcacaggagagggcaacatcacagagatcttctatgagctgtgccgggaggtgagaagaagaaggatggtgcagggcaagaccaggagaagaagcagcaccacccacgtgaagcaggccatcaacaagatgctgaccaagatcagcagctag

SEQ ID NO: 167247 - DNA, 120 bp, Artificial Sequence
  Description of Artificial Sequence: Synthetic coding sequence
atggccaagtctgctgaggtgaagctggccatcttcggccgggccggcgtgggcaagagcgccctggtggtgcgcttcctgaccaagcgcttcatctgggagtatgaccccaccctgtag

SEQ ID NO: 167248 - DNA, 600 bp, Artificial Sequence; identical to SEQ ID NO: 167246
  Description of Artificial Sequence: Synthetic coding sequence

SEQ ID NO: 167249 - DNA, 600 bp, Artificial Sequence; identical to SEQ ID NO: 167246
  Description of Artificial Sequence: Synthetic coding sequence

SEQ ID NO: 167250 - DNA, 543 bp, Artificial Sequence
  Description of Artificial Sequence: Synthetic coding sequence
atggccaagtctgctgaggtgaagctggccatcttcggccgggccggcgtgggcaagtctgagagcacctaccgccaccaggccaccattgatgatgaggtggtgtccatggagatcctggacacagctggccaggaggacaccatccagcgggagggccacatgcgctggggcgagggctttgtgctggtgtatgacatcacagaccggggcagctttgaggaggtgctgcccctgaagaacatcctggatgagatcaagaagcccaagaatgtgaccctcatcctggtgggcaacaaggctgacctggaccacagccggcaggtgtccacagaggagggggagaagctggccacagagctggcctgtgccttctatgaatgttctgcctgcaccggggagggcaacatcacagagatcttctatgagctgtgccgggaggtgagaagaagaaggatggtgcagggcaagacccggcggcgcagcagcaccacccacgtgaagcaggccatcaacaagatgctgaccaagatcagcagctag

SEQ ID NO: 167251 - DNA, 612 bp, Artificial Sequence
  Description of Artificial Sequence: Synthetic coding sequence
atggtgtccacctacagagtggccgtgctgggcgcccggggcgtgggcaagagcgccatcgtgcggcagttcctgtacaatgagttcagcgaggtgtgtgtgcccaccacagcccggcggctgtacctgcctgctgtggtgatgaatggacatgtgcatgacctgcagatcctggacttcccccccatcagcgccttccctgtgaacaccctgcaggagtgggccgacacctgctgccggggcctgcggtctgtgcacgcctacatcctggtgtatgacatctgctgctttgacagctttgaatatgtgaagaccatccggcagcagatcctggagaccagggtcatcggcaccagcgagacccccatcatcatcgtgggcaacaagagggacctgcagaggggccgggtcatcccccgctggaatgtgagccacctggtgaggaagacctggaagtgtggctacgtggagtgcagcgccaagtacaactggcacatcctgctgctcttcagcgagctgctgaagtctgtgggctgtgcccgctgcaagcacgtgcatgctgccctgcgcttccagggcgccctgcggaggaacagatgtgccatcatgtag

SEQ ID NO: 167252 - DNA, 729 bp, Artificial Sequence
  Description of Artificial Sequence: Synthetic coding sequence
atgaggcccctgtccatgagcggccacttcctgctggcccccatccctgagagcagcagtgactacctgctgcccaaggacatcaagctggccgtgctgggcgccggccgggtgggcaagagcgccatgattgtgcgcttcctgaccaagcgcttcatcggggactatgagcccaacacaggcaagctgtacagccggctggtgtatgtggagggggaccagctgagcctgcagatccaggacaccccaggaggagtgcagatccaggacagcctgccccaggtggtggacagcctgagcaaatgtgtgcagtgggccgagggcttcctgctggtgtacagcatcacagattatgacagctacctgagcatccggcccctgtaccagcacatcaggaaggtgcacccagacagcaaggcccctgtgatcatcgtgggcaacaagggggacctgctgcacgcccggcaggtgcagacccaggacggcatccagctggccaatgagctgggcagcctcttcctggagatcagcaccagcgagaactatgaagatgtgtgtgatgtgttccagcacctgtgcaaggaggtgtccaagatgcacggcctgtctggagagaggagaagagccagcatcatcccccggcccaggagccccaacatgcaggacctgaagaggcgcttcaagcaggccctgagccccaaggtgaaggcccccagcgccctgggctag

SEQ ID NO: 167253 - DNA, 747 bp, Artificial Sequence
  Description of Artificial Sequence: Synthetic coding sequence
atgaggctcatccagaacatgtgcaccatcgccgagtacccagcccctggaaatgctgctgccagtgactgctgcgtgggcgctgctggaagaaggctggtgaagattgctgtggtgggcgccagcggcgtgggcaagacagccctggtggtgcgcttcctgaccaagcgcttcatcggggactatgaaagaaatgccggcaacctgtacacccggcaggtgcagatcgagggggagaccctggccctgcaggtgcaggacaccccaggcatccaggtgcatgagaacagcctgagctgcagcgagcagctgaaccgctgcatccgctgggcagatgctgtggtgattgtgttcagcatcacagactacaagagctatgagctgatcagccagctgcaccagcacgtgcagcagctgcacctgggcacccggctgcctgtggtggtggtggccaacaaggctgacctgctgcacatcaagcaggtggacccccagctgggcctgcagctggcctccatgctgggctgcagcttctatgaggtgtctgtgtctgagaactacaatgatgtgtacagcgccttccacgtgctgtgcaaggaggtgagccacaagcagcagcccagcagcaccccagagaagaggaggaccagcctcatcccccggcccaagagccccaacatgcaggacctgaagaggcgcttcaagcaggccctgagcgccaaggtgaggacagtgacctctgtgtag

SEQ ID NO: 167254 - DNA, 927 bp, Artificial Sequence
  Description of Artificial Sequence: Synthetic coding sequence
atgaccctgaatggaggcggcagcggggccggcggcagcagaggaggcggccaggagcgggagaggagaagaggcagcaccccctggggccctgccccacccctgcacagaagatccatgcctgtggatgagcgggacctgcaggccgccctgacccctggggccctgacagctgctgctgctggcaccggcacccagggcccccggctggactggccagaggacagcgaggacagcctgagcagcggcggcagtgacagtgatgagagcgtgtacaaggtgctgctgctgggcgcccctggggtgggcaagagcgccctggcccgcatctttggaggagtggaggatggccctgaggccgaggccgccggccacacctatgacaggagcatcgtggtggatggagaggaggccagcctgatggtgtatgacatctgggagcaggacggcggccgctggctgcccggccactgcatggccatgggagatgcctacgtgattgtgtacagcgtgacagacaagggcagctttgagaaggccagcgagctgcgggtgcagctgcggcgggcccggcagacagatgatgtgcccatcatcctggtgggcaacaagagtgacctggtgcgcagccgggaggtgtctgtggatgagggccgggcctgtgctgtggtgtttgactgcaagttcatcgagaccagcgctgccctgcaccacaacgtgcaggccctgtttgagggcgtggtgcggcagatccggctgcggcgggacagcaaggaggccaatgcccggcggcaggccggcacccggcggcgggagagcctgggcaagaaggccaagcgcttcctgggcagaattgtggccaggaacagcaggaagatggccttccgggccaagagcaagagctgccacgacctgtctgtgctgtag

SEQ ID NO: 167255 - DNA, 927 bp, Artificial Sequence; identical to SEQ ID NO: 167254
  Description of Artificial Sequence: Synthetic coding sequence

SEQ ID NO: 167256 - DNA, 579 bp, Artificial Sequence
  Description of Artificial Sequence: Synthetic coding sequence
atgcaggccatcaagtgtgtggtggtgggagatggagctgtgggcaagacctgcctgctgatctcctacaccaccaatgccttccctggagagtacatccccaccgtgtttgacaactacagcgccaacgtgatggtggatggcaagcctgtgaacctgggcctgtgggacacagctggccaggaggactatgaccggctgcggcccctgagctacccccagacagatgtgttcctgatctgcttcagcctggtgtccccagccagctttgaaaatgtgcgggccaagtggtacccagaggtgcgccaccactgcccccacacccccatcctgctggtgggcaccaagctggacctgagagatgacaaggacaccatcgagcggctgcgggacaagaagctggcccccatcacctacccccagggcctggccatggcccgggagatcggctctgtgaagtacctggagtgcagcgccctgacccagaggggcctgaagacagtgtttgatgaggccatccgggctgtgctgtgccccccacctgtgaagaagccaggcaagaagtgcaccgtcttctag

SEQ ID NO: 167257 - DNA, 942 bp, Artificial Sequence
  Description of Artificial Sequence: Synthetic coding sequence
atgcccaacacagccatgaagaagaaggtgctgctgatgggcaagagcggcagcggcaagacctccatgaggagcatcatctttgccaactacatcgcccgggacacccggcggctgggcgccaccattgatgtggagcacagccacgtgcgcttcctgggcaacctggtgctgaacctgtgggactgtggcggccaggacaccttcatggagaactacttcaccagccagagggacaacatcttcagaaatgtggaggtgctgatctacgtgtttgatgtggagagccgggagctggagaaggacatgcactactaccagagctgcctggaggccatcctgcagaacagcccagatgccaagatcttctgcctggtgcacaagatggacctggtgcaggaggaccagagggacctgatcttcaaggagcgggaggaggacctgcggcggctgagccggcccctggagtgtgcctgcttccgcaccagcatctgggatgagaccctgtacaaggcctggagcagcatcgtgtaccagctgatccccaacgtgcagcagctggagatgaacctgaggaactttgcccagatcatcgaggctgatgaggtgctgctgtttgagcgggccaccttcctggtgatcagccactaccagtgcaaggagcagagagatgtgcacagatttgagaagatcagcaacatcatcaagcagttcaagctgagctgcagcaagctggccgccagcttccagagcatggaggtgaggaacagcaactttgctgccttcatcgacatcttcaccagcaacacctacgtgatggtggtgatgtctgaccccagcatccccagcgctgccaccctcatcaacatcagaaatgccaggaagcactttgagaagctggagcgggtggatggccccaagcacagcctgctgatgaggtag

SEQ ID NO: 167258 - DNA, 1125 bp, Artificial Sequence
  Description of Artificial Sequence: Synthetic coding sequence
atggaggagagtgacagcgagaagaccacagagaaggagaacctgggccccaggatggacccccccctgggggagcctgagggcagcctgggctgggtgctgcccaacacagccatgaagaagaaggtgctgctgatgggcaagagcggcagcggcaagacctccatgaggagcatcatctttgccaactacatcgcccgggacacccggcggctgggcgccaccatcctggaccgcatccacagcctgcagatcaacagcagcctgagcacctacagcctggtggacagcgtgggcaacaccaagacctttgatgtggagcacagccacgtgcgcttcctgggcaacctggtgctgaacctgtgggactgtggcggccaggacaccttcatggagaactacttcaccagccagagggacaacatcttcagaaatgtggaggtgctgatctacgtgtttgatgtggagagccgggagctggagaaggacatgcactactaccagagctgcctggaggccatcctgcagaacagcccagatgccaagatcttctgcctggtgcacaagatggacctggtgcaggaggaccagagggacctgatcttcaaggagcgggaggaggacctgcggcggctgagccggcccctggagtgcagctgcttccgcaccagcatctgggatgagaccctgtacaaggcctggagcagcatcgtgtaccagctgatccccaacgtgcagcagctggagatgaacctgaggaactttgctgagatcattgaagcagatgaggtgctgctgtttgagcgggccaccttcctggtgatcagccactaccagtgcaaggagcagagagatgcccacagatttgagaagatcagcaacatcatcaagcagttcaagctgagctgcagcaagctggccgccagcttccagagcatggaggtgaggaacagcaactttgctgccttcatcgacatcttcaccagcaacacctacgtgatggtggtgatgtctgaccccagcatccccagcgctgccaccctcatcaacatcagaaatgccaggaagcactttgagaagctggagcgggtggatggccccaagcagtgcctgctgatgaggtag

SEQ ID NO: 167259 - DNA, 1041 bp, Artificial Sequence
  Description of Artificial Sequence: Synthetic coding sequence
atggaggagagtgacagcgagaagaccacagagaaggagaacctgggccccaggatggacccccccctgggggagcctgagggcagcctgggctgggtgctgcccaacacagccatgaagaagaaggtgctgctgatgggcaagagcggcagcggcaagacctccatgaggagcatcatctttgccaactacatcgcccgggacacccggcggctgggcgccaccattgatgtggagcacagccacgtgcgcttcctgggcaacctggtgctgaacctgtgggactgtggcggccaggacaccttcatggagaactacttcaccagccagagggacaacatcttcagaaatgtggaggtgctgatctacgtgtttgatgtggagagccgggagctggagaaggacatgcactactaccagagctgcctggaggccatcctgcagaacagcccagatgccaagatcttctgcctggtgcacaagatggacctggtgcaggaggaccagagggacctgatcttcaaggagcgggaggaggacctgcggcggctgagccggcccctggagtgcagctgcttccgcaccagcatctgggatgagaccctgtacaaggcctggagcagcatcgtgtaccagctgatccccaacgtgcagcagctggagatgaacctgaggaactttgctgagatcattgaagcagatgaggtgctgctgtttgagcgggccaccttcctggtgatcagccactaccagtgcaaggagcagagagatgcccacagatttgagaagatcagcaacatcatcaagcagttcaagctgagctgcagcaagctggccgccagcttccagagcatggaggtgaggaacagcaactttgctgccttcatcgacatcttcaccagcaacacctacgtgatggtggtgatgtctgaccccagcatccccagcgctgccaccctcatcaacatcagaaatgccaggaagcactttgagaagctggagcgggtggatggccccaagcagtgcctgctgatgaggtag

SEQ ID NO: 167260 - DNA, 585 bp, Artificial Sequence
  Description of Artificial Sequence: Synthetic coding sequence
atgaagaagaaggtgctgctgatgggcaagagcggcagcggcaagacctccatgaggagcatcatctttgccaactacatcgcccgggacacccggcggctgggcgccaccattgatgtggagcacagccacgtgcgcttcctgggcaacctggtgctgaacctgtgggactgtggcggccaggacaccttcatggagaactacttcaccagccagagggacaacatcttcagaaatgtggaggtgctgatctacgtgtttgatgtggagagccgggagctggagaaggacatgcactactaccagagctgcctggaggccatcctgcagaacagcccagatgccaagatcttctgcctggtgcacaagatggacctggtgcaggaggaccagagggacctgatcttcaaggagcgggaggaggacctgcggcggctgagccggcccctggagtgcagctgcttccgcaccagcatctgggatgagaccctgtacaaggcctggagcagcatcgtgtaccagctgatccccaacgtgcagcagctggagatgaacctgaggaactttgctgagatcattgaatag

SEQ ID NO: 167261 - DNA, 1200 bp, Artificial Sequence
  Description of Artificial Sequence: Synthetic coding sequence
atgagcctgcagtatggagctgaggagacccccctggccggcagctatggagctgctgacagcttccccaaggactttggctacggcgtggaggaggaggaggaggaggccgctgctgctgggggcggcgtgggcgctggggccggcggcggctgcggccctgggggcgctgacagcagcaagccccgcatcctgctgatgggcctgcggcgcagcggcaagagcagcatccagaaggtggtgttccacaagatgagccccaatgagaccctcttcctggagagcaccaacaagatctacaaggatgacatcagcaacagcagctttgtgaacttccagatctgggacttccctggccagatggacttctttgaccccacctttgattatgagatgatcttccggggcactggagccctgatctacgtgattgatgcccaggatgactacatggaggccctgacccggctgcacatcaccgtgtccaaggcctacaaggtgaacccagacatgaactttgaggtgttcatccacaaggtggatggcctgagtgatgaccacaagattgagacccagagggacatccaccagagggccaatgatgacctggctgatgctggcctggagaagctgcacctgtccttctacctgaccagcatctatgaccacagcatctttgaggccttcagcaaggtggtgcagaagctgatcccccagctgcccaccctggagaacctgctgaacatcttcatcagcaacagcggcatcgagaaggccttcctgtttgatgtggtgtccaagatctacatcgccacagacagcagccctgtggacatgcagagctatgagctgtgctgtgacatgattgatgtggtgattgatgtgtcctgcatctacggcctgaaggaggatggcagcggcagcgcctatgacaaggagagcatggccatcatcaagctgaacaacaccaccgtgctgtacctgaaggaggtgaccaagttcctggccctggtgtgcatcctgcgggaggagagctttgagaggaagggcctgattgactacaacttccactgcttcaggaaggccatccacgaggtgtttgaggtgggcgtgaccagccacaggagctgtggccaccagaccagcgccagcagcctgaaggccctgacccacaacggcaccccaagaaatgccatctag

SEQ ID NO: 167262 - DNA, 750 bp, Artificial Sequence
  Description of Artificial Sequence: Synthetic coding sequence
atggaggccctggcccggctgcacctgactgtgacccgggcctacaaggtgaacacagacatcaactttgaggtgttcatccacaaggtggatggcctgagtgatgaccacaagattgagacccagagggacatccaccagagggccaatgatgacctggctgatgctggcctggagaagatccacctgtccttctacctgaccagcatctatgaccacagcatctttgaggccttcagcaaggtggtgcagaagctgatcccccagctgcccaccctggagaacctgctgaacatcttcatcagcaacagcggcatcgagaaggccttcctgtttgatgtggtgtccaagatctacatcgccacagacagcacccctgtggacatgcagacctatgagctgtgctgtgacatgattgatgtggtgattgacatcagctgcatctacggcctgaaggaggatggagctggcaccccctatgacaaggagagcacagccatcatcaagctgaacaacaccaccgtgctgtacctgaaggaggtgaccaagttcctggccctggtgtgctttgtgcgggaggagagctttgagaggaagggcctgattgactacaacttccactgcttcaggaaggccatccacgaggtgtttgaggtgaggatgaaggtggtgaagagcaggaaggtgcagaaccggctgcagaagaagaagagggccacccccaacggcaccccccgggtgctgctgtag

SEQ ID NO: 167263 - DNA, 1203 bp, Artificial Sequence
  Description of Artificial Sequence: Synthetic coding sequence
atgagccaggtgctgggcaagccccagccccaggatgaagatgatgctgaggaggaggaggaggaggatgagctggtgggcctggccgactatggagatggccctgacagcagtgatgctgaccctgacagcggcacagaggagggcgtgctggacttcagtgaccccttcagcacagaggtgaagccccgcatcctgctgatgggcctgcggcgcagcggcaagagcagcatccagaaggtggtgttccacaagatgagccccaatgagaccctcttcctggagagcaccaacaagatctgcagagaagatgtgagcaacagcagctttgtgaacttccagatctgggacttccctggccagattgacttctttgaccccacctttgattatgagatgatcttccggggcaccggggccctgatctttgtgattgacagccaggatgactacatggaggccctggcccggctgcacctgactgtgacccgggcctacaaggtgaacacagacatcaactttgaggtgttcatccacaaggtggatggcctgagtgatgaccacaagattgagacccagagggacatccaccagagggccaatgatgacctggctgatgctggcctggagaagatccacctgtccttctacctgaccagcatctatgaccacagcatctttgaggccttcagcaaggtggtgcagaagctgatcccccagctgcccaccctggagaacctgctgaacatcttcatcagcaacagcggcatcgagaaggccttcctgtttgatgtggtgtccaagatctacatcgccacagacagcacccctgtggacatgcagacctatgagctgtgctgtgacatgattgatgtggtgattgacatcagctgcatctacggcctgaaggaggatggagctggcaccccctatgacaaggagagcacagccatcatcaagctgaacaacaccaccgtgctgtacctgaaggaggtgaccaagttcctggccctggtgtgctttgtgcgggaggagagctttgagaggaagggcctgattgactacaacttccactgcttcaggaaggccatccacgaggtgtttgaggtgaggatgaaggtggtgaagagcaggaaggtgcagaaccggctgcagaagaagaagagggccaccccaaatggcaccccccgggtgctgctgtag

SEQ ID NO: 167264 - DNA, 348 bp, Artificial Sequence
  Description of Artificial Sequence: Synthetic coding sequence
atgctgcgggacaccatgaagtcctggaatgacagccagagcgacctgtgcagcacagaccaggaggaggaggaggagatgatctttggagaaaatgaagatgacctggatgagatgatggacctgagtgacctgcccaccagcctgtttgcctgcagcgtgcatgaagctgtgtttgaggcccgggagcagaaggagaggaacatgaacttcacccgggagcagagccgccacccagcctggtggttcatgtctgtgaaggtgaagctgaagaggaagaagaggcagaagacccccaacaggaagctgcccaggagaggagcccccaccctgcggccccagaggtag

SEQ ID NO: 167265 - DNA, 726 bp, Artificial Sequence
  Description of Artificial Sequence: Synthetic coding sequence
atgctgcgggacaccatgaagtcctggaatgacagccagagcgacctgtgcagcacagaccaggaggaggaggaggagatgatctttggagaaaatgaagatgacctggatgagatgatggacctgagtgacctgcccaccagcctgtttgcctgcagcgtgcatgaagctgtgtttgaggcccgggagcagaaggagagatttgaggccctcttcaccatctatgatgaccaggtgaccttccagctgttcaagagcttccggcgggtgcgcatcaacttcagcaagccagaggccgccgcccgggccagaattgagctgcacgagacagacttcaacggccagaagctgaagctgtactttgcccaggtgcagatgtctggagaggtgcgggacaagagctacctgctgcccccccagcctgtgaagcagttcctgatcagccccccagccagcccccctgtgggctggaagcagagtgaagatgccatgcctgtgatcaactatgacctgctgtgtgctgtgtccaagctgggccctggagagaagtatgagctgcacgccggcacagagagcaccccatctgtggtggtgcacgtgtgtgagagcgagacagaggaggaggaggagaccaagaaccccaagcagaagatcgcccagacccggcggccagaccccccaacagctgccctgaatgagccccagacctttgactgtgccctgtag

SEQ ID NO: 167266 - DNA, 522 bp, Artificial Sequence
  Description of Artificial Sequence: Synthetic coding sequence
atgctgcgggacaccatgaagtcctggaatgacagccagagcgacctgtgcagcacagaccaggaggaggaggaggagatgatctttggagaaaatgaagatgacctggatgagatgatggacctgagtgacctgcccaccagcctgtttgcctgcagcgtgcatgaagctgtgtttgaggcccgggagcagaaggagagatttgaggccctcttcaccatctatgatgaccaggtgaccttccagctgttcaagagcttccggcgggtgcgcatcaacttcagcaagccagaggccgccgcccgggccagaattgagctgcacgagacagacttcaacggccagaagctgaagctgtactttgcccaggagaggaacatgaacttcacccgggagcagagccgccacccagcctggtggttcatgtctgtgaaggtgaagctgaagaggaagaagaggcagaagacccccaacaggaagctgcccaggagaggagcccccaccctgcggccccagaggtag

SEQ ID NO: 167267 - DNA, 198 bp, Artificial Sequence
  Description of Artificial Sequence: Synthetic coding sequence
atgctgcgggacaccatgaagtcctggaatgacagccagagcgacctgtgcagcacagaccaggaggaggaggaggagatgatctttggagaaaatgaagatgacctggatgagatgatggacctgagtgacctgcccaccagcctgtttgcctgcagcgtgcatgaagctgtgtttgaggcccgggagcagaagtag

SEQ ID NO: 167268 - DNA, 696 bp, Artificial Sequence
  Description of Artificial Sequence: Synthetic coding sequence
atgctgcgggacaccatgaagtcctggaatgacagccagagcgacctgtgcagcacagaccaggaggaggaggaggagatgatctttggagaaaatgaagatgacctggatgagatgatggacctgagtgacctgcccaccagcctgtttgcctgcagcgtgcatgaagctgtgtttgaggcccgggagcagaaggagagatttgaggccctcttcaccatctatgatgaccaggtgaccttccagctgttcaagagcttccggcgggtgcgcatcaacttcagcaagccagaggccgccgcccgggccagaattgagctgcacgagacagacttcaacggccagaagctgaagctgtactttgcccagagctacctgctgcccccccagcctgtgaagcagttcctgatcagccccccagccagcccccctgtgggctggaagcagagtgaagatgccatgcctgtgatcaactatgacctgctgtgtgctgtgtccaagctgggccctggagagaagtatgagctgcacgccggcacagagagcaccccatctgtggtggtgcacgtgtgtgagagcgagacagaggaggaggaggagaccaagaaccccaagcagaagatcgcccagacccggcggccagaccccccaacagctgccctgaatgagccccagacctttgactgtgccctgtag

SEQ ID NO: 167269 - DNA, 552 bp, Artificial Sequence
  Description of Artificial Sequence: Synthetic coding sequence
atgctgcgggacaccatgaagtcctggaatgacagccagagcgacctgtgcagcacagaccaggaggaggaggaggagatgatctttggagaaaatgaagatgacctggatgagatgatggacctgagtgacctgcccaccagcctgtttgcctgcagcgtgcatgaagctgtgtttgaggcccgggagcagaaggtgcagatgtctggagaggtgcgggacaagagctacctgctgcccccccagcctgtgaagcagttcctgatcagccccccagccagcccccctgtgggctggaagcagagtgaagatgccatgcctgtgatcaactatgacctgctgtgtgctgtgtccaagctgggccctggagagaagtatgagctgcacgccggcacagagagcaccccatctgtggtggtgcacgtgtgtgagagcgagacagaggaggaggaggagaccaagaaccccaagcagaagatcgcccagacccggcggccagaccccccaacagctgccctgaatgagccccagacctttgactgtgccctgtag

SEQ ID NO: 167270 - DNA, 900 bp, Artificial Sequence
  Description of Artificial Sequence: Synthetic coding sequence
atgcacagcctggccacagctgcccctgtgcccaccaccctggcccaggtggaccgggagaagatctaccagtggatcaatgagctgagcagccctgagacccgggagaatgccctgctggagctgagcaagaagcgggagagcgtgcctgacctggcccccatgctgtggcacagctttggcaccatcgccgccctgctgcaggagatcgtgaacatctaccccagcatcaacccccccaccctgacagcccaccagagcaacagagtgtgcaatgccctggccctgctgcagtgtgtggccagccaccctgagaccaggtctgccttcctggccgcccacatccccctcttcctgtaccccttcctgcacacagtgtccaagacccggccctttgagtacctgcggctgaccagcctgggcgtgattggagccctggtgaagacagatgagcaggaggtgatcaacttcctgctgaccacagagatcatccccctgtgcctgcgcatcatggagagcggcagcgagctgagcaagacagtggccaccttcatcctgcagaagatcctgctggatgacaccggcctggcctacatctgccagacctatgagcgcttcagccacgtggccatgatcctgggcaagatggtgctgcagctgagcaaggagcccagcgcccggctgctgaagcacgtggtgcgctgctacctgcggctgagtgacaacccccgggcccgggaggccctgcggcagtgcctgcctgaccagctgaaggacaccacctttgcccaggtgctgaaggatgacaccaccaccaagcgctggctggcccagctggtgaagaacctgcaggagggccaggtgacagacccccggggcatccccctgcccccccagtag

SEQ ID NO: 167271 - DNA, 996 bp, Artificial Sequence
  Description of Artificial Sequence: Synthetic coding sequence
atgcacagcctggccacagctgcccctgtgcccaccaccctggcccaggtggaccgggagaagatctaccagtggatcaatgagctgagcagccctgagacccgggagaatgccctgctggagctgagcaagaagcgggagagcgtgcctgacctggcccccatgctgtggcacagctttggcaccatcgccgccctgctgcaggagatcgtgaacatctaccccagcatcaacccccccaccctgacagcccaccagagcaacagagtgtgcaatgccctggccctgctgcagtgtgtggccagccaccctgagaccaggtctgccttcctggccgcccacatccccctcttcctgtaccccttcctgcacacagtgtccaagacccggccctttgagtacctgcggctgaccagcctgggcgtgattgtggagaccggcttccaccacgtgggccaggccgacctggagctgcccaccagcagtgacctgcctgccagcgccagccagagcgctggcatcactggagccctggtgaagacagatgagcaggaggtgatcaacttcctgctgaccacagagatcatccccctgtgcctgcgcatcatggagagcggcagcgagctgagcaagacagtggccaccttcatcctgcagaagatcctgctggatgacaccggcctggcctacatctgccagacctatgagcgcttcagccacgtggccatgatcctgggcaagatggtgctgcagctgagcaaggagcccagcgcccggctgctgaagcacgtggtgcgctgctacctgcggctgagtgacaacccccgggcccgggaggccctgcggcagtgcctgcctgaccagctgaaggacaccacctttgcccaggtgctgaaggatgacaccaccaccaagcgctggctggcccagctggtgaagaacctgcaggagggccaggtgacagacccccggggcatccccctgcccccccagtag

SEQ ID NO: 167272 - DNA, 900 bp, Artificial Sequence; identical to SEQ ID NO: 167270
  Description of Artificial Sequence: Synthetic coding sequence

SEQ ID NO: 167273 - DNA, 777 bp, Artificial Sequence
  Description of Artificial Sequence: Synthetic coding sequence
atgcacagcctggccacagctgcccctgtgcccaccaccctggcccaggtggaccgggagaagatctaccagtggatcaatgagctgagcagccctgagacccgggagaatgccctgctggagctgagcaagaagcgggagagcgtgcctgacctggcccccatgctgtggcacagctttggcaccatcgccgccctgctgcaggagatcgtgaacatctaccccagcatcaacccccccaccctgacagcccaccagagcaacagagtgtgcaatgccctggccctgctgcagtgtgtggccagccaccctgagaccaggtctgccttcctggccgcccacatccccctcttcctgtaccccttcctgcacacagtgtccaagacccggccctttgagtacctgcggctgaccagcctgggcgtgattggagccctggtgaagacagatgagcaggaggtgatcaacttcctgctgaccacagagatcatccccctgtgcctgcgcatcatggagagcggcagcgagctgagcaagacagtggccaccttcatcctgcagaagatcctgctggatgacaccggcctggcctacatctgccagacctatgagcgcttcagccacgtggccatgatcctgggcaagatggtgctgcagctgagcaaggagcccagcgcccggctgctgaagcacgtggtgcgctgctacctgcggctgagtgacaacccccgcttcagtgacctgaccttctgctggagcagcttccagaggaagtag

SEQ ID NO: 167274 - DNA, 990 bp, Artificial Sequence
  Description of Artificial Sequence: Synthetic coding sequence
atggccgccctgggcggagatggcctgcggctgctgtctgtgtccaggcctgagcggcccccagagagcgctgccctgggcggcctgggccctggcctgtgctgctgggtgtctgtgttcagctgcctgagcctggcctgcagctatgtgggcagcctgtatgtgtggaagtctgagctgccccgggaccaccctgctgtgatcaagaggcgcttcacctctgtgctggtggtgagcagcctgagccccctgtgtgtgctgctgtggagggagctgaccggcatccagcccggcaccagcctgctgaccctgatgggcttccggctggagggcatcttccctgctgccctgctgcccctgctgctgaccatgatcctcttcctgggccccctgatgcagctgtccatggactgcccctgtgacctggctgatggcctgaaggtggtgctggcccccaggtcctgggcccgctgcctgacagacatgcgctggctgaggaaccaggtgattgcccccctgacagaggagctggtgttccgggcctgcatgctgcccatgctggccccctgcatgggcctgggccctgctgtgttcacctgccccctcttcttcggcgtggcccacttccaccacatcatcgagcagctgcgcttccggcagagctctgtgggcaacatcttcctgtctgctgccttccagttctcctacacagctgtgtttggagcctacacagccttcctgttcatcagaacaggccacctgattggccctgtgctgtgccacagcttctgcaactacatgggcttccctgctgtgtgtgccgccctggagcacccccagaggcggcccctgctggccggctacgccctgggcgtgggcctcttcctgctgctgctgcagcccctgacagaccccaagctgtatggcagcctgcccctgtgtgtgctgctggagcgggccggggacagcgaggcccccctgtgcagctag

SEQ ID NO: 167275 - DNA, 927 bp, Artificial Sequence
  Description of Artificial Sequence: Synthetic coding sequence
atggccgccctgggcggagatggcctgcggctgctgtctgtgtccaggcctgagcggcccccagagagcgctgccctgggcggcctgggccctggcctgtgctgctgggtgtctgtgttcagctgcctgagcctggcctgcagctatgtgggcagcctgtatgtgtggaagtctgagctgccccgggaccaccctgctgtgatcaagaggcgcttcacctctgtgctggtggtgagcagcctgagccccctgtgtgtgctgctgtggagggagctgaccggcatccagcccggcaccagcctgctgaccctgatgggcttccggctggagggcatcttccctgctgccctgctgcccctgctgctgaccatgatcctcttcctgggccccctgatgcagctgtccatggactgcccctgtgacctggctgatggcctgaaggtggtgctggcccccaggtcctgggcccgctgcctgacagacatgcgctggctgaggaaccaggtgattgcccccctgacagaggagctggtgttccgggcctgcatgctgcccatgctggccccctgcatgggcctgggccctgctgtgttcacctgccccctcttcttcggcgtggcccacttccaccacatcatcgagcagctgcgcttccggcagagctctgtgggcaacatcttcctgtctgctggccacctgattggccctgtgctgtgccacagcttctgcaactacatgggcttccctgctgtgtgtgccgccctggagcacccccagaggcggcccctgctggccggctacgccctgggcgtgggcctcttcctgctgctgctgcagcccctgacagaccccaagctgtatggcagcctgcccctgtgtgtgctgctggagagagctggggacagcgaggcccccctgtgcagctag

SEQ ID NO: 167276 - DNA, 1164 bp, Artificial Sequence
  Description of Artificial Sequence: Synthetic coding sequence
atggtgcccaagggggccaccatgctggtgatccccccaggcctgtctgaggaggaggaggccctgcagaagaagttcaacaagctgaagaagaagaagaaggccctgctggccctgaagaagcagagcagcagcagcaccaccagccagggcggcgtgaagaggagcctgtctgagcagcctgtgatggacacagccacagccacagagcaggccaagcagctggtgaagagcggggccatcagcgccatcaaggccgagaccaagaacagcggcttcaagaggagcaggaccctggagggcaagctgaaggaccctgagaagggccctgtgcccaccttccagcccttccagaggagcatctctgcagatgatgacctgcaggagagcagccggcggccccagaggaagagcctgtatgagagctttgtgagcagcagtgaccggctgcgggagctgggcccagatggagaggaggccgagggccctggagctggagatggccccccaagaagctttgactggggctatgaggagaggtctggggcccacagcagcgccagccccccaagaagccgcagccgggacaggagccatgaaagaaacagagaccgggaccgggaccgggagcgggaccgggaccgggaccgggaccgggaccgggagcgggaccgggaccgggaccgggaccgggaccgggaccgggagcgggaccgggaccgggagcgggaccgggaccgggaccgggagggccccttccgccgcagtgacagcttccctgagcggcgggcccccaggaaaggaaacaccctgtatgtgtatggagaggacatgacccccaccctgctgcggggggccttcagccccttcggcaacatcatcgacctgtccatggacccccccaggaactgtgcctttgtgacctatgagaagatggagagcgctgaccaggccgtggccgagctgaatggcacccaggtggagagcgtgcagctgaaggtgaacatcgccaggaagcagcccatgctggatgctgccaccgggaagtctgtgtggggcagcctggccgtgcagaacagccccaagggctgccaccgggacaagaggacccagatcgtgtacagtgatgatgtgtacaaggagaacctggtggatggcttctag

SEQ ID NO: 167277 - DNA, 1143 bp, Artificial Sequence
  Description of Artificial Sequence: Synthetic coding sequence
atgctggtgattcctcctggcctgtctgaggaggaggaggccctgcagaagaagttcaacaagctgaagaagaagaagaaggccctgctggccctgaagaagcagagcagcagcagcaccaccagccagggcggcgtgaagaggagcctgtctgagcagcctgtgatggacacagccacagccacagagcaggccaagcagctggtgaagagcggggccatcagcgccatcaaggccgagaccaagaacagcggcttcaagaggagcaggaccctggagggcaagctgaaggaccctgagaagggccctgtgcccaccttccagcccttccagaggagcatctctgcagatgatgacctgcaggagagcagcagaagaccccagaggaagagcctgtatgagagctttgtgagcagcagtgaccggctgcgggagctgggcccagatggagaggaggccgagggccctggagctggagatggcccccccaggagctttgactggggctatgaggagaggtctggggcccacagcagcgccagcccccccaggagccgcagccgggacaggagccatgagaggaacagagaccgggaccgggaccgggagcgggaccgggaccgggaccgggaccgggaccgggagcgggaccgggaccgggaccgggaccgggaccgggaccgggagcgggaccgggaccgggagcgggaccgggaccgggaccgggagggccccttcagaagaagtgacagcttccctgagcggcgggcccccaggaagggcaacaccctgtatgtgtatggagaggacatgacccccaccctgctgcggggggccttcagcccctttggaaacatcatcgacctgtccatggaccccccaagaaactgtgcctttgtgacctatgagaagatggagagcgctgaccaggccgtggccgagctgaatggcacccaggtggagagcgtgcagctgaaggtgaacatcgccaggaagcagcccatgctggatgctgccaccgggaagtctgtgtggggcagcctggccgtgcagaacagccccaagggctgccaccgggacaagaggacccagatcgtgtacagtgatgatgtgtacaaggagaacctggtggatggcttctag

SEQ ID NO: 167278 - DNA, 1143 bp, Artificial Sequence; identical to SEQ ID NO: 167277
  Description of Artificial Sequence: Synthetic coding sequence

SEQ ID NO: 167279 - DNA, 1143 bp, Artificial Sequence; identical to SEQ ID NO: 167277
  Description of Artificial Sequence: Synthetic coding sequence

SEQ ID NO: 167280 - DNA, 885 bp, Artificial Sequence
  Description of Artificial Sequence: Synthetic coding sequence
atgctggtgattcctcctggcctgtctgaggaggaggaggccctgcagaagaagttcaacaagctgaagaagaagaagaaggccctgctggccctgaagaagcagagcagcagcagcaccaccagccagggcggcgtgaagaggagcctgtctgagcagcctgtgatggacacagccacagccacagagcaggccaagcagctggtgaagagcggggccatcagcgccatcaaggccgagaccaagaacagcggcttcaagaggagcaggaccctggagggcaagctgaaggaccctgagaagggccctgtgcccaccttccagcccttccagaggagcatctctgcagatgatgacctgcaggagagcagcagaagaccccagaggaagagcctgtatgagagctttgtgagcagcagtgaccggctgcgggagctgggcccagatggagaggaggccgagggccctggagctggagatggcccccccaggagctttgactggggctatgaggagaggtctggggcccacagcagcgccagcccccccaggagccgcagccgggacaggagccatgagaggaacagagaccgggaccgggaccgggagcgggaccgggaccgggaccgggaccgggaccgggagcgggaccgggaccgggaccgggaccgggaccgggaccgggagcgggaccgggaccgggagcgggaccgggaccgggaccgggagggccccttcagaagaagtgacagcttccctgagcggcgggcccccaggaagggcaacaccctgtatgtgtatggagaggacatgacccccaccctgctgcggggggccttcagcccctttggaaacatcatcgacctgtccatggaccccccatag

SEQ ID NO: 167281 - DNA, 480 bp, Artificial Sequence
  Description of Artificial Sequence: Synthetic coding sequence
atgctggtgattcctcctggcctgtctgaggaggaggaggccctgcagaagaagttcaacaagctgaagaagaagaagaaggccctgctggccctgaagaagcagagcagcagcagcaccaccagccagggcggcgtgaagaggagcctgtctgagcagcctgtgatggacacagccacagccacagagcaggccaagcagctggtgaagagcggggccatcagcgccatcaaggccgagaccaagaacagcggcttcaagaggagcaggaccctggagggcaagctgaaggaccctgagaagggccctgtgcccaccttccagcccttccagaggagcatctctgcagatgatgacctgcaggagagcagcagaagaccccagaggaagagcctgtatgagagctttgtgagcagcagtgaccggctgcgggagctgggcccagatggagaggaggccgagggccctggggccggctag

SEQ ID NO: 167282 - DNA, 723 bp, Artificial Sequence
  Description of Artificial Sequence: Synthetic coding sequence
atgctggtgattcctcctggcctgtctgaggaggaggaggccctgcagaagaagttcaacaagctgaagaagaagaagaaggccctgctggccctgaagaagcagagcagcagcagcaccaccagccagggcggcgtgaagaggagcctgtctgagcagcctgtgatggacacagccacagccacagagcaggccaagcagctggtgaagagcggggccatcagcgccatcaaggccgagaccaagaacagcggcttcaagaggagcaggaccctggagggcaagctgaaggaccctgagaagggccctgtgcccaccttccagcccttccagaggagcatctctgcagatgatgacctgcaggagagcagcagaagaccccagaggaagagcctgtatgaaagtgaccggctgcgggagctgggcccagatggagaggaggccgagggccctggagctggagatggccccccaagaagctttgactggggctatgaggagaggtctggggcccacagcagcgccagccccccaagaagccgcagccgggacaggagccatgaaagaaacagagaccgggaccgggaccgggagcgggaccgggaccgggaccgggaccgggaccgggagcgggaccgggaccgggaccgggaccgggaccgggaccgggagcgggaccgggaccgggagcgggaccgggaccgggaccgggagggcccctag

SEQ ID NO: 167283 - DNA, 480 bp, Artificial Sequence; identical to SEQ ID NO: 167281
  Description of Artificial Sequence: Synthetic coding sequence

SEQ ID NO: 167284 - DNA, 480 bp, Artificial Sequence; identical to SEQ ID NO: 167281
  Description of Artificial Sequence: Synthetic coding sequence

SEQ ID NO: 167285 - DNA, 1005 bp, Artificial Sequence
  Description of Artificial Sequence: Synthetic coding sequence
atgctggtgattcctcctggcctgtctgaggaggaggaggccctgcagaagaagttcaacaagctgaagaagaagaagaaggccctgctggccctgaagaagcagagcagcagcagcaccaccagccagggcggcgtgaagaggagcctgtctgagcagcctgtgatggacacagccacagccacagagcaggccaagcagctggtgaagagcggggccatcagcgccatcaaggccgagaccaagaacagcggcttcaagaggagcaggaccctggagggcaagctgaaggaccctgagaagggccctgtgcccaccttccagcccttccagaggagcatctctgcagatgatgacctgcaggagagcagcagaagaccccagaggaagagcctgtatgaaagtgaccggctgcgggagctgggcccagatggagaggaggccgagggccctggagctggagatggccccccaagaagctttgactggggctatgaggagaggtctggggcccacagcagcgccagccccccaagaagccgcagccgggacaggagccatgaaagaaacagagaccgggaccgggaccgggagcgggaccgggaccgggaccgggaccgggaccgggagcgggaccgggaccgggaccgggaccgggaccgggaccgggagcgggaccgggaccgggagcgggaccgggaccgggaccgggagggccccttccgccgcagtgacagcttccctgagcggcgggcccccaggaaaggaaacaccctgtatgtgtatggagaggacatgacccccaccctgctgcggggggccttcagccccttcggcaacatcatcgacctgtccatggacccccccaggaactgtgcctttgtgacctatgagaagatggagagcgctgaccaggccgtggccgagctgaatggcacccaggtggagagcgtgcagctgaaggtgaacatcgccaggaagcagcccatgctggatgctgcctag

SEQ ID NO: 167286 - DNA, 723 bp, Artificial Sequence; identical to SEQ ID NO: 167282
  Description of Artificial Sequence: Synthetic coding sequence

SEQ ID NO: 167287 - DNA, 480 bp, Artificial Sequence; identical to SEQ ID NO: 167281
  Description of Artificial Sequence: Synthetic coding sequence

SEQ ID NO: 167288 - DNA, 1005 bp, Artificial Sequence; identical to SEQ ID NO: 167285
  Description of Artificial Sequence: Synthetic coding sequence

SEQ ID NO: 167289 - DNA, 480 bp, Artificial Sequence; identical to SEQ ID NO: 167281
  Description of Artificial Sequence: Synthetic coding sequence

SEQ ID NO: 167290 - DNA, 1143 bp, Artificial Sequence; identical to SEQ ID NO: 167277
  Description of Artificial Sequence: Synthetic coding sequence

SEQ ID NO: 167291 - DNA, 885 bp, Artificial Sequence; identical to SEQ ID NO: 167280
  Description of Artificial Sequence: Synthetic coding sequence

SEQ ID NO: 167292 - DNA, 723 bp, Artificial Sequence; identical to SEQ ID NO: 167282
  Description of Artificial Sequence: Synthetic coding sequence

SEQ ID NO: 167293 - DNA, 885 bp, Artificial Sequence; identical to SEQ ID NO: 167280
  Description of Artificial Sequence: Synthetic coding sequence

SEQ ID NO: 167294 - DNA, 1005 bp, Artificial Sequence; identical to SEQ ID NO: 167285
  Description of Artificial Sequence: Synthetic coding sequence

SEQ ID NO: 167295 - DNA, 1005 bp, Artificial Sequence; identical to SEQ ID NO: 167285
  Description of Artificial Sequence: Synthetic coding sequence

SEQ ID NO: 167296 - DNA, 1005 bp, Artificial Sequence; identical to SEQ ID NO: 167285
  Description of Artificial Sequence: Synthetic coding sequence

SEQ ID NO: 167297 - DNA, 1053 bp, Artificial Sequence
  Description of Artificial Sequence: Synthetic coding sequence
atgctggtgattcctcctggcctgtctgaggaggaggaggccctgcagaagaagttcaacaagctgaagaagaagaagaaggccctgctggccctgaagaagcagagcagcagcagcaccaccagccagggcggcgtgaagaggagcctgtctgagcagcctgtgatggacacagccacagccacagagcaggccaagcagctggtgaagagcggggccatcagcgccatcaaggccgagaccaagaacagcggcttcaagaggagcaggaccctggagggcaagctgaaggaccctgagaagggccctgtgcccaccttccagcccttccagaggagcatctctgcagatgatgacctgcaggagagcagcagaagaccccagaggaagagcctgtatgagagctttgactggggctatgaggagaggtctggggcccacagcagcgccagcccccccaggagccgcagccgggacaggagccatgagaggaacagagaccgggaccgggaccgggagcgggaccgggaccgggaccgggaccgggaccgggagcgggaccgggaccgggaccgggaccgggaccgggaccgggagcgggaccgggaccgggagcgggaccgggaccgggaccgggagggccccttcagaagaagtgacagcttccctgagcggcgggcccccaggaagggcaacaccctgtatgtgtatggagaggacatgacccccaccctgctgcggggggccttcagcccctttggaaacatcatcgacctgtccatggaccccccaagaaactgtgcctttgtgacctatgagaagatggagagcgctgaccaggccgtggccgagctgaatggcacccaggtggagagcgtgcagctgaaggtgaacatcgccaggaagcagcccatgctggatgctgccaccgggaagtctgtgtggggcagcctggccgtgcagaacagccccaagggctgccaccgggacaagaggacccagatcgtgtacagtgatgatgtgtacaaggagaacctggtggatggcttctag

SEQ ID NO: 167298 - DNA, 1143 bp, Artificial Sequence; identical to SEQ ID NO: 167277
  Description of Artificial Sequence: Synthetic coding sequence

SEQ ID NO: 167299 - DNA, 723 bp, Artificial Sequence; identical to SEQ ID NO: 167282
  Description of Artificial Sequence: Synthetic coding sequence

SEQ ID NO: 167300 - DNA, 1005 bp, Artificial Sequence; identical to SEQ ID NO: 167285
  Description of Artificial Sequence: Synthetic coding sequence

SEQ ID NO: 167301 - DNA, 885 bp, Artificial Sequence; identical to SEQ ID NO: 167280
  Description of Artificial Sequence: Synthetic coding sequence

SEQ ID NO: 167302 - DNA, 885 bp, Artificial Sequence; identical to SEQ ID NO: 167280
  Description of Artificial Sequence: Synthetic coding sequence

SEQ ID NO: 167303 - DNA, 885 bp, Artificial Sequence; identical to SEQ ID NO: 167280
  Description of Artificial Sequence: Synthetic coding sequence

SEQ ID NO: 167304 - DNA, 723 bp, Artificial Sequence; identical to SEQ ID NO: 167282
  Description of Artificial Sequence: Synthetic coding sequence

SEQ ID NO: 167305 - DNA, 1143 bp, Artificial Sequence; identical to SEQ ID NO: 167277
  Description of Artificial Sequence: Synthetic coding sequence

SEQ ID NO: 167306 - DNA, 480 bp, Artificial Sequence; identical to SEQ ID NO: 167281
  Description of Artificial Sequence: Synthetic coding sequence

SEQ ID NO: 167307 - DNA, 1164 bp, Artificial Sequence; identical to SEQ ID NO: 167276
  Description of Artificial Sequence: Synthetic coding sequence

SEQ ID NO: 167308 - DNA, 1164 bp, Artificial Sequence; identical to SEQ ID NO: 167276
  Description of Artificial Sequence: Synthetic coding sequence

SEQ ID NO: 167309 - DNA, 1164 bp, Artificial Sequence; identical to SEQ ID NO: 167276
  Description of Artificial Sequence: Synthetic coding sequence

SEQ ID NO: 167310 - DNA, 1164 bp, Artificial Sequence; identical to SEQ ID NO: 167276
  Description of Artificial Sequence: Synthetic coding sequence

SEQ ID NO: 167311 - DNA, 1164 bp, Artificial Sequence; identical to SEQ ID NO: 167276
  Description of Artificial Sequence: Synthetic coding sequence

SEQ ID NO: 167312 - DNA, 3294 bp, Artificial Sequence
  Description of Artificial Sequence: Synthetic coding sequence
atggccacccaggtgatgggccagagcagcggcggcggcggcctcttcaccagcagcggcaacatcggcatggccctgcccaatgacatgtatgacctgcatgacctgagcaaggccgagctggccgccccccagctgatcatgctggccaacgtggccctgactggagaggtgaatggcagctgctgtgactacctggtgggggaggagcggcagatggccgagctgatgcctgtgggggacaacaacttcagtgacagcgaggagggggagggcctggaggagagcgctgacatcaagggggagccccacggcctggagaacatggagctgcggagcctggagctgtctgtggtggagccccagcctgtgtttgaggccagcggggccccagacatctacagcagcaacaaggacctgcccccagagaccccaggagctgaggacaagggcaagagcagcaagaccaagcccttccgctgcaagccctgccagtatgaggccgagagcgaggagcagtttgtgcaccacatccgggtgcacagcgccaagaagttctttgtggaggagagcgctgagaagcaggccaaggcccgggagagcggcagcagcacagctgaggagggggacttcagcaagggccccatccgctgtgacagatgtggctacaacaccaacagatatgaccactacacagcccacctgaagcaccacaccagggctggggacaatgaaagagtgtacaagtgcatcatctgcacctacaccaccgtgtctgagtaccactggaggaagcacctgaggaaccacttccccaggaaggtgtacacctgtgggaagtgcaactacttcagtgacaggaagaacaactacgtgcagcacgtgaggacccacactggagagcggccctacaagtgtgagctgtgcccctacagcagcagccagaagacccacctgaccaggcacatgaggacccacagcggggagaagcccttcaagtgtgaccagtgcagctatgtggccagcaaccagcacgaggtgaccaggcatgcccggcaggtgcacaacggccccaagcccctgaactgcccccactgtgactacaagacagctgacaggagcaacttcaagaagcacgtggagctgcacgtgaacccccggcagttcaactgccctgtgtgtgactatgctgccagcaagaagtgcaacctgcagtaccacttcaagagcaagcaccccacctgccccaacaagaccatggatgtgtccaaggtgaagctgaagaagaccaagaagcgggaggccgacctgcctgacaacatcaccaatgagaagacagaaattgagcagaccaagatcaagggagatgtggccggcaagaagaatgagaagtctgtgaaggccgagaagagagatgtgtccaaggagaagaagcccagcaacaacgtgtctgtcatccaggtgaccaccaggaccaggaagtctgtgacagaggtgaaggagatggatgtgcacacaggcagcaacagcgagaagttcagcaagaccaagaagagcaagaggaagctggaggtggacagccacagcctgcacggccctgtgaatgatgaggagagcagcaccaagaagaagaagaaggtggagagcaagagcaagaacaacagccaggaggtgcccaagggggacagcaaggtggaggagaacaagaagcagaacacctgcatgaagaagagcaccaagaagaagaccctgaagaacaagagcagcaagaagagcagcaagccaccccagaaggagcctgtggagaagggcagcgcccagatggaccccccccagatgggccctgcccccacagaggccgtgcagaagggccctgtgcaggtggagcccccaccacccatggagcacgcccagatggagggcgcccagatccggcctgccccagatgagcctgtgcagatggaggtggtgcaggagggccctgcccagaaggagctgctgccccctgtggagcccgcccagatggtgggcgcccagatcgtgctggcccacatggagctgcccccacccatggagacagcccagacagaggtggcccagatgggccctgcccccatggagcccgcccagatggaggtggcccaggtggagagcgcccccatgcaggtggtgcagaaggagcctgtgcagatggagctgagcccccccatggaggtggtgcagaaggagcctgtgcagatcgagctgagcccccccatggaggtggtgcagaaggagcctgtgaagattgagctgagcccccccatcgaggtggtgcagaaggagcctgtgcagatggagctgagcccccccatgggcgtggtgcagaaggagcccgcccagcgggagcccccaccaccccgggagccccccctgcacatggagcccatcagcaagaagccacccctgaggaaggacaagaaggagaagagcaacatgcagagcgagcgggccaggaaggagcaggtgctgattgaggtgggcctggtgcctgtgaaggacagctggctgctgaaggagagcgtgtccacagaggacctgagcccccccagcccccccctgcccaaggagaacctgcgggaggaggccagcggggaccagaagctgctgaacacaggagagggcaacaaggaggcccccctgcagaaggtgggcgctgaggaggctgatgagagcctgcccggcctggccgccaacatcaatgaaagcacccacatcagcagcagcggccagaacctgaacaccccagagggggagaccctgaatggcaagcaccagacagacagcatcgtgtgtgagatgaagatggacacagaccagaacacccgggagaacctgaccggcatcaacagcacagtggaggagcctgtgagccccatgctgcccccatctgctgtggaggagcgggaggccgtgtccaagacagccctggccagccccccagccaccatggccgccaatgaaagccaggagattgatgaagatgagggcatccacagccatgagggcagtgacctgagtgacaacatgtctgagggcagtgatgacagcggcctgcatggagcccggcctgtgccccaggagagcagcaggaagaatgccaaggaggccctggccgtgaaggccgccaagggggactttgtgtgcatcttctgtgacaggagcttcaggaagggcaaggactacagcaagcacctgaacagacacctggtgaatgtgtactacctggaggaggccgcccagggccaggagtag

SEQ ID NO: 167313 - DNA, 3225 bp, Artificial Sequence
  Description of Artificial Sequence: Synthetic coding sequence
atggccacccaggtgatgggccagagcagcggcggcggcggcctcttcaccagcagcggcaacatcggcatggccctgcccaatgacatgtatgacctgcatgacctgagcaaggccgagctggccgccccccagctgatcatgctggccaacgtggccctgactggagaggtgaatggcagctgctgtgactacctggtgggggaggagcggcagatggccgagctgatgcctgtgggggacaacaacttcagtgacagcgaggagggggagggcctggaggagagcgctgacatcaagggggagccccacggcctggagaacatggagctgcggagcctggagctgtctgtggtggagccccagcctgtgtttgaggccagcggggccccagacatctacagcagcaacaaggacctgcccccagagaccccaggagctgaggacaagggcaagagcagcaagaccaagcccttccgctgcaagccctgccagtatgaggccgagagcgaggagcagtttgtgcaccacatccgggtgcacagcgccaagaagttctttgtggaggagagcgctgagaagcaggccaaggcccgggagagcggcagcagcacagctgaggagggggacttcagcaagggccccatccgctgtgacagatgtggctacaacaccaacagatatgaccactacacagcccacctgaagcaccacaccagggctggggacaatgaaagagtgtacaagtgcatcatctgcacctacaccaccgtgtctgagtaccactggaggaagcacctgaggaaccacttccccaggaaggtgtacacctgtgggaagtgcaactacttcagtgacaggaagaacaactacgtgcagcacgtgaggacccacacaggcaagaggcccagcggggagaagcccttcaagtgtgaccagtgcagctatgtggccagcaaccagcacgaggtgaccaggcatgcccggcaggtgcacaacggccccaagcccctgaactgcccccactgtgactacaagacagctgacaggagcaacttcaagaagcacgtggagctgcacgtgaacccccggcagttcaactgccctgtgtgtgactatgctgccagcaagaagtgcaacctgcagtaccacttcaagagcaagcaccccacctgccccaacaagaccatggatgtgtccaaggtgaagctgaagaagaccaagaagcgggaggccgacctgcctgacaacatcaccaatgagaagacagaaattgagcagaccaagatcaagggagatgtggccggcaagaagaatgagaagtctgtgaaggccgagaagagagatgtgtccaaggagaagaagcccagcaacaacgtgtctgtcatccaggtgaccaccaggaccaggaagtctgtgacagaggtgaaggagatggatgtgcacacaggcagcaacagcgagaagttcagcaagaccaagaagagcaagaggaagctggaggtggacagccacagcctgcacggccctgtgaatgatgaggagagcagcaccaagaagaagaagaaggtggagagcaagagcaagaacaacagccaggaggtgcccaagggggacagcaaggtggaggagaacaagaagcagaacacctgcatgaagaagagcaccaagaagaagaccctgaagaacaagagcagcaagaagagcagcaagccaccccagaaggagcctgtggagaagggcagcgcccagatggaccccccccagatgggccctgcccccacagaagctgtgcagaagggccctgtgcaggtggagcccccaccacccatggagcacgcccagatggagggcgcccagatccggcctgccccagatgagcctgtgcagatggaggtggtgcaggagggccctgcccagaaggagctgctgccccctgtggagcccgcccagatggtgggcgcccagatcgtgctggcccacatggagctgcccccacccatggagacagcccagacagaggtggcccagatgggccctgcccccatggagcccgcccagatggaggtggcccaggtggagagcgcccccatgcaggtggtgcagaaggagcctgtgcagatggagctgagcccccccatggaggtggtgcagaaggagcctgtgcagatcgagctgagcccccccatggaggtggtgcagaaggagcctgtgaagattgagctgagcccccccatcgaggtggtgcagaaggagcctgtgcagatggagctgagcccccccatgggcgtggtgcagaaggagcccgcccagcgggagcccccaccaccccgggagccccccctgcacatggagcccatcagcaagaagccacccctgaggaaggacaagaaggagaagagcaacatgcagagcgagcgggccaggaaggagcaggtgctgattgaggtgggcctggtgcctgtgaaggacagctggctgctgaaggagagcgtgtccacagaggacctgagcccccccagcccccccctgcccaaggagaacctgcgggaggaggccagcggggaccagaagctgctgaacacaggagagggcaacaaggaggcccccctgcagaaggtgggcgctgaggaggctgatgagagcctgcccggcctggccgccaacatcaatgaaagcacccacatcagcagcagcggccagaacctgaacaccccagagggggagaccctgaatggcaagcaccagacagacagcatcgtgtgtgagatgaagatggacacagaccagaacacccgggagaacctgaccggcatcaacagcacagtggaggagcctgtgagccccatgctgccccccagcgctgtggaggagcgggaggccgtgtccaagacagccctggccagccccccagccaccatggccgccaatgaaagccaggagattgatgaagatgagggcatccacagccatgagggcagtgacctgagtgacaacatgtctgagggcagtgatgattctggcctgcacggggcccggcctgtgccccaggagagcagcaggaagaatgccaaggaggccctggccgtgaaggccgccaagggggactttgtgtgcatcttctgtgaccgctccttcaggaagggcaaggactacagcaagcacctgaacagacacctggtgaatgtgtactacctggaggaggccgcccagggccaggagtag

SEQ ID NO: 167314 - DNA, 1383 bp, Artificial Sequence
  Description of Artificial Sequence: Synthetic coding sequence
atggccacccaggtgatgggccagagcagcggcggcggcggcctcttcaccagcagcggcaacatcggcatggccctgcccaatgacatgtatgacctgcatgacctgagcaaggccgagctggccgccccccagctgatcatgctggccaacgtggccctgactggagaggtgaatggcagctgctgtgactacctggtgggggaggagcggcagatggccgagctgatgcctgtgggggacaacaacttcagtgacagcgaggagggggagggcctggaggagagcgctgacatcaagggggagccccacggcctggagaacatggagctgcggagcctggagctgtctgtggtggagccccagcctgtgtttgaggccagcggggccccagacatctacagcagcaacaaggacctgcccccagagaccccaggagctgaggacaagggcaagagcagcaagaccaagcccttccgctgcaagccctgccagtatgaggccgagagcgaggagcagtttgtgcaccacatccgggtgcacagcgccaagaagttctttgtggaggagagcgctgagaagcaggccaaggcccgggagagcggcagcagcacagctgaggagggggacttcagcaagggccccatccgctgtgacagatgtggctacaacaccaacagatatgaccactacacagcccacctgaagcaccacaccagggctggggacaatgaaagagtgtacaagtgcatcatctgcacctacaccaccgtgtctgagtaccactggaggaagcacctgaggaaccacttccccaggaaggtgtacacctgtgggaagtgcaactacttcagtgacaggaagaacaactacgtgcagcacgtgaggacccacactggagagcggccctacaagtgtgagctgtgcccctacagcagcagccagaagacccacctgaccaggcacatgaggacccacagcggggagaagcccttcaagtgtgaccagtgcagctatgtggccagcaaccagcacgaggtgaccaggcatgcccggcaggtgcacaacggccccaagcccctgaactgcccccactgtgactacaagacagctgacaggagcaacttcaagaagcacgtggagctgcacgtgaacccccggcagttcaactgccctgtgtgtgactatgctgccagcaagaagtgcaacctgcagtaccacttcaagagcaagcaccccacctgccccaacaagaccatggatgtgtccaaggtgaagctgaagaagaccaagaagcgggaggccgacctgcctgacaacatcaccaatgagaagacagaaattgagcagaccaagaagaagaagaagaagaagaagaagtag

SEQ ID NO: 167315 - DNA, 5745 bp, Artificial Sequence
  Description of Artificial Sequence: Synthetic coding sequence
atggctgatggaaaaggagatgctgctgctgtggccggggccggggctgaggccccagctgtggccggggctggagatggagtggagacagagagcatggtgcggggccacaggcctgtgtccccagcccctggggccagcggcctgcggccctgcctgtggcagctggagacagagctgcgggagcaggaggtgtctgaggtgagcagcctgaactactgccgctccttctgccagaccctgctgcagtatgccagcaacaagaatgccagcgagcacatcgtgtacctgctggaggtgtaccgcctggccatccagagctttgccagcgcccggccctacctgaccacagaatgtgaagatgtgctgctggtgctgggccgcctggtgctgagctgctttgagctgctgctgtctgtgtctgagagcgagctgccctgtgaggtgtggctgcccttcctgcagagcctgcaggagagccatgatgccctgctggagtttggaaacaacaacctgcagatcctggtgcacgtgaccaaggagggcgtgtggaagaaccctgtgctgctgaagatcctgagccagcagcctgtggagacagaggaggtgaacaagctgattgcccaggagggccccagcttcctgcagatgaggatcaagcacctgctgaagagcaactgcatcccccaggccacagccctgagcaagctgtgtgccgagagcaaggagatcagcaatgtgtcctccttccagcaggcctacatcacctgcctgtgcagcatgctgcccaatgaagatgccatcaaggagatcgccaaggtggactgcaaggaggtgctggacatcatctgcaacctggagagcgagggccaggacaacacagcctttgtgctgtgcaccacctacctgacccagcagctgcagacagcctctgtgtactgctcctgggagctgaccctcttctggagcaagctgcagaggagaattgaccccagcctggacaccttcctggagcgctgccggcagtttggagtcatcgccaagacccagcagcacctgttctgcctgatccgggtcatccagacagaggcccaggatgctggcctgggcgtgtccatcctgctgtgtgtgcgggccctgcagctgcggagcagtgaagatgaggagatgaaggcctctgtgtgcaagaccatcgcctgcctgctgcctgaggacctggaggtgagaagagcctgccagctgacagagttcctgattgagcccagcctggatggcttcaacatgctggaggagctgtacctgcagcctgaccagaagtttgatgaagaaaatgcccctgtgcccaacagcctgcgctgtgagctgctgctggccctgaaggcccactggccctttgatcctgagttctgggactggaagaccctgaagaggcactgccaccagctgctgggccaggaggccagtgacagtgatgatgacctgagcggctatgagatgagcatcaatgacacagatgtgctggagagcttcctgagtgactatgatgagggcaaggaggacaagcagtacagaagaagagacctgacagaccagcacaaggagaagagggacaagaagcccatcggcagcagcgagcgctaccagcgctggctgcagtacaagttcttctgcctgctgtgcaagagagaatgtattgaggcccgcatcctgcaccacagcaagatgcacatggaggatggcatctacacctgccctgtgtgcatcaagaagttcaagaggaaggagatgtttgtgccccacgtgatggagcacgtgaagatgccacccagcagaagagacaggagcaagaagaagctgctgctgaagggcagccagaagggcatctgccccaagagccccagcgccatccctgagcagaaccacagcctgaatgaccaggccaagggggagagccatgaatatgtgaccttcagcaagctggaggactgccacctgcaggaccgggacctgtacccctgccccggcacagactgcagcagggtcttcaagcagttcaagtacctgtctgtgcacctgaaggccgagcaccagaacaatgatgaaaatgccaagcactacctggacatgaagaacagaagagagaagtgcacctactgccgccgccacttcatgtctgccttccacctgcgggagcacgagcaggtgcactgcggcccccagccctacatgtgtgtgtccattgactgctacgccaggtttggatctgtgaatgagctgctgaaccacaagcagaagcatgatgacctgcgctacaagtgtgagctgaatggctgcaacatcgtgttcagtgacctgggccagctgtaccaccacgaggcccagcacttcagagatgccagctacacctgcaacttcctgggctgcaagaagttctactacagcaagattgagtaccagaaccacctgtccatgcacaacgtggagaacagcaatggagacatcaagaagtctgtgaagctggaggagagcgccactggagagaagcaggactgcatcaaccagccccacctgctgaaccagacagacaagagccacctgcctgaggacctcttctgtgccgagagcgccaacagccagattgacacagaaacagctgagaacctgaaggagaacagcgacagcaacagcagtgaccagctgagccacagcagcagcgcctccatgaatgaggagctgattgacaccctggaccacagcgagaccatgcaggatgtgctgctgagcaatgagaaggtgtttggccccagcagcctgaaggagaagtgcagctccatggctgtgtgctttgatggcaccaagttcacctgtggctttgatggctgcggcagcacctacaagaatgcccggggcatgcagaagcacctgaggaaggtgcacccctaccacttcaagcccaagaagatcaagaccaaggacctcttccccagcctgggcaatgagcacaaccagaccacagagaagctggatgctgagcccaagccctgcagcgacaccaacagcgacagcccagatgagggcctggaccacaacatccacatcaagtgcaagcgggagcaccagggctacagcagcgagagcagcatctgtgccagcaagaggccctgcacagaggacaccatgctggagctgctgctgcggctgaagcacctgagcctgaagaacagcatcacccacggcagcttcagcggcagcctgcagggctaccccagcagcggggccaagagcctgcagagcgtgagcagcatcagtgacctgaacttccagaaccaggatgagaacatgcccagccagtacctggcccagctggccgccaagcccttcttctgtgagctgcagggctgcaagtatgaatttgtgacccgggaggccctgctgatgcactacctgaagaagcacaactacagcaaggagaaggtgctgcagctgaccatgttccagcaccgctacagccccttccagtgccacatctgccagaggagcttcaccaggaagacccacctgcgcatccactacaagaacaagcaccagattggaagtgaccgggccacccacaagctgctggacaatgaaaaatgtgaccacgagggcccctgcagcgtggaccggctgaagggggactgcagcgctgagctgggcggggaccccagcagcaacagcgagaagccccactgccaccccaagaaggatgagtgcagcagcgagacagacctggagagcagctgtgaggagacagagagcaagaccagtgacatcagcagccccatcggcagccaccgggaggagcaggagggccgggagggccggggcagcagaagaacagtggccaagggcaacctgtgctacatcctgaacaagtaccacaagcccttccactgcatccacaagacctgcaacagcagcttcaccaacctgaagggcctcatccgccactacagaacagtgcaccagtacaacaaggagcagctgtgcctggagaaggacaaggcccggaccaagcgggagctggtgaagtgcaagaagatctttgcctgcaagtacaaggagtgcaacaagcgcttcctgtgcagcaaggccctggccaagcactgcagcgacagccacaacctggaccacatcgaggagcccaaggtgctgtctgaggccggcagcgctgcccgcttcagctgcaaccagccccagtgcccagctgtgttctacaccttcaacaagctgaagcaccacctgatggagcagcacaacatcgagggggagatccacagcgactatgagatccactgtgacctgaatggctgcggccagatcttcacccacaggagcaactacagccagcacgtgtactaccgccacaaggactactatgatgacctcttccgcagccagaaggtggccaatgaaaggctgctgcggtctgagaaggtgtgccagacagctgacacccagggccacgagcaccagaccacccggcgctccttcaatgccaagagcaagaagtgtggcctcatcaaggagaagaaggcccccatctccttcaagaccagggctgaggccctgcacatgtgtgtggagcacagcgagcacacccagtacccctgcatggtgcagggctgcctgtctgtggtgaagctggagagcagcatcgtgcgccactacaagaggacccaccagatgagcagcgcctacctggagcagcagatggagaacctggtggtgtgtgtgaagtatggcaccaagatcaaggaggagccccccagcgaggccgacccctgcatcaagaaggaggagaacagaagctgtgagagcgagaggacagagcacagccacagccctggggacagcagcgcccccatccagaacacagactgctgccacagcagcgagagagatggcggccagaagggctgcatcgagagcagctctgtgtttgatgctgacaccctgctgtaccggggcaccctgaagtgcaaccacagcagcaagaccaccagcctggagcagtgcaacatcgtgcagcccccaccaccctgcaagattgagaacagcatccccaaccccaatggaacagaaagtggcacctacttcaccagcttccagctgcccctgccccgcatcaaggagagcgagacccggcagcacagcagcggccaggagaacacagtgaagaaccccacccacgtgcccaaggagaacttcaggaagcacagccagcccaggagctttgacctgaagacctacaagcccatgggctttgagagcagcttcctgaagttcatccaggagagcgaggagaaggaggatgactttgatgactgggagcccagcgagcacctgaccctgagcaacagcagccagagcagcaatgacctgactggaaatgtggtggccaacaacatggtgaatgattctgagcctgaggtggacatcccccacagcagcagtgacagcaccatccacgagaacctgacagccatcccccccctgattgtggccgagaccaccaccgtgcccagcctggagaacctgcgggtggtgctggacaaggccctgacagactgtggggagctggccctgaagcagctgcactacctgcggcctgtggtggtgctggagaggagcaagttcagcacccccatcctggacctcttccccaccaagaagacagatgagctgtgtgtgggcagcagctag

SEQ ID NO: 167316 - DNA, 4824 bp, Artificial Sequence
  Description of Artificial Sequence: Synthetic coding sequence
atgttctaccatgacctcttctaccgggagctgaccctcttctggagcaagctgcagaggagaattgaccccagcctggacaccttcctggagcgctgccggcagtttggagtgattgccaagacccagcagcacctgttctgcctgatccgggtcatccagacagaggcccaggatgctggcctgggcgtgtccatcctgctgtgtgtgcgggccctgcagctgcggagcagtgaagatgaggagatgaaggcctctgtgtgcaagaccatcgcctgcctgctgcctgaggacctggaggtgcggcgggcctgccagctgacagagttcctgattgagcccagcctggatggcttcaacatgctggaggagctgtacctgcagcctgaccagaagtttgatgaggagaatgcccctgtgcccaacagcctgcgctgtgagctgctgctggccctgaaggcccactggccctttgatcctgagttctgggactggaagaccctgaagaggcactgccaccagctgctgggccaggaggccagtgacagtgatgatgacctgagcggctatgagatgagcatcaatgacacagatgtgctggagagcttcctgagtgactatgatgagggcaaggaggacaagcagtacagaagaagagacctgacagaccagcacaaggagaagagggacaagaagcccatcggcagcagcgagcgctaccagcgctggctgcagtacaagttcttctgcctgctgtgcaagcgggagtgcatcgaggcccgcatcctgcaccacagcaagatgcacatggaggatggcatctacacctgccctgtgtgcatcaagaagttcaagaggaaggagatgtttgtgccccacgtgatggagcacgtgaagatgccacccagccggcgggacaggagcaagaagaagctgctgctgaagggcagccagaagggcatctgccccaagagccccagcgccatccctgagcagaaccacagcctgaatgaccaggccaagggggagagccatgaatatgtgaccttcagcaagctggaggactgccacctgcaggaccgggacctgtacccctgccctggaacagactgcagcagggtcttcaagcagttcaagtacctgtctgtgcacctgaaggccgagcaccagaacaatgatgaaaatgccaagcactacctggacatgaagaacagaagagagaagtgcacctactgcagaagacacttcatgtctgccttccacctgcgggagcacgagcaggtgcactgcggcccccagccctacatgtgtgtgtccattgactgctacgcccgcttcggctctgtgaatgagctgctgaaccacaagcagaagcatgatgacctgcgctacaagtgtgagctgaatggctgcaacatcgtgttcagtgacctgggccagctgtaccaccacgaggcccagcacttcagagatgccagctacacctgcaacttcctgggctgcaagaagttctactacagcaagattgagtaccagaaccacctgtccatgcacaacgtggagaacagcaatggagacatcaagaagtctgtgaagctggaggagagcgccaccggggagaagcaggactgcatcaaccagccccacctgctgaaccagacagacaagagccacctgcctgaagatctcttctgtgccgagagcgccaacagccagattgacacagaaacagctgagaacctgaaggaaaattctgacagcaacagcagtgaccagctgagccacagcagcagcgcctccatgaatgaggagctgattgacaccctggaccacagcgagaccatgcaggatgtgctgctgagcaatgagaaggtgtttggccccagcagcctgaaggagaagtgcagctccatggctgtgtgctttgatggcaccaagttcacctgtggctttgatggctgcggcagcacctacaagaatgcccggggcatgcagaagcacctgaggaaggtgcacccctaccacttcaagcccaagaagatcaagaccaaggacctcttccccagcctgggcaatgagcacaaccagaccacagagaagctggatgctgagcccaagccctgcagcgacaccaacagcgacagcccagatgagggcctggaccacaacatccacatcaagtgcaagcgggagcaccagggctacagcagcgagagcagcatctgtgccagcaagaggccctgcacagaggacaccatgctggagctgctgctgcggctgaagcacctgagcctgaagaacagcatcacccacggcagcttcagcggcagcctgcagggctaccccagcagcggggccaagagcctgcagagcgtgagcagcatcagtgacctgaacttccagaaccaggatgagaacatgcccagccagtacctggcccagctggccgccaagcccttcttctgtgagctgcagggctgcaagtatgaatttgtgacccgggaggccctgctgatgcactacctgaagaagcacaactacagcaaggagaaggtgctgcagctgaccatgttccagcaccgctacagccccttccagtgccacatctgccagaggagcttcaccaggaagacccacctgcgcatccactacaagaacaagcaccagatcggcagtgaccgggccacccacaagctgctggacaatgagaagtgtgaccacgagggcccctgcagcgtggaccggctgaagggggactgcagcgctgagctgggcggggaccccagcagcaacagcgagaagccccactgccaccccaagaaggatgaatgtagcagcgagacagacctggagagcagctgtgaggagacagagagcaagaccagtgacatcagcagccccatcggcagccaccgggaggagcaggagggccgggagggccggggcagcagaagaacagtggccaagggcaacctgtgctacatcctgaacaagtaccacaagcccttccactgcatccacaagacctgcaacagcagcttcaccaacctgaagggcctcatccgccactacagaacagtgcaccagtacaacaaggagcagctgtgcctggagaaggacaaggcccggaccaagcgggagctggtgaagtgcaagaagatctttgcctgcaagtacaaggagtgcaacaagcgcttcctgtgcagcaaggccctggccaagcactgcagcgacagccacaacctggaccacatcgaggagcccaaggtgctgtctgaggccggcagcgctgcccgcttcagctgcaaccagccccagtgcccagctgtgttctacaccttcaacaagctgaagcaccacctgatggagcagcacaacattgaaggagagatccacagcgactatgagatccactgtgacctgaatggctgcggccagatcttcacccacaggagcaactacagccagcacgtgtactaccgccacaaggactactatgatgacctcttccgcagccagaaggtggccaatgaaaggctgctgcggtctgagaaggtgtgccagacagctgacacccagggccacgagcaccagaccaccaggaggagcttcaatgccaagagcaagaagtgtggcctcatcaaggagaagaaggcccccatctccttcaagaccagggctgaggccctgcacatgtgtgtggagcacagcgagcacacccagtacccctgcatggtgcagggctgcctgtctgtggtgaagctggagagcagcatcgtgcgccactacaagaggacccaccagatgagcagcgcctacctggagcagcagatggagaacctggtggtgtgtgtgaagtatggcaccaagatcaaggaggagcccccatctgaggccgacccctgcatcaagaaggaggagaacagaagctgtgagagcgagaggacagagcacagccacagccctggggacagcagcgcccccatccagaacacagactgctgccacagcagcgagagagatggcggccagaagggctgcatcgagagcagctctgtgtttgatgctgacaccctgctgtaccggggcaccctgaagtgcaaccacagcagcaagaccaccagcctggagcagtgcaacatcgtgcagcccccaccaccctgcaagattgaaaattccatccccaaccccaacggcacagagagcggcacctacttcaccagcttccagctgcccctgccccgcatcaaggagagcgagacccggcagcacagcagcggccaggagaacacagtgaagaaccccacccacgtgcccaaggagaacttcaggaagcacagccagcccaggagctttgacctgaagacctacaagcccatgggctttgagagcagcttcctgaagttcatccaggagagcgaggagaaggaggatgactttgatgactgggagcccagcgagcacctgaccctgagcaacagcagccagagcagcaatgacctgactggaaatgtggtggccaacaacatggtgaatgacagcgagcctgaggtggacatcccccacagcagcagtgacagcaccatccacgagaacctgacagccatccccccactcatcgtggccgagaccaccaccgtgcccagcctggagaacctgcgggtggtgctggacaaggccctgacagactgtggggagctggccctgaagcagctgcactacctgcggcctgtggtggtgctggagaggagcaagttcagcacccccatcctggacctcttccccaccaagaagacagatgagctgtgtgtgggcagcagctag

SEQ ID NO: 167317 - DNA, 1641 bp, Artificial Sequence
  Description of Artificial Sequence: Synthetic coding sequence
atgttctactaccccaacgtgctgcagaggcacacaggctgctttgccaccatctggctggccgccacccggggcagccggctggtgaagcgggagtacctgcgggtgaatgtggtgaagacctgtgaggagatcctgaactacgtgctggtgcgggtgcagcccccccagcccggcctgccccggccccgcttcagcctgtacctgagcgcccagctgcagattggagtcatccgggtgtacagccagcagtgccagtacctggtggaggacatccagcacatcctggagcggctgcaccgggcccagctgcagatcagaattgacatggagacagagctgcccagcctgctgctgcccaaccacctggccatgatggagaccctggaggatgccccagaccccttcttcggcatgatgtctgtggacccccggctgcccagcccctttgacatcccccagatccgccacctgctggaggccgccatccctgagcgggtggaggagatccccccagaggtgcccacagagccccgggagcctgagcgcatccctgtgacagtgctgcccccagaggccatcaccatcctggaggccgagcccatccgcatgctggagattgaaggagagcgggagctgcctgaggtgtcccggcgggagctggacctgctgattgctgaggaggaggccatcctgctggagatcccccggctgcccccaccagccccagctgaggtggagggcattggagaggccctgggccctgaggagctgcggctgaccggctgggagcccggggccctgctgatggaggtgaccccacctgaggagctgcggctgcctgccccacccagccctgagcggcggccccctgtgcccccacctccaagaagaagaagaagaagaaggctgctcttctgggacaaggagacccagatcagccctgagaagttccaggagcagctgcagacccgggcccactgctgggagtgccccatggtgcagcccccagagaggaccatccggggccctgctgagctgttccgcacccccaccctgagcggctggctgcccccagagctgctgggcctgtggacccactgtgcccagcccccacccaaggccctgcggcgggagctgcctgaggaggccgctgctgaggaggagaggaggaagattgaggtgcccagcgagattgaggtgccccgggaggccctggagcccagcgtgcccctgatggtgtccctggagatcagcctggaggccgctgaggaggagaagagccgcatcagcctcatccccccagaggagcgctgggcctggccagaggtggaggcccctgaggccccagccctgcctgtggtgcctgagctgcctgaggtgcccatggagatgcccctggtgctgcccccagagctggagctgctgagcctggaggccgtgcacagagctgtggccctggagctgcaggccaaccgggagccagacttcagcagcctggtgagccccctgagccccaggaggatggccgcccgggtcttctacctgctgctggtgctgagcgcccagcagatcctgcacgtgaagcaggagaagccctacggccgcctgctgatccagcccggcccccgcttccactag

SEQ ID NO: 167318 - DNA, 1590 bp, Artificial Sequence
  Description of Artificial Sequence: Synthetic coding sequence
atgttctactaccccaacgtgctgcagaggcacacaggctgctttgccaccatctggctggccgccacccggggcagccggctggtgaagcgggagtacctgcgggtgaatgtggtgaagacctgtgaggagatcctgaactacgtgctggtgcgggtgcagcccccccagcccggcctgccccggccccgcttcagcctgtacctgagcgcccagctgcagattggagtcatccgggtgtacagccagcagtgccagtacctggtggaggacatccagcacatcctggagcggctgcaccgggcccagctgcagatcagaattgacatggagacagagctgcccagcctgctgctgcccaaccacctggccatgatggagaccctggaggatgccccagaccccttcttcggcatgatgtctgtggacccccggctgcccagcccctttgacatcccccagatccgccacctgctggaggccgccatccctgagcgggtggaggagatccccccagaggtgcccacagagccccgggagcctgagcgcatccctgtgacagtgctgcccccagaggccatcaccatcctggaggccgagcccatccgcatgctggagattgaaggagagcgggagctgcctgaggtgtcccggcgggagctggacctgctgattgctgaggaggaggccatcctgctggagatcccccggctgcccccaccagccccagctgaggtggagggcattggagaggccctgggccctgaggagctgcggctgaccggctgggagcccggggccctgctgatgagaagacctcctgtgcccccaccacccaggagaagaagaagaagaaggctgctcttctgggacaaggagacccagatcagccctgagaagttccaggagcagctgcagacccgggcccactgctgggagtgccccatggtgcagcccccagagaggaccatccggggccctgctgagctgttccgcacccccaccctgagcggctggctgcccccagagctgctgggcctgtggacccactgtgcccagcccccacccaaggccctgcggcgggagctgcctgaggaggccgctgctgaggaggagaggaggaagattgaggtgcccagcgagattgaggtgccccgggaggccctggagcccagcgtgcccctgatggtgtccctggagatcagcctggaggccgctgaggaggagaagagccgcatcagcctcatccccccagaggagcgctgggcctggccagaggtggaggcccctgaggccccagccctgcctgtggtgcctgagctgcctgaggtgcccatggagatgcccctggtgctgcccccagagctggagctgctgagcctggaggccgtgcacagagctgtggccctggagctgcaggccaaccgggagccagacttcagcagcctggtgagccccctgagccccaggaggatggccgcccgggtcttctacctgctgctggtgctgagcgcccagcagatcctgcacgtgaagcaggagaagccctacggccgcctgctgatccagcccggcccccgcttccactag

SEQ ID NO: 167319 - DNA, 225 bp, Artificial Sequence
  Description of Artificial Sequence: Synthetic coding sequence
atgttctactaccccaacgtgctgcagaggcacacaggctgctttgccaccatctggctggccgccacccggggcagccggctggtgaagcgggagtacctgcgggtgaatgtggtgaagacctgtgaggagatcctgaactacgtgctggtgcgggtgcagcccccccagcccggcctgccccggccccgcttcagcctgtacctgagcgcccagctgcagtag

SEQ ID NO: 167320 - DNA, 1641 bp, Artificial Sequence; identical to SEQ ID NO: 167317
  Description of Artificial Sequence: Synthetic coding sequence

SEQ ID NO: 167321 - DNA, 699 bp, Artificial Sequence
  Description of Artificial Sequence: Synthetic coding sequence
atggccggggacacagaggtgtggaagcagatgttccaggagctgatgagggaggtgaagccctggcaccgctggaccctgcggccagacaagggcctgctgcccaacgtgctgaagccaggctggatgcagtaccagcagtggacctttgcccgcttccagtgcagcagctgcagcaggaactgggccagcgcccaggtgctggtgctcttccacatgaactggagcgaggagaagagccggggccaggtgaagatgagggtcttcacccagcgctgcaagaagtgcccccagcccctgtttgaggaccctgagttcacccaggagaacatcagccgcatcctgaagaacctggtgttccgcatcctgaagaagtgctaccggggccgcttccagctgattgaggaggtgcccatgatcaaggacatcagcctggagggcccccacaacagcgacaactgtgaggcctgcctgcagggcttctgtgccggccccatccaggtgaccagcctgccccccagccagaccccccgggtgcacagcatctacaaggtggaggaggtggtgaagccctgggccagcggggagaatgtgtacagctatgcctgccagaaccacatctgcaggaacctgagcatcttctgctgctgcgtcatcctgattgtgattgtggtgattgtggtgaagacagccatctag

SEQ ID NO: 167322 - DNA, 741 bp, Artificial Sequence
  Description of Artificial Sequence: Synthetic coding sequence
atggtggtggacttctggacctgggagcagaccttccaggagctgatccaggaggccaagccccgggccacctggaccctgaagctggatggcaacctgcagctggactgcctggcccagggctggaagcagtaccagcagagggccttcggctggttccgctgcagcagctgccagaggtcctgggccagcgcccaggtgcagatcctgtgccacacctactgggagcactggaccagccagggccaggtgaggatgaggctgtttggccagcgctgccagaagtgctcctggagccagtatgagatgcctgagttcagcagtgacagcaccatgaggatcctgagcaacctggtgcagcacatcctgaagaagtactatggaaatggcaccaggaagagccctgagatgcctgtgatcctggaggtgtccctggagggcagccatgacacagccaactgtgaggcctgcaccctgggcatctgtggccagggcctgaagagctgcatgaccaagcccagcaagagcctgctgccccacctgaagacaggcaacagcagccctggcatcggggctgtgtacctggccaaccaggccaagaaccagagcgctgaggccaaggaggccaagggcagcggctatgagaagctgggccccagccgggaccctgaccccctgaacatctgtgtgttcatcctgctgctggtgttcatcgtggtgaagtgcttcaccagcgagtag

SEQ ID NO: 167323 - DNA, 447 bp, Artificial Sequence
  Description of Artificial Sequence: Synthetic coding sequence
atggcccgggccctgtgccgcctgccccggcggggcctgtggctgctgctggcccaccacctgttcatgaccacagcctgccaggaggccaactacggggccctgctgcgggagctgtgcctgacccagttccaggtggacatggaggccgtgggggagaccctgtggtgtgactggggccgcaccatccgcagctaccgggagctggccgactgcacctggcacatggccgagaagctgggctgcttctggcccaatgctgaggtggaccgcttcttcctggccgtgcacggccgctacttccgcagctgccccatcagcggccgggctgtgcgggaccccccaggcagcatcctgtaccccttcatcgtggtgcccatcaccgtgaccctgctggtgacagccctggtggtgtggcagagcaagaggacagagggcatcgtgtag

SEQ ID NO: 167324 - DNA, 381 bp, Artificial Sequence
  Description of Artificial Sequence: Synthetic coding sequence
atgaccacagcctgccaggaggccaactacggggccctgctgcgggagctgtgcctgacccagttccaggtggacatggaggccgtgggggagaccctgtggtgtgactggggccgcaccatccgcagctaccgggagctggccgactgcacctggcacatggccgagaagctgggctgcttctggcccaatgctgaggtggaccgcttcttcctggccgtgcacggccgctacttccgcagctgccccatcagcggccgggctgtgcgggaccccccaggcagcatcctgtaccccttcatcgtggtgcccatcaccgtgaccctgctggtgacagccctggtggtgtggcagagcaagaggacagagggcatcgtgtag

SEQ ID NO: 167325 - DNA, 381 bp, Artificial Sequence; identical to SEQ ID NO: 167324
  Description of Artificial Sequence: Synthetic coding sequence

SEQ ID NO: 167326 - DNA, 381 bp, Artificial Sequence; identical to SEQ ID NO: 167324
  Description of Artificial Sequence: Synthetic coding sequence

SEQ ID NO: 167327 - DNA, 528 bp, Artificial Sequence
  Description of Artificial Sequence: Synthetic coding sequence
atggccagcctgcgggtggagagagctgggggcccccggctgcccaggaccagggtgggccggcctgctgccctgcggctgctgctgctgctgggcgctgtgctgaacccccatgaggccctggcccagcccctgcccaccaccggcaccccaggcagcgagggcggcaccgtgaagaactatgaaacagctgtgcagttctgctggaaccactacaaggaccagatggaccccatcgagaaggactggtgtgactgggccatgatcagccggccctacagcaccctgcgggactgcctggagcactttgctgagctgtttgacctgggcttccccaaccccctggccgagcgcatcatctttgagacccaccagatccactttgccaactgcagcctggtgcagcccaccttcagtgaccccccagaagatgtgctgctggccatgatcatcgcccccatctgcctgatccccttcctgatcaccctggtggtgtggaggagcaaggacagcgaggcccaggcctag

SEQ ID NO: 167328 - DNA, 447 bp, Artificial Sequence
  Description of Artificial Sequence: Synthetic coding sequence
atggagactggagccctgcggcggccccagctgctgcccctgctgctgctgctgtgtggcggctgccccagggctgggggctgcaatgaaacaggcatgctggagcggctgcccctgtgtgggaaggcctttgctgacatgatgggcaaggtggatgtgtggaagtggtgcaacctgtctgagttcatcgtgtactatgagagcttcaccaactgcacagagatggaggccaacgtggtgggctgctactggcccaaccccctggcccagggcttcatcaccggcatccaccggcagttcttcagcaactgcaccgtggacagagtgcacctggaggaccccccagatgaggtgctgatccccctgattgtcatccctgtggtgctgactgtggccatggccggcctggtggtgtggaggagcaagaggacagacaccctgctgtag

SEQ ID NO: 167329 - DNA, 447 bp, Artificial Sequence; identical to SEQ ID NO: 167328
  Description of Artificial Sequence: Synthetic coding sequence

SEQ ID NO: 167330 - DNA, 456 bp, Artificial Sequence
  Description of Artificial Sequence: Synthetic coding sequence
atggagactggagccctgcggcggccccagctgctgcccctgctgctgctgctgtgtggcggctgccccagggctgggggctgcaatgaaacaggcatgctggagcggctgcccctgtgtgggaaggcctttgctgacatgatgggcaaggtggatgtgtggaagtggtgcaacctgtctgagttcatcgtgtactatgagagcttcaccaactgcacagagatggaggccaacgtggtgggctgctactggcccaaccccctggcccagggcttcatcaccggcatccaccggcagttcttcagcaactgcaccgtggacagagtgcacctggaggaccccccagatgaggtgctgatccccctgattgtcatccctgtggtgctgactgtggccatggccggcctggtggtgtggaggagcaagaggacagacaccctgctgtgtggcaactag

SEQ ID NO: 167331 - DNA, 606 bp, Artificial Sequence
  Description of Artificial Sequence: Synthetic coding sequence
atggtgtcctggatcatcagccggctggtggtgctgatcttcggcaccctgtacccagcctactacagctacaaggctgtgaagagcaaggacatcaaggagtatgtgaagtggatgatgtactggatcatctttgccctcttcaccacagctgagaccttcacagacatcttcctgtgctggttccccttctactatgagctgaagatcgcctttgtggcctggctgctgagcccctacaccaagggcagcagcctgctgtacaggaagtttgtgcaccccaccctgagcagcaaggagaaggagattgatgactgcctggtgcaggccaaggacaggagctatgatgccctggtgcactttgggaagaggggcctgaatgtggccgccacagctgctgtgatggccgccagcaagggccagggcgccctgtctgagcggctgcggagcttctccatgcaggacctgaccaccatcagaggagatggagccccagcccccagcggccccccacctcctggcagcggccgggccagcggcaagcacggccagcccaagatgagccgcagcgccagcgagagcgccagcagcagcggcacagcctag

SEQ ID NO: 167332 - DNA, 525 bp, Artificial Sequence
  Description of Artificial Sequence: Synthetic coding sequence
atggaccacctgcaggccggcggcgtgaagtggatgatgtactggatcatctttgccctcttcaccacagctgagaccttcacagacatcttcctgtgctggttccccttctactatgagctgaagatcgcctttgtggcctggctgctgagcccctacaccaagggcagcagcctgctgtacaggaagtttgtgcaccccaccctgagcagcaaggagaaggagattgatgactgcctggtgcaggccaaggacaggagctatgatgccctggtgcactttgggaagaggggcctgaatgtggccgccacagctgctgtgatggccgccagcaagggccagggcgccctgtctgagcggctgcgctccttctccatgcaggacctgaccaccatcagaggagatggagccccagcccccagcggccccccacctcctggcagcggccgggccagcggcaagcacggccagcccaagatgagccgcagcgccagcgagagcgccagcagcagcggcacagcctag

SEQ ID NO: 167333 - DNA, 627 bp, Artificial Sequence
  Description of Artificial Sequence: Synthetic coding sequence
atgcagaaggtgctgagcaatggccagacagaggaggtgcgcagcggcagccgcctcatcttcggcaccctgtacccagcctactacagctacaaggctgtgaagagcaaggacatcaaggagtatgtgaagtggatgatgtactggatcatctttgccctcttcaccacagctgagaccttcacagacatcttcctgtgctggttccccttctactatgagctgaagatcgcctttgtggcctggctgctgagcccctacaccaagggcagcagcctgctgtacaggaagtttgtgcaccccaccctgagcagcaaggagaaggagattgatgactgcctggtgcaggccaaggacaggagctatgatgccctggtgcactttgggaagaggggcctgaatgtggccgccacagctgctgtgatggccgccagcaagggccagggcgccctgtctgagcggctgcgctccttctccatgcaggacctgaccaccatcagaggagatggagccccagcccccagcggccccccacctcctggcagcggccgggccagcggcaagcacggccagcccaagatgagccgcagcgccagcgagagcgccagcagcagcggcacagcctag

SEQ ID NO: 167334 - DNA, 543 bp, Artificial Sequence
  Description of Artificial Sequence: Synthetic coding sequence
atgagcctgcacccctgccgcctgaacaacctgcccaaccaggtgaagtggatgatgtactggatcatctttgccctcttcaccacagctgagaccttcacagacatcttcctgtgctggttccccttctactatgagctgaagatcgcctttgtggcctggctgctgagcccctacaccaagggcagcagcctgctgtacaggaagtttgtgcaccccaccctgagcagcaaggagaaggagattgatgactgcctggtgcaggccaaggacaggagctatgatgccctggtgcactttgggaagaggggcctgaatgtggccgccacagctgctgtgatggccgccagcaagggccagggcgccctgtctgagcggctgcgctccttctccatgcaggacctgaccaccatcagaggagatggagccccagcccccagcggccccccacctcctggcagcggccgggccagcggcaagcacggccagcccaagatgagccgcagcgccagcgagagcgccagcagcagcggcacagcctag

SEQ ID NO: 167335 - DNA, 432 bp, Artificial Sequence
  Description of Artificial Sequence: Synthetic coding sequence
atggtgtcctggatcatcagccggctggtggtgctgatcttcggcaccctgtacccagcctactacagctacaaggctgtgaagagcaaggacatcaaggagtatgtgaagtggatgatgtactggatcatctttgccctcttcaccacagctgagaccttcacagacatcttcctgtgctgggacagagtgccctacagaagagactgtggggccagcgcctgcaggaccagccccccatctggagaaacagcccccctgctgccccgggccccccaccaccggggcctgggcggccctgctgccaacacagccagcctgcgctgccctggggtgctgctgcgggccctggccgcccaggccccaccccgcatcctgcggagccgcttcaggaagaagagcaccagcagcagcgccacagagaccacctag

SEQ ID NO: 167336 - DNA, 759 bp, Artificial Sequence
  Description of Artificial Sequence: Synthetic coding sequence
atggtgtcctggatcatcagccggctggtggtgctgatcttcggcaccctgtacccagcctacagcagctacaaggctgtgaagaccaagaatgtgaaggagtatgtgaagtggatgatgtactggatcgtgtttgccttcttcaccacagctgagaccctgacagacatcgtgctgtcctggttccccttctactttgagctgaagatcgccttcgtcatctggctgctgagcccctacaccaagggcagctctgtgctgtacaggaagtttgtgcaccccaccctgagcaacaaggagaaggagattgatgagtacatcacccaggcccgggacaagagctatgagaccatgatgagggtgggcaagaggggcctgaacctggccgccaatgctgctgtgacagctgctgccaagggcgtgctgtctgagaagctgcggagcttctccatgcaggacctgaccctcatcagagatgaagatgccctgcccctgcagaggccagatggccgcctgcggcccagccctggcagcctgctggacaccatcgaggacctgggagatgatcctgccctgagcctgcggagcagcaccaacccagctgacagcaggacagaggcctctgaagatgacatgggagacaaggcccccaagagggccaagcccatcaagaaggcccccaaggccgagcccctggccagcaagaccctgaagacccggcccaagaagaagaccagcggcggcggggacagcgcctag

SEQ ID NO: 167337 - DNA, 765 bp, Artificial Sequence
  Description of Artificial Sequence: Synthetic coding sequence
atggtgtcctggatcatcagccggctggtggtgctgatcttcggcaccctgtacccagcctacagcagctacaaggctgtgaagaccaagaatgtgaaggagtatgtgaagtggatgatgtactggatcgtgtttgccttcttcaccacagctgagaccctgacagacatcgtgctgtcctggttccccttctactttgagctgaagatcgccttcgtcatctggctgctgagcccctacaccaagggcagctctgtgctgtacaggaagtttgtgcaccccaccctgagcaacaaggagaaggagattgatgagtacatcacccaggcccgggacaagagctatgagaccatgatgagggtgggcaagaggggcctgaacctggccgccaatgctgctgtgacagctgctgccaagggccagggcgtgctgtctgagaagctgcggagcttctccatgcaggacctgaccctcatcagagatgaagatgccctgcccctgcagaggccagatggccgcctgcggcccagccctggcagcctgctggacaccatcgaggacctgggagatgatcctgccctgagcctgcggagcagcaccaacccagctgacagcaggacagaggcctctgaagatgacatgggagacaaggcccccaagagggccaagcccatcaagaaggcccccaaggccgagcccctggccagcaagaccctgaagacccggcccaagaagaagaccagcggcggcggggacagcgcctag

SEQ ID NO: 167338 - DNA, 723 bp, Artificial Sequence
  Description of Artificial Sequence: Synthetic coding sequence
atgctgtacccagcctactacagctacaaggctgtgaagaccaagaatgtgaaggagtatgtgcgctggatgatgtactggatcgtgtttgccctgtacaccgtcatcgagaccgtggccgaccagacagtggcctggttccccctgtactatgagctgaagatcgcctttgtgatctggctgctgagcccctacaccaagggggccagcctcatctacaggaagttcctgcaccccctgctgagcagcaaggagcgggagattgatgactacatcgtgcaggccaaggagcggggctatgagaccatggtgaactttggccggcagggcctgaacctggccgccacagctgctgtgacagctgctgtgaagagccagggcgccatcacagagcggctgcgctccttctccatgcatgacctgaccaccatccagggagatgagcctgtgggccagaggccctaccagcccctgcctgaggccaagaagaagagcaagccagcccccagcgagagcgctggctacggcatccccctgaaggatggagatgagaagacagatgaggaggccgagggcccctacagcgacaatgagatgctgacccacaagggcctgcggcgcagccagagcatgaagtctgtgaagaccaccaagggcaggaaggaggtgcgctatggcagcctgaagtacaaggtgaagaagaggccccaggtgtacttctag

SEQ ID NO: 167339 - DNA, 768 bp, Artificial Sequence
  Description of Artificial Sequence: Synthetic coding sequence
atggtgtcctggatgatcagcagagctgtggtgctggtgtttggcatgctgtacccagcctactacagctacaaggctgtgaagaccaagaatgtgaaggagtatgtgcgctggatgatgtactggatcgtgtttgccctgtacacagtgattgaaacagtggccgaccagacagtggcctggttccccctgtactatgagctgaagatcgccttcgtcatctggctgctgagcccctacaccaagggggccagcctcatctacaggaagttcctgcaccccctgctgagcagcaaggagcgggagattgatgactacatcgtgcaggccaaggagcggggctatgagaccatggtgaactttggccggcagggcctgaacctggccgccacagctgctgtgacagctgctgtgaagagccagggcgccatcacagagcggctgcggagcttctccatgcatgacctgaccaccatccagggagatgagcctgtgggccagaggccctaccagcccctgcctgaggccaagaagaagagcaagccagcccccagcgagagcgctggctacggcatccccctgaaggatggagatgagaagacagatgaggaggccgagggcccctacagcgacaatgagatgctgacccacaagggcctgcggcgcagccagagcatgaagtctgtgaagaccaccaagggcaggaaggaggtgcgctatggcagcctgaagtacaaggtgaagaagaggccccaggtgtacttctag

SEQ ID NO: 167340 - DNA, 774 bp, Artificial Sequence
  Description of Artificial Sequence: Synthetic coding sequence
ctgatgatgtggctgctggtggagcgggccctgatccagctggtgtttggcatgctgtacccagcctactacagctacaaggctgtgaagaccaagaatgtgaaggagtatgtgcgctggatgatgtactggatcgtgtttgccctgtacacagtgattgaaacagtggccgaccagacagtggcctggttccccctgtactatgagctgaagatcgccttcgtcatctggctgctgagcccctacaccaagggggccagcctcatctacaggaagttcctgcaccccctgctgagcagcaaggagcgggagattgatgactacatcgtgcaggccaaggagcggggctatgagaccatggtgaactttggccggcagggcctgaacctggccgccacagctgctgtgacagctgctgtgaagagccagggcgccatcacagagcggctgcggagcttctccatgcatgacctgaccaccatccagggagatgagcctgtgggccagaggccctaccagcccctgcctgaggccaagaagaagagcaagccagcccccagcgagagcgctggctacggcatccccctgaaggatggagatgagaagacagatgaggaggccgagggcccctacagcgacaatgagatgctgacccacaagggcctgcggcgcagccagagcatgaagtctgtgaagaccaccaagggcaggaaggaggtgcgctatggcagcctgaagtacaaggtgaagaagaggccccaggtgtacttctag

SEQ ID NO: 167341 - DNA, 774 bp, Artificial Sequence
  Description of Artificial Sequence: Synthetic coding sequence
atggtgtcctggatgatctgccgcctggtggtgctggtgtttggcatgctgtgcccagcctatgccagctacaaggctgtgaagaccaagaacatccgggagtatgtgcgctggatgatgtactggatcgtgtttgccctcttcatggctgctgagatcgtgacagacatcttcatctcctggttccccttctactatgagatcaagatggcctttgtgctgtggctgctgagcccctacaccaagggggccagcctgctgtacaggaagtttgtgcaccccagcctgagcagacatgagaaggagattgatgcctacatcgtgcaggccaaggagaggagctatgaaacagtgctgagctttgggaagaggggcctgaacattgctgccagcgctgctgtgcaggccgccaccaagagccagggcgccctggccggccgcctgcggagcttctccatgcaggacctgcggagcatcagtgatgccccagccccagcctaccatgaccccctgtacctggaggaccaggtgagccaccggcggccccccatcggctaccgggccggcggcctgcaggacagcgacacagaagatgagtgctggagcgacacagaggccgtgccccgggccccagcccggccccgggagaagcccctcatccgcagccagagcctgcgggtggtgaagaggaagccccctgtgcgggagggcaccagccgcagcctgaaggtgaggaccaggaagaagacagtgcccagtgatgtggacagctag

SEQ ID NO: 167342 - DNA, 522 bp, Artificial Sequence
  Description of Artificial Sequence: Synthetic coding sequence
atggtgtcctggatgatctgccgcctggtggtgctggtgtttggcatgctgtgcccagcctatgccagctacaaggctgtgaagaccaagaacatccgggagtatgtgcgctggatgatgtactggatcgtgtttgccctcttcatggctgctgagatcgtgacagacatcttcatctcctggttccccttctactatgagatcaagatggcctttgtgctgtggctgctgagcccctacaccaagggggccagcctgctgtacaggaagtttgtgcaccccagcctgagcagacatgagaaggagattgatgcctacatcgtgcaggccaaggagaggagctatgaaacagtgctgagctttgggaagaggggcctgaacattgctgccagcgctgctgtgcaggccgccaccaagggcactggacctggggcctgcaggacagccacccccaggatgtctgtgggccagatcctgcggcagagccctggccggcagcccggccctgagaggagcccctag

SEQ ID NO: 167343 - DNA, 570 bp, Artificial Sequence
  Description of Artificial Sequence: Synthetic coding sequence
atgtctgctgccatgagggagagatttgaccgcttcctgcacgagaagaactgcatgacagacctgctggccaagctggaggccaagacaggagtgaacagaagcttcatcgccctgggcgtcatcggcctggtggccctgtacctggtgtttggctatggagccagcctgctgtgcaacctgattggcttcggctacccagcctacatcagcatcaaggccatcgagagccccaacaaggaggatgacacccagtggctgacctactgggtggtgtatggagtcttcagcattgctgagttcttcagtgacatcttcctgtcctggttccccttctactacatgctgaagtgtggcttcctgctgtggtgcatggcccccagccccagcaatggagctgagctgctgtacaagaggatcatccggcccttcttcctgaagcatgagagccagatggacagcgtggtgaaggacctgaaggacaaggccaaggagacagcagatgccatcaccaaggaggccaagaaggccaccgtgaacctgctgggggaggagaagaagagcacctag

SEQ ID NO: 167344 - DNA, 396 bp, Artificial Sequence
  Description of Artificial Sequence: Synthetic coding sequence
atgtctgctgccatgagggagagatttgaccgcttcctgcacgagaagaactgcatgacagacctgctggccaagctggaggccaagacaggagtgaacagaagcttcatcgccctgggcgtcatcggcctggtggccctgtacctggtgtttggctatggagccagcctgctgtgcaacctgattggcttcggctacccagcctacatcagcatcaaggccatcgagagccccaacaaggaggatgacacccagtggctgacctactgggtggtgtatggagtcttcagcattgctgagttcttcagtgacatcttcctgtcctggttccccttctactacatgctgaaggtgtggagcggcctgggcttcctgctgccccgctgcctgctgtag

SEQ ID NO: 167345 - DNA, 1413 bp, Artificial Sequence
  Description of Artificial Sequence: Synthetic coding sequence
atgcacttcagcatccctgagacagagagccgcagcggggacagcggcggcagcgcctacgtggcctacaacatccacgtgaatggagtgctgcactgccgggtgcgctacagccagctgctgggcctgcacgagcagctgaggaaggagtatggagccaacgtgctgcctgccttcccccccaagaagctgttcagcctgaccccagctgaggtggagcagaggcgggagcagctggagaagtacatgcaggccgtgcggcaggaccccctgctgggcagcagcgagaccttcaacagcttcctgcggcgggcccagcaggagacccagcaggtgcccacagaggaggtgtccctggaggtgctgctgagcaatggccagaaggtgctggtgaatgtgctgaccagtgaccagacagaagatgtgctggaggccgtggccgccaagctggacctgcctgatgacctgattggctacttcagcctcttcctggtgcgggagaaggaggatggagccttctcctttgtgaggaagctgcaggagtttgagctgccctacgtgtctgtgaccagcctgcggagccaggagtacaagatcgtgctgaggaagagctactgggacagcgcctatgatgatgatgtgatggagaacagagtgggcctgaacctgctgtatgcccagacagtgtctgacatcgagcggggctggatcctggtgaccaaggagcagcaccggcagctgaagagcctgcaggagaaggtgtccaagaaggagttcctgcggctggcccagaccctgcggcactacggctacctgcgctttgatgcctgtgtggccgacttccctgagaaggactgccctgtggtggtgtctgctggcaacagcgagctgagcctgcagctgcggctgcccggccagcagctgcgggagggcagcttccgggtgaccaggatgcgctgctggagggtgaccagctctgtgcccctgcccagcggcagcaccagcagccctggccggggccgcggggaggtgcggctggagctggcctttgagtacctgatgagcaaggaccggctgcagtgggtgaccatcaccagcccccaggccatcatgatgagcatctgcctgcagagcatggtggatgagctgatggtgaagaagagcggcggcagcatcaggaagatgctgcggcggcgggtgggcggcaccctgcggcggagtgacagccagcaggccgtgaagagcccccccctgctggagagcccagatgccacccgggagagcatggtgaagctgagcagcaagctgtctgctgtgtccctgcggggcatcggcagccccagcacagatgccagcgccagtgatgtgcacggcaactttgcctttgagggcattggagatgaggacctgtag

SEQ ID NO: 167346 - DNA, 2814 bp, Artificial Sequence
  Description of Artificial Sequence: Synthetic coding sequence
atgcaccggccccggcggcggggcaccaggcctcccctgctggccctgctggccgccctgctgctggccgcccggggagctgctgcccaggagacagagctgtctgtgtctgctgagctggtgcccaccagctcctggaacatcagcagcgagctgaacaaggacagctacctgaccctggatgagcccatgaacaacatcaccaccagcctgggccagacagctgagctgcactgcaaggtgtctggcaaccccccacccaccatccgctggttcaagaatgatgcccctgtggtgcaggagccccggcggctgtccttccgcagcaccatctacggcagccggctgcgcatccggaacctggacaccacagacaccggctacttccagtgtgtggccaccaacgggaaggaggtggtgagcagcactggagtgctgtttgtgaagtttggccccccacccacagccagccctggctacagtgatgaatatgaggaggatggcttctgccagccctaccggggcatcgcctgtgcccgcttcatcggcaacagaacagtgtacatggagagcctgcacatgcagggcgagattgagaaccagatcacagctgccttcaccatgattggcaccagcagccacctgagtgacaagtgcagccagtttgccatccccagcctgtgccactacgccttcccctactgtgatgagaccagctctgtgcccaagccccgggacctgtgcagagatgaatgtgagatcctggagaatgtgctgtgccagacagagtacatctttgcccggagcaaccccatgatcctgatgaggctgaagctgcccaactgtgaggacctgccccagcctgagagccctgaggccgccaactgcatcagaattggcatccccatggctgaccccatcaacaagaaccacaagtgctacaacagcactggagtggactaccggggcaccgtgtctgtgaccaagagcggccggcagtgccagccctggaacagccagtacccccacacccacaccttcaccgccctgcgcttccctgagctgaatggaggccacagctactgcagaaatcctggcaaccagaaggaggccccctggtgcttcaccctggatgagaacttcaagagtgacctgtgtgacatcccagcctgtgacagcaaggacagcaaggagaagaacaagatggagatcctgtacatcctggtgcccagcgtggccatccccctggccatcgccctgctcttcttcttcatctgtgtgtgcaggaacaaccagaagagcagcagcgcccctgtgcagaggcagcccaagcacgtgcggggccagaatgtggagatgtccatgctgaatgcctacaagcccaagagcaaggccaaggagctgcccctgtctgctgtgcgcttcatggaggagctgggagaatgtgccttcggcaagatctacaagggccacctgtacctgcccggcatggaccacgcccagctggtggccatcaagaccctgaaggactacaacaacccccagcagtggacagagttccagcaggaggccagcctgatggccgagctgcaccaccccaacatcgtgtgcctgctgggcgctgtgacccaggagcagcctgtgtgcatgctgtttgagtacatcaaccagggcgacctgcacgagttcctgatcatgaggagcccccacagtgatgtgggctgcagcagtgatgaagatggcaccgtgaagagcagcctggaccatggagacttcctgcacatcgccatccagattgctgctggcatggagtacctgagcagccacttctttgtgcacaaggacctggccgccaggaacatcctgattggagagcagctgcacgtgaagatcagtgacctgggcctgagccgggagatctacagcgctgactactacagagtgcagagcaagagcctgctgcccatccgctggatgcctcctgaggccatcatgtatggcaagttcagcagtgacagcgacatctggagctttggagtggtgctgtgggagatcttctcctttggcctgcagccctactacggcttcagcaaccaggaggtgattgagatggtgaggaagaggcagctgctgccctgcagcgaggactgcccccccaggatgtacagcctgatgacagagtgctggaatgagatccccagcagaagaccccgcttcaaggacatccacgtgcggctgcgctcctgggagggcctgagcagccacaccagcagcaccacccccagcggcggcaatgccaccacccagaccaccagcctgagcgccagccctgtgagcaacctgagcaacccccgctaccccaactacatgttccccagccagggcatcaccccccagggccagattgctggcttcatcggcccccccatcccccagaaccagcgcttcatccccatcaatggctaccccatccccccaggctatgctgccttccctgctgcccactaccagcccactggaccacccagggtcatccagcactgccccccacccaagagccgcagccccagcagcgccagcggcagcaccagcactggacatgtgaccagcctgcccagcagcggcagcaaccaggaggccaacatccccctgctgccccacatgagcatccccaaccaccctgggggcatgggcatcaccgtgtttggaaacaagagccagaagccctacaagattgacagcaagcaggccagcctgctgggagatgccaacatccacggccacacagagagcatgatctctgctgagctgtag

SEQ ID NO: 167347 - DNA, 1182 bp, Artificial Sequence
  Description of Artificial Sequence: Synthetic coding sequence
atgcaccggccccggcggcggggcaccaggcctcccctgctggccctgctggccgccctgctgctggccgcccggggagctgctgcccaggagacagagctgtctgtgtctgctgagctggtgcccaccagctcctggaacatcagcagcgagctgaacaaggacagctacctgaccctggatgagcccatgaacaacatcaccaccagcctgggccagacagctgagctgcactgcaaggtgtctggcaaccccccacccaccatccgctggttcaagaatgatgcccctgtggtgcaggagccccggcggctgtccttccgcagcaccatctacggcagccggctgcgcatccggaacctggacaccacagacaccggctacttccagtgtgtggccaccaacgggaaggaggtggtgagcagcactggagtgctgtttgtgaagtttggccccccacccacagccagccctggctacagtgatgaatatgaggaggatggcttctgccagccctaccggggcatcgcctgtgcccgcttcatcggcaacagaacagtgtacatggagagcctgcacatgcagggcgagattgagaaccagatcacagctgccttcaccatgattggcaccagcagccacctgagtgacaagtgcagccagtttgccatccccagcctgtgccactacgccttcccctactgtgatgagaccagctctgtgcccaagccccgggacctgtgcagagatgaatgtgagatcctggagaatgtgctgtgccagacagagtacatctttgcccggagcaaccccatgatcctgatgaggctgaagctgcccaactgtgaggacctgccccagcctgagagccctgaggccgccaactgcatcagaattggcatccccatggctgaccccatcaacaagaaccacaagtgctacaacagcactggagtggactaccggggcaccgtgtctgtgaccaagagcggccggcagtgccagccctggaacagccagtacccccacacccacaccttcaccgccctgcgcttccctgagctgaatggaggccacagctactgcagaaatcctggcaaccagaaggaggccccctggtgcttcaccctggatgagaacttcaagagtgacctgtgtgacatcccagcctgtgggaagtag

SEQ ID NO: 167348 - DNA, 2823 bp, Artificial Sequence
  Description of Artificial Sequence: Synthetic coding sequence
cgggcccggggctgcagcgccaggagaagaggcacccggccccccctgctggccctgctggccgccctgctgctggccgcccggggagctgctgcccaggagacagagctgtctgtgtctgctgagctggtgcccaccagctcctggaacatcagcagcgagctgaacaaggacagctacctgaccctggatgagcccatgaacaacatcaccaccagcctgggccagacagctgagctgcactgcaaggtgtctggcaaccccccacccaccatccgctggttcaagaatgatgcccctgtggtgcaggagccccggcggctgtccttccgcagcaccatctacggcagccggctgcgcatccggaacctggacaccacagacaccggctacttccagtgtgtggccaccaacgggaaggaggtggtgagcagcactggagtgctgtttgtgaagtttggacctccacccacagccagccctggctacagtgatgaatatgaagaagatggcttctgccagccctaccggggcatcgcctgtgcccgcttcatcggcaacagaacagtgtacatggagagcctgcacatgcagggcgagattgagaaccagatcacagctgccttcaccatgattggcaccagcagccacctgagtgacaagtgcagccagtttgccatccccagcctgtgccactacgccttcccctactgtgatgagaccagctctgtgcccaagccccgggacctgtgcagagatgaatgtgagatcctggagaatgtgctgtgccagacagagtacatctttgcccggagcaaccccatgatcctgatgaggctgaagctgcccaactgtgaggacctgccccagcctgagagccctgaggccgccaactgcatccgcatcggcatccccatggctgaccccatcaacaagaaccacaagtgctacaacagcactggagtggactaccggggcaccgtgtctgtgaccaagagcggccggcagtgccagccctggaacagccagtacccccacacccacaccttcaccgccctgcgcttccctgagctgaatggaggccacagctactgcaggaaccctggcaaccagaaggaggccccctggtgcttcaccctggatgagaacttcaagagtgacctgtgtgacatcccagcctgtgacagcaaggacagcaaggagaagaacaagatggagatcctgtacatcctggtgcccagcgtggccatccccctggccatcgccctgctcttcttcttcatctgtgtgtgcaggaacaaccagaagagcagcagcgcccctgtgcagaggcagcccaagcacgtgcggggccagaatgtggagatgtccatgctgaatgcctacaagcccaagagcaaggccaaggagctgcccctgtctgctgtgcgcttcatggaggagctgggggagtgtgccttcggcaagatctacaagggccacctgtacctgcccggcatggaccacgcccagctggtggccatcaagaccctgaaggactacaacaacccccagcagtggacagagttccagcaggaggccagcctgatggccgagctgcaccaccccaacatcgtgtgcctgctgggcgctgtgacccaggagcagcctgtgtgcatgctgtttgagtacatcaaccagggcgacctgcacgagttcctgatcatgaggagcccccacagtgatgtgggctgcagcagtgatgaagatggcaccgtgaagagcagcctggaccacggggacttcctgcacatcgccatccagattgctgctggcatggagtacctgagcagccacttctttgtgcacaaggacctggccgccaggaacatcctgattggagagcagctgcacgtgaagatcagtgacctgggcctgagccgggagatctacagcgctgactactacagagtgcagagcaagagcctgctgcccatccgctggatgcctcctgaggccatcatgtatggcaagttcagcagtgacagcgacatctggagctttggagtggtgctgtgggagatcttctcctttggcctgcagccctactacggcttcagcaaccaggaggtgattgagatggtgaggaagaggcagctgctgccctgcagcgaggactgcccccccaggatgtacagcctgatgacagagtgctggaatgagatccccagccggcggccccgcttcaaggacatccacgtgcggctgcgctcctgggagggcctgagcagccacaccagcagcaccaccccatctggaggaaatgccaccacccagaccaccagcctgagcgccagccctgtgagcaacctgagcaacccccgctaccccaactacatgttccccagccagggcatcaccccccagggccagattgctggcttcatcggcccccccatcccccagaaccagcgcttcatccccatcaatggctaccccatccccccaggctacgccgccttccctgctgcccactaccagcccaccggcccccccagggtcatccagcactgccccccacccaagagccgcagccccagcagcgccagcggcagcaccagcacaggccacgtgaccagcctgcccagcagcggcagcaaccaggaggccaacatccccctgctgccccacatgagcatccccaaccaccctgggggcatgggcatcaccgtgtttggaaacaagagccagaagccctacaagattgacagcaagcaggccagcctgctgggagatgccaacatccacggccacacagagagcatgatctctgctgagctgtag

SEQ ID NO: 167349 - DNA, 1167 bp, Artificial Sequence
  Description of Artificial Sequence: Synthetic coding sequence
atgctgtttgagtacatcaaccagggcgacctgcacgagttcctgatcatgaggagcccccacagtgatgtgggctgcagcagtgatgaagatggcaccgtgaagagcagcctggaccacggggacttcctgcacatcgccatccagattgctgctggcatggagtacctgagcagccacttctttgtgcacaaggacctggccgccaggaacatcctgattggagagcagctgcacgtgaagatcagtgacctgggcctgagccgggagatctacagcgctgactactacagagtgcagagcaagagcctgctgcccatccgctggatgcctcctgaggccatcatgtatggcaagttcagcagtgacagcgacatctggagctttggagtggtgctgtgggagatcttctcctttggcctgcagccctactacggcttcagcaaccaggaggtgattgagatggtgaggaagaggcagctgctgccctgcagcgaggactgcccccccaggatgtacagcctgatgacagagtgctggaatgagatccccagccggcggccccgcttcaaggacatccacgtgcggctgcgctcctgggagggcctgagcagccacaccagcagcaccaccccatctggaggaaatgccaccacccagaccaccagcctgagcgccagccctgtgagcaacctgagcaacccccgctaccccaactacatgttccccagccagggcatcaccccccagggccagattgctggcttcatcggcccccccatcccccagaaccagcgcttcatccccatcaatggctaccccatccccccaggctacgccgccttccctgctgcccactaccagcccaccggcccccccagggtcatccagcactgccccccacccaagagccgcagccccagcagcgccagcggcagcaccagcacaggccacgtgaccagcctgcccagcagcggcagcaaccaggaggccaacatccccctgctgccccacatgagcatccccaaccaccctgggggcatgggcatcaccgtgtttggaaacaagagccagaagccctacaagattgacagcaagcaggccagcctgctgggagatgccaacatccacggccacacagagagcatgatctctgctgagctgtag

SEQ ID NO: 167350 - DNA, 2832 bp, Artificial Sequence
  Description of Artificial Sequence: Synthetic coding sequence
atggcccggggcagcgccctgccccggcggcccctgctgtgcatcccagctgtgtgggccgccgccgccctgctgctgtctgtgtccaggaccagcggggaggtggaggtgctggaccccaatgaccccctgggccccctggatggccaggacggccccatccccaccctgaagggctacttcctgaacttcctggagcctgtgaacaacatcaccatcgtgcagggccagacagccatcctgcactgcaaggtggccggcaaccccccacccaacgtgcgctggctgaagaatgatgcccctgtggtgcaggagccccggcgcatcatcatcaggaagacagaatatggcagccggctgcgcatccaggacctggacaccacagacaccggctactaccagtgtgtggccaccaacggcatgaagaccatcacagccactggagtgctgtttgtgcggctgggccccacccacagccccaaccacaacttccaggatgactaccatgaagatggcttctgccagccctaccggggcatcgcctgtgcccgcttcatcggcaacagaaccatctacgtggacagcctgcagatgcagggcgagattgaaaatcgcatcacagctgccttcaccatgattggcaccagcacccacctgagtgaccagtgcagccagtttgccatccccagcttctgccactttgtgttccccctgtgtgatgcccggagcaggacccccaagccccgggagctgtgcagagatgaatgtgaggtgctggagagtgacctgtgccggcaggagtacaccatcgcccggagcaaccccctcatcctgatgaggctgcagctgcccaagtgtgaggccctgcccatgcctgagagcccagatgctgccaactgcatgagaattggcatcccagctgagcggctgggccgctaccaccagtgctacaacggcagcggcatggactaccggggcacagccagcaccaccaagagcggccaccagtgccagccctgggccctgcagcacccccacagccaccacctgagcagcacagacttccctgagctgggcggcggccacgcctactgcaggaaccctgggggccagatggagggcccctggtgcttcacccagaacaagaatgtgaggatggagctgtgtgatgtgcccagctgcagcccccgggacagcagcaagatgggcatcctgtacatcctggtgcccagcatcgccatccccctggtgattgcctgcctcttcttcctggtgtgcatgtgcaggaacaagcagaaggccagcgccagcaccccccagaggcggcagctgatggccagccccagccaggacatggagatgcccctcatcaaccagcacaagcaggccaagctgaaggagatcagcctgtctgctgtgcgcttcatggaggagctgggagaagatagatttgggaaggtgtacaagggccacctgtttggacctgcccctggagagcagacccaggccgtggccatcaagaccctgaaggacaaggccgagggccccctgcgggaggagttcagacatgaggccatgctgcgggcccggctgcagcaccccaacgtggtgtgcctgctgggcgtggtgaccaaggaccagcccctgtccatgatcttctcctactgcagccacggggacctgcacgagttcctggtgatgaggagcccccacagtgatgtgggcagcacagatgatgacagaacagtgaagagcgccctggagcccccagactttgtgcacctggtggcccagattgctgctggcatggagtacctgagcagccaccacgtggtgcacaaggacctggccaccagaaatgtgctggtgtatgacaagctgaatgtgaagatcagtgacctgggcctcttccgggaggtgtatgctgctgactactacaagctgctgggcaacagcctgctgcccatccgctggatggcccctgaggccatcatgtatggcaagttcagcattgacagcgacatctggagctatggagtggtgctgtgggaggtgttctcctatggcctgcagccctactgcggctacagcaaccaggatgtggtggagatgatccggaaccggcaggtgctgccctgcccagatgactgcccagcctgggtgtatgccctgatgattgagtgctggaatgagttccccagcagaagaccccgcttcaaggacatccacagccggctgcgggcctggggcaacctgagcaactacaacagcagcgcccagaccagcggggccagcaacaccacccagaccagcagcctgagcaccagccctgtgtccaatgtgtccaatgcccgctacgtgggccccaagcagaaggccccacccttcccccagccccagttcatccccatgaagggccagatccggcccatggtgcccccaccccagctgtatgtgcctgtgaatggctaccagcctgtgcctgcctacggggcctacctgcccaacttctaccctgtgcagatccccatgcagatggccccccagcaggtgcccccccagatggtgcccaagcccagcagccaccacagcggcagcggcagcaccagcacaggctacgtgaccacagcccccagcaacacctccatggctgacagagctgccctgctgtctgagggcgcagatgacacccagaatgccccagaagatggagcccagagcacagtgcaggaggccgaggaggaggaggagggctctgtgcctgagacagagctgctgggggactgtgacaccctgcaggtggatgaggcccaggtgcagctggaggcctag

SEQ ID NO: 167351 - DNA, 1239 bp, Artificial Sequence
  Description of Artificial Sequence: Synthetic coding sequence
atgggccaggaccagaccaagcagcagatcgagaagggcctgcagctgtaccagagcaaccagacagagaaggccctgcaggtgtggaccaaggtgctggagaagagcagtgacctgatgggccgcttccgggtgctgggctgcctggtgacagcccacagcgagatgggccgctacaaggagatgctgaagtttgctgtggtgcagattgacacagcccgggagctggaggatgctgacttcctgctggagagctacctgaacctggcccggagcaatgagaagctgtgtgagttccacaagaccatctcctactgcaagacctgcctgggcctgcccggcaccagggctggggcccagctgggcggccaggtgtccctgtccatgggaaatgccttcctgggcctgtctgtgttccagaaggccctggagagctttgagaaggccctgcgctatgcccacaacaatgatgatgccatgctggagtgccgggtgtgctgcagcctgggcagcttctacgcccaggtgaaggactatgagaaggccctcttcttcccctgcaaggctgctgagctggtgaacaactacggcaagggctggagcctgaagtaccgggccatgagccagtaccacatggctgtggcctaccgcctgctgggccgcctgggcagcgccatggagtgctgtgaggagagcatgaagatcgccctgcagcacggggaccggcccctgcaggccctgtgcctgctgtgctttgctgacatccacaggagcagaggagacctggagacagccttccccaggtatgattctgccatgagcatcatgacagaaattggcaaccggctgggccaggtgcaggccctgctgggcgtggccaagtgctgggtggccaggaaggccctggacaaggccctggatgccatcgagcgggcccaggacctggccgaggaggtgggcaacaagctgagccagctgaagctgcactgcctgtctgagagcatctaccgcagcaagggcctgcagcgggagctgcgggcccacgtggtgcgcttccatgaatgtgtggaggagacagagctgtactgcggcctgtgtggggagagcatcggggagaagaacagccggctgcaggccctgccctgcagccacatcttccacctgcgctgcctgcagaacaacggcaccaggagctgccccaactgcagaagaagctccatgaagccaggctttgtgtag

SEQ ID NO: 167352 - DNA, 1062 bp, Artificial Sequence
  Description of Artificial Sequence: Synthetic coding sequence
atgggccaggaccagaccaagcagcagatcgagaagggcctgcagctgtaccagagcaaccagacagagaaggccctgcaggtgtggaccaaggtgctggagaagagcagtgacctgatgggccgcttccgggtgctgggctgcctggtgacagcccacagcgagatgggccgctacaaggagatgctgaagtttgctgtggtgcagattgacacagcccgggagctggaggatgctgacttcctgctggagagctacctgaacctggcccggagcaatgagaagctgtgtgagttccacaagaccatctcctactgcaagacctgcctgggcctgcccggcaccagggctggggcccagctgggcggccaggtgtccctgtccatgggaaatgccttcctgggcctgtctgtgttccagaaggccctggagagctttgagaaggccctgcgctatgcccacaacaatgatgatgccatgctggagtgccgggtgtgctgcagcctgggcagcttctacgcccaggtgaaggactatgagaaggccctcttcttcccctgcaaggctgctgagctggtgaacaactacggcaagggctggagcctgaagtaccgggccatgagccagtaccacatggctgtggcctaccgcctgctgggccgcctgggcagcgccatggagtgctgtgaggagagcatgaagatcgccctgcagcacggggaccggcccctgcaggccctgtgcctgctgtgctttgctgacatccacaggagcagaggagacctggagctgagccagctgaagctgcactgcctgtctgagagcatctaccgcagcaagggcctgcagcgggagctgcgggcccacgtggtgcgcttccatgaatgtgtggaggagacagagctgtactgcggcctgtgtggggagagcattggagagaagaacagccggctgcaggccctgccctgcagccacatcttccacctgcgctgcctgcagaacaacggcaccaggagctgccccaactgccgccgcagctccatgaagccaggctttgtgtag

SEQ ID NO: 167353 - DNA, 2010 bp, Artificial Sequence
  Description of Artificial Sequence: Synthetic coding sequence
atgggcacagccctggtgtaccacgaggacatgacagccacccggctgctgtgggatgatcctgaatgtgaaattgaaagacctgagcggctgacagctgccctggaccggctgcggcagaggggcctggagcagcgctgcctgcggctgagcgcccgggaggccagcgaggaggagctgggcctggtgcacagcccagaatatgtgtccctggtgcgggagacccaggtgctgggcaaggaggagctgcaggccctgagcggccagtttgatgccatctacttccaccccagcaccttccactgtgcccggctggccgccggggccggcctgcagctggtggatgctgtgctgactggagctgtgcagaatggcctggccctggtgcggcccccaggccaccacggccagagagctgctgccaacggcttctgtgtgttcaacaacgtggccatcgccgccgcccacgccaagcagaagcacggcctgcaccgcatcctggtggtggactgggatgtgcaccacggccagggcatccagtacctgtttgaagatgaccccagcgtgctgtacttctcctggcacagatatgaacatggccgcttctggcccttcctgcgggagagtgatgctgatgctgtgggccggggccagggcctgggcttcaccgtgaacctgccctggaaccaggtgggcatgggaaatgctgactatgtggccgccttcctgcacctgctgctgcccctggcctttgaatttgatcctgagctggtgctggtgtctgctggctttgacagcgccatcggggaccctgagggccagatgcaggccaccccagagtgctttgcccacctgacccagctgctgcaggtgctggccggcggccgggtgtgtgctgtgctggagggcggctaccacctggagagcctggccgagagcgtgtgcatgacagtgcagaccctgctgggggaccctgccccacccctgagcggccccatggccccctgccagagcgccctggagagcatccagagcgcccgggccgcccaggccccccactggaagagcctgcagcagcaggatgtgacagctgtgcccatgagccccagcagccacagccctgagggccggcccccacccctgctgcccggcggccctgtgtgcaaggctgctgccagcgcccccagcagcctgctggaccagccctgcctgtgcccagcccccagcgtgaggacagctgtggccctgaccaccccagacatcaccctggtgctgcccccagatgtgatccagcaggaggccagcgccctgcgggaggagacagaggcctgggcccggccccatgagagcctggcccgggaggaggccctgacagccctgggcaagctgctgtacctgctggatggcatgctggatggccaggtgaacagcggcattgctgccaccccagccagcgctgctgctgccaccctggatgtggccgtgcggcggggcctgagccatggagcccagaggctgctgtgtgtggccctgggccagctggaccggcccccagacctggcccatgatggccgcagcctgtggctgaacatccggggcaaggaggccgccgccctgtccatgtttcatgtgtccacccccctgcctgtgatgactggaggcttcctgagctgcatcctgggcctggtgctgcccctggcctacggcttccagcctgacctggtgctggtggccctgggccctggccacggcctgcagggcccccacgccgccctgctggccgccatgctgcggggcctggccggcggccgggtgctggccctgctggaggagaacagcaccccccagctggccggcatcctggcccgggtgctgaatggagaggccccacccagcctgggccccagctctgtggccagcccagaagatgtgcaggccctgatgtacctgcggggccagctggagccccagtggaagatgctgcagtgccacccccacctggtggcctag

SEQ ID NO: 167354 - DNA, 1206 bp, Artificial Sequence
  Description of Artificial Sequence: Synthetic coding sequence
atgcagcgctgctggcagggcgacccccgggtgcggcccaccttccaggagatcaccagcgagacagaggacctgtgtgagaagccagatgatgaggtgaaggagacagcccatgacctggatgtgaagagccccccagagcccaggtctgaggtggtgcctgcccggctgaagagggccagcgcccccacctttgacaatgactacagcctgtctgagctgctgagccagctggacagcggcgtgtcccaggccgtggagggccctgaggagctgagccgcagcagcagcgagagcaagctgcccagcagcggcagcggcaagaggctgtctggagtgtcctctgtggacagcgccttcagcagccggggcagcctgagcctgagctttgagcgggagcccagcaccagtgacctgggcaccacagatgtgcagaagaagaagctggtggatgccatcgtgtctggggacaccagcaagctgatgaagatcctgcagccccaggatgtggacctggccctggacagcggggccagcctgctgcacctggccgtggaggccggccaggaggagtgtgccaagtggctgctgctgaacaatgccaaccccaacctgagcaacagaagaggcagcacccccctgcacatggctgtggagcggcgggtgcggggcgtggtggagctgctgctggccaggaagatctctgtgaatgccaaggatgaggaccagtggacagccctgcactttgctgcccagaatggagatgagagcagcacccggctgctgctggagaagaatgcctctgtgaatgaggtggactttgagggccgcacccccatgcacgtggcctgccagcacggccaggagaacatcgtgcgcatcctgctgcggcggggcgtggatgtgtccctgcagggcaaggatgcctggcactgcaccaccctggccggccccccagcccaccggcaggccgccggccaggccgccggcggggagtgtgagaggccagatgctggctgggaggatgccatcgcccctggccgcacagcccgggccctgccccggggcccccacccccacaggcctgtgctgcggcggcagaggctgcagcctgctggaacagacaccccagcccggccccggcggcggggcacccgggccctgcccggctgcagctgcatcggggccctggcccggcggccctag

SEQ ID NO: 167355 - DNA, 2355 bp, Artificial Sequence
  Description of Artificial Sequence: Synthetic coding sequence
atggagggagatggcggcaccccctgggccctggccctgctgcggacctttgatgctggggagttcaccggctgggagaaggtgggcagcggcggcttcggccaggtgtacaaggtgagacatgtgcactggaagacctggctggccatcaagtgcagccccagcctgcacgtggatgaccgggagaggatggagctgctggaggaggccaagaagatggagatggccaagttccgctacatcctgcctgtgtatggcatctgccgggagcctgtgggcctggtgatggagtacatggagaccggcagcctggagaagctgctggccagcgagcccctgccctgggacctgcgcttccgcatcatccatgaaacagctgtgggcatgaacttcctgcactgcatggccccacccctgctgcacctggacctgaagccagccaacatcctgctggatgcccactaccacgtgaagatcagtgactttggcctggccaagtgcaatggcctgagccacagccatgacctgtccatggatggcctgtttggcaccatcgcctacctgcccccagagcgcatccgggagaagagccggctgtttgacaccaagcatgatgtgtacagctttgccatcgtcatctggggcgtgctgacccagaagaagccctttgctgatgagaagaacatcctgcacatcatggtgaaggtggtgaagggccacaggcctgagctgccccctgtgtgccgggcccggccccgggcctgcagccacctgatccggctgatgcagcgctgctggcagggcgacccccgggtgcggcccaccttccaggagatcaccagcgagacagaggacctgtgtgagaagccagatgatgaggtgaaggagacagcccatgacctggatgtgaagagccccccagagcccaggtctgaggtggtgcctgcccggctgaagagggccagcgcccccacctttgacaatgactacagcctgtctgagctgctgagccagctggacagcggcgtgtcccaggccgtggagggccctgaggagctgagccgcagcagcagcgagagcaagctgcccagcagcggcagcggcaagaggctgagcggcgtgtcctctgtggacagcgccttcagcagccggggcagcctgagcctgagctttgagcgggagcccagcaccagtgacctgggcaccacagatgtgcagaagaagaagctggtggatgccatcgtgtctggggacaccagcaagctgatgaagatcctgcagccccaggatgtggacctggccctggacagcggggccagcctgctgcacctggccgtggaggccggccaggaggagtgtgccaagtggctgctgctgaacaatgccaaccccaacctgagcaacagaagaggcagcacccccctgcacatggctgtggagaggagagtgcggggcgtggtggagctgctgctggccaggaagatctctgtgaatgccaaggatgaggaccagtggacagccctgcactttgctgcccagaatggagatgagagcagcacccggctgctgctggagaagaatgcctctgtgaatgaggtggactttgagggccgcacccccatgcacgtggcctgccagcacggccaggagaacatcgtgcgcatcctgctgcggcggggcgtggatgtgtccctgcagggcaaggatgcctggctgcccctgcactatgctgcctggcagggccacctgcccatcgtgaagctgctggccaagcagcccggggtgtctgtgaatgcccagaccctggatggccgcacccccctgcacctggccgcccagaggggccactacagagtggcccgcatcctgattgacctgtgcagtgatgtgaatgtgtgcagcctgctggcccagacccccctgcacgtggccgctgagaccggccacaccagcacagcccggctgctgctgcacagaggagctgggaaggaggccatgaccagtgatggctacacagccctgcacctggccgccagaaatggccacctggccaccgtgaagctgctggtggaggagaaggcagatgtgctggcccggggccccctgaaccagacagccctgcacctggccgccgcccacggccacagcgaggtggtggaggagctggtgtctgcagatgtgattgacctgtttgatgagcagggcctgagcgccctgcacctggccgcccagggcagacatgcccagacagtggagaccctgctgcggcatggagcccacatcaacctgcagagcctgaagttccagggcggccacggccctgctgccaccctgctgcggcgcagcaagacctag

SEQ ID NO: 167356 - DNA, 2499 bp, Artificial Sequence
  Description of Artificial Sequence: Synthetic coding sequence
atggagggagatggcggcaccccctgggccctggccctgctgcggacctttgatgctggggagttcaccggctgggagaaggtgggcagcggcggcttcggccaggtgtacaaggtgagacatgtgcactggaagacctggctggccatcaagtgcagccccagcctgcacgtggatgaccgggagaggatggagctgctggaggaggccaagaagatggagatggccaagttccgctacatcctgcctgtgtatggcatctgccgggagcctgtgggcctggtgatggagtacatggagaccggcagcctggagaagctgctggccagcgagcccctgccctgggacctgcgcttccgcatcatccatgaaacagctgtgggcatgaacttcctgcactgcatggccccacccctgctgcacctggacctgaagccagccaacatcctgctggatgcccactaccacgtgaagatcagtgactttggcctggccaagtgcaatggcctgagccacagccatgacctgtccatggatggcctgtttggcaccatcgcctacctgcccccagagcgcatccgggagaagagccggctgtttgacaccaagcatgatgtgtacagctttgccatcgtcatctggggcgtgctgacccagaagaagccctttgctgatgagaagaacatcctgcacatcatggtgaaggtggtgaagggccacaggcctgagctgccccctgtgtgccgggcccggccccgggcctgcagccacctgatccggctgatgcagcgctgctggcagggcgacccccgggtgcggcccaccttccagggcaatggcctgaatggagagctgatccggcaggtgctggccgccctgctgcctgtgacaggccgctggaggagccctggagagggcttccggctggagagcgaggtgatcatccgggtgacctgccccctgagcagcccccaggagatcaccagcgagacagaggacctgtgtgagaagccagatgatgaggtgaaggagacagcccatgacctggatgtgaagagccccccagagcccaggtctgaggtggtgcctgcccggctgaagagggccagcgcccccacctttgacaatgactacagcctgtctgagctgctgagccagctggacagcggcgtgtcccaggccgtggagggccctgaggagctgagccgcagcagcagcgagagcaagctgcccagcagcggcagcggcaagaggctgagcggcgtgtcctctgtggacagcgccttcagcagccggggcagcctgagcctgagctttgagcgggagcccagcaccagtgacctgggcaccacagatgtgcagaagaagaagctggtggatgccatcgtgtctggggacaccagcaagctgatgaagatcctgcagccccaggatgtggacctggccctggacagcggggccagcctgctgcacctggccgtggaggccggccaggaggagtgtgccaagtggctgctgctgaacaatgccaaccccaacctgagcaacagaagaggcagcacccccctgcacatggctgtggagaggagagtgcggggcgtggtggagctgctgctggccaggaagatctctgtgaatgccaaggatgaggaccagtggacagccctgcactttgctgcccagaatggagatgagagcagcacccggctgctgctggagaagaatgcctctgtgaatgaggtggactttgagggccgcacccccatgcacgtggcctgccagcacggccaggagaacatcgtgcgcatcctgctgcggcggggcgtggatgtgtccctgcagggcaaggatgcctggctgcccctgcactatgctgcctggcagggccacctgcccatcgtgaagctgctggccaagcagcccggggtgtctgtgaatgcccagaccctggatggccgcacccccctgcacctggccgcccagaggggccactacagagtggcccgcatcctgattgacctgtgcagtgatgtgaatgtgtgcagcctgctggcccagacccccctgcacgtggccgctgagaccggccacaccagcacagcccggctgctgctgcacagaggagctgggaaggaggccatgaccagtgatggctacacagccctgcacctggccgccagaaatggccacctggccaccgtgaagctgctggtggaggagaaggcagatgtgctggcccggggccccctgaaccagacagccctgcacctggccgccgcccacggccacagcgaggtggtggaggagctggtgtctgcagatgtgattgacctgtttgatgagcagggcctgagcgccctgcacctggccgcccagggcagacatgcccagacagtggagaccctgctgcggcatggagcccacatcaacctgcagagcctgaagttccagggcggccacggccctgctgccaccctgctgcggcgcagcaagacctag

SEQ ID NO: 167357 - DNA, 2166 bp, Artificial Sequence
  Description of Artificial Sequence: Synthetic coding sequence
atggagctgctggaggaggccaagaagatggagatggccaagttccgctacatcctgcctgtgtatggcatctgccgggagcctgtgggcctggtgatggagtacatggagaccggcagcctggagaagctgctggccagcgagcccctgccctgggacctgcgcttccgcatcatccacgagacagctgtgggcatgaacttcctgcactgcatggccccacccctgctgcacctggacctgaagccagccaacatcctgctggatgcccactaccacgtgaagatcagtgactttggcctggccaagtgcaatggcctgagccacagccatgacctgtccatggatggcctgtttggcaccatcgcctacctgcccccagagcgcatccgggagaagagccggctgtttgacaccaagcatgatgtgtacagctttgccatcgtcatctggggcgtgctgacccagaagaagccctttgctgatgagaagaacatcctgcacatcatggtgaaggtggtgaagggccacaggcctgagctgccccctgtgtgccgggcccggccccgggcctgcagccacctgatccggctgatgcagcgctgctggcagggcgacccccgggtgcggcccaccttccaggagatcaccagcgagacagaggacctgtgtgagaagccagatgatgaggtgaaggagacagcccatgacctggatgtgaagagccccccagagcccaggtctgaggtggtgcctgcccggctgaagagggccagcgcccccacctttgacaatgactacagcctgtctgagctgctgagccagctggacagcggcgtgtcccaggccgtggagggccctgaggagctgagccgcagcagcagcgagagcaagctgcccagcagcggcagcggcaagaggctgtctggagtgtcctctgtggacagcgccttcagcagccggggcagcctgagcctgagctttgagcgggagcccagcaccagtgacctgggcaccacagatgtgcagaagaagaagctggtggatgccatcgtgtctggggacaccagcaagctgatgaagatcctgcagccccaggatgtggacctggccctggacagcggggccagcctgctgcacctggccgtggaggccggccaggaggagtgtgccaagtggctgctgctgaacaatgccaaccccaacctgagcaacagaagaggcagcacccccctgcacatggctgtggagcggcgggtgcggggcgtggtggagctgctgctggccaggaagatctctgtgaatgccaaggatgaggaccagtggacagccctgcactttgctgcccagaatggagatgagagcagcacccggctgctgctggagaagaatgcctctgtgaatgaggtggactttgagggccgcacccccatgcacgtggcctgccagcacggccaggagaacatcgtgcgcatcctgctgcggcggggcgtggatgtgtccctgcagggcaaggatgcctggctgcccctgcactacgccgcctggcagggccacctgcccatcgtgaagctgctggccaagcagcccggggtgtctgtgaatgcccagaccctggatggccgcacccccctgcacctggccgcccagaggggccactacagagtggcccgcatcctgattgacctgtgcagtgatgtgaatgtgtgcagcctgctggcccagacccccctgcacgtggccgctgagaccggccacaccagcacagcccggctgctgctgcacagaggagctgggaaggaggccatgaccagtgatggctacacagccctgcacctggccgccagaaatggccacctggccaccgtgaagctgctggtggaggagaaggcagatgtgctggcccggggccccctgaaccagacagccctgcacctggccgccgcccacggccacagcgaggtggtggaggagctggtgtctgcagatgtgattgacctgtttgatgagcagggcctgagcgccctgcacctggccgcccagggcagacatgcccagacagtggagaccctgctgcggcacggggcccacatcaacctgcagagcctgaagttccagggcggccacggccctgctgccaccctgctgcggcgcagcaagacctag

SEQ ID NO: 167358 - DNA, 2166 bp, Artificial Sequence; identical to SEQ ID NO: 167357
  Description of Artificial Sequence: Synthetic coding sequence

SEQ ID NO: 167359 - DNA, 3132 bp, Artificial Sequence
  Description of Artificial Sequence: Synthetic coding sequence
atggccgccagcttcccccccaccctgggcctgagcagcgccccagatgagatccagcacccccacatcaagttcagcgagtggaagttcaagctgttccgggtgcgcagctttgagaagaccccagaggaggcccagaaggagaagaaggacagctttgagggcaagcccagcctggagcagagccctgctgtgctggacaaggcagatggccagaagcctgtgcccacccagcccctgctgaaggcccaccccaagttcagcaagaagttccatgacaatgagaaggcccggggcaaggccatccaccaggccaacctgcggcacctgtgccgcatctgtggcaacagcttccgggcagatgagcacaacagacgctaccctgtgcacggccctgtggatggcaagaccctgggcctgctgaggaagaaggagaagagggccacctcctggccagacctgattgccaaggtgttcagaattgatgtgaaggcagatgtggacagcatccaccccacagagttctgccacaactgctggagcatcatgcacaggaagttcagcagcgccccctgtgaggtgtacttccccagaaatgtgaccatggagtggcacccccacacccccagctgtgacatctgcaacacagcccggcggggcctgaagaggaagagcctgcagcccaacctgcagctgagcaagaagctgaagacagtgctggaccaggcccggcaggcccggcagcacaagagaagagcccaggcccgcatcagcagcaaggatgtgatgaagaagatcgccaactgcagcaagatccacctgagcaccaagctgctggccgtggacttccctgagcactttgtgaagagcatcagctgccagatctgtgagcacatcctggccgaccctgtggagaccaactgcaagcacgtgttctgccgggtgtgcatcctgcgctgcctgaaggtgatgggcagctactgccccagctgccgctacccctgcttccccacagacctggagagccctgtgaagagcttcctgtctgtgctgaacagcctgatggtgaagtgcccagccaaggagtgcaatgaggaggtgtccctggagaagtacaaccaccacatcagcagccacaaggagagcaaggagatctttgtgcacatcaacaagggcggccggccccggcagcacctgctgagcctgacccggcgggcccagaagcaccggctgcgggagctgaagctgcaggtgaaggcctttgctgacaaggaggagggcggagatgtgaagtctgtgtgcatgaccctcttcctgctggccctgcgggccagaaatgagcaccggcaggctgatgagctggaggccatcatgcagggcaaaggaagtggcctgcagcctgctgtgtgcctggccatccgggtgaacaccttcctgagctgcagccagtaccacaagatgtacagaacagtgaaggccatcaccggccggcagatcttccagcccctgcacgccctgagaaatgctgagaaggtgctgctgcccggctaccaccactttgagtggcagccccccctgaagaatgtgagcagcagcacagatgtgggcatcattgatggcctgagcggcctgagcagctctgtggatgactaccctgtggacaccatcgccaagcgcttccgctatgacagcgccctggtgtctgccctgatggacatggaggaggacatcctggagggcatgaggagccaggacctggatgactacctgaatggccccttcaccgtggtggtgaaggagagctgtgatggcatgggagatgtgtctgagaagcacggcagcggccctgtggtgcctgagaaggctgtgcgcttctccttcaccatcatgaagatcaccatcgcccacagcagccagaatgtgaaggtgtttgaggaggccaagcccaacagcgagctgtgctgcaagcccctgtgcctgatgctggctgatgaaagtgaccacgagaccctgacagccatcctgagccccctgattgctgagcgggaggccatgaagagcagcgagctgatgctggagctgggcggcatcctgcggaccttcaagttcatcttccggggcaccggctatgatgagaagctggtgcgggaggtggagggcctggaggccagcggctctgtgtacatctgcaccctgtgtgatgccacccggctggaggccagccagaacctggtgttccacagcatcaccaggagccatgctgagaacctggagagatatgaggtgtggaggagcaacccctaccatgaatctgtggaggagctgcgggacagagtgaagggcgtgtctgccaagcccttcatcgagaccgtgcccagcattgatgccctgcactgtgacattggaaatgctgctgagttctacaagatcttccagctggagattggagaggtgtacaagaaccccaatgccagcaaggaggagaggaagcgctggcaggccaccctggacaagcacctgaggaagaagatgaacctgaagcccatcatgaggatgaatggaaactttgccaggaagctgatgaccaaggagaccgtggatgctgtgtgtgagctgatccccagcgaggagagacatgaggccctgcgggagctgatggacctgtacctgaagatgaagcctgtgtggaggagcagctgcccagccaaggagtgcccagagagcctgtgccagtacagcttcaacagccagagatttgctgagctgctgagcaccaagttcaagtaccgctatgagggcaagatcaccaactacttccacaagaccctggcccacgtgcctgagatcatcgagagagatggcagcatcggggcctgggccagcgagggcaatgaaagtggcaacaagctgttccgccgcttcaggaagatgaatgcccggcagagcaaatgttatgagatggaggatgtgctgaagcaccactggctgtacaccagcaagtacctgcagaagttcatgaatgcccacaatgccctgaagaccagcggcttcaccatgaacccccaggccagcctgggggaccccctgggcatcgaggacagcctggagagccaggacagcatggagttctag

SEQ ID NO: 167360 - DNA, 1584 bp, Artificial Sequence
  Description of Artificial Sequence: Synthetic coding sequence
atgagcctgcagatggtgacagtgagcaacaacatcgccctgatccagcccggcttcagcctgatgaactttgatggccaggtgttcttcttcggccagaagggctggcccaagaggagctgccccactggagtcttccacctggatgtgaagcacaaccacgtgaagctgaagcccaccatcttcagcaaggacagctgctacctgccccccctgcgctacccagccacctgcaccttcaagggcagcctggagagcgagaagcaccagtacatcatccacggcggcaagacccccaacaatgaggtgtctgacaagatctacgtgatgagcatcgtgtgcaagaacaacaagaaggtgaccttccgctgcacagagaaggacctggtgggagatgtgcctgaggcccgctatggccacagcatcaacgtggtgtacagccggggcaagtccatgggcgtgctgtttggaggccgcagctacatgcccagcacccacaggaccacagagaagtggaacagcgtggccgactgcctgccctgtgtgttcctggtggactttgaatttggctgtgccaccagctacatcctgcctgagctgcaggacggcctgtccttccacgtgtccatcgccaagaatgacaccatctacatcctgggcggccacagcctggccaacaacatccggcctgccaacctgtaccgcatccgggtggacctgcccctgggcagccctgctgtgaactgcaccgtgctgcccggcggcatctctgtgagcagcgccatcctgacccagaccaacaatgatgaatttgtgattgtgggcggctaccagctggagaaccagaagaggatgatctgcaacatcatcagcctggaggacaacaagattgagatccgggagatggagaccccagactggaccccagacatcaagcacagcaagatctggtttggcagcaacatgggaaatggcaccgtcttcctgggcatccctggggacaacaagcaggtggtgtctgagggcttctacttctacatgctgaagtgtgccgaggatgacaccaatgaggagcagaccaccttcaccaacagccagaccagcacagaggaccccggggacagcaccccatttgaagattctgaggagttctgcttctctgctgaggccaacagctttgatggagatgatgaatttgacacctacaatgaagatgatgaggaggatgaaagtgaaacaggctactggatcacctgctgccccacctgtgatgtggacatcaacacctgggtgcccttctacagcacagagctgaacaagccagccatgatctactgcagccatggagatggccactgggtgcacgcccagtgcatggacctggccgagaggaccctcatccacctgtctgctggcagcaacaagtactactgcaatgaacatgtggagatcgcccgggccctgcacaccccccagagggtgctgcccctgaagaagccacccatgaagagcctgaggaagaagggcagcggcaagatcctgaccccagccaagaagagcttcctgcggcggctgtttgattag

SEQ ID NO: 167361 - DNA, 216 bp, Artificial Sequence
  Description of Artificial Sequence: Synthetic coding sequence
atgagcctgcagatggtgacagtgagcaacaacatcgccctgatccagcccggcttcagcctgatgaactttgatggccaggtgttcttcttcggccagaagggctggcccaagaggagctgccccactggagtcttccacctggatgtgaagcacaaccacgtgaagctgaagcccaccatcttcagcaaggacagctgctacctgcccccatag

SEQ ID NO: 167362 - DNA, 453 bp, Artificial Sequence
  Description of Artificial Sequence: Synthetic coding sequence
atgagcctgcagatggtgacagtgagcaacaacatcgccctgatccagcccggcttcagcctgatgaactttgatggccaggtgttcttcttcggccagaagggctggcccaagaggagctgccccactggagtcttccacctggatgtgaagcacaaccacgtgaagctgaagcccaccatcttcagcaaggacagctgctacctgccccccctgcgctacccagccacctgcaccttcaagggcagcctggagagcgagaagcaccagtacatcatccacggcggcaagacccccaacaatgaggtgtctgacaagatctacgtgatgagcatcgtgtgcaagaacaacaagaaggtgaccttccgctgcacagagaaggacctggtgggagatgtgcctgaggcccgctatggccacagcatcaacgtggtgtacagccggggcaagtag

SEQ ID NO: 167363 - DNA, 6 bp, Artificial Sequence
  Description of Artificial Sequence: Synthetic coding sequence
atgtag

SEQ ID NO: 167364 - DNA, 1503 bp, Artificial Sequence
  Description of Artificial Sequence: Synthetic coding sequence
atggaccacacagagggcagccctgctgaggagcccccagcccacgcccccagccctgggaagtttggagagcggcccccacccaagaggctgacccgggaggccatgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactactgcacagccaagaccctgtacatcagtgacagcgacaagaggaagcacttcatgctgtctgtgaagatgttttatggcaacagtgatgacattggagtcttcctgagcaagaggatcaaggtgatcagcaagcccagcaagaagaagcagagcctgaagaatgctgacctgtgcatcgccagcggcaccaaggtggccctcttcaaccggctgcggagccagacagtgtccacccgctacctgcacgtggagggcggcaacttccacgccagcagccagcagtggggcgccttcttcatccacctgctggatgatgatgagagcgagggggaggagttcaccgtgagagatggctacatccactacggccagacagtgaagctggtgtgcagcgtgacaggcatggccctgcccaggctcatcatcaggaaggtggacaagcagacagccctgctggatgctgatgatcctgtgtcccagctgcacaagtgtgccttctacctgaaggacacagagaggatgtacctgtgcctgagccaggagcgcatcatccagttccaggccaccccctgccccaaggagcccaacaaggagatgatcaatgatggagcctcctggaccatcatcagcacagacaaggccgagtacaccttctatgagggcatgggccctgtgctggcccctgtgacccctgtgcctgtggtggagagcctgcagctgaatggaggaggagatgtggccatgctggagctgaccggccagaacttcacccccaacctgcgggtgtggtttggagatgtggaggccgagaccatgtaccgctgtggggagagcatgctgtgtgtggtgcctgacatcagcgccttccgggagggctggcgctgggtgcggcagcctgtgcaggtgcctgtgaccctggtgagaaatgatggcatcatctacagcaccagcctgaccttcacctacaccccagagcccggcccccggccccactgcagcgctgctggggccatcctgcgggccaacagcagccaggtgcccccaaatgaaagcaacaccaacagcgagggcagctacaccaatgccagcaccaacagcacctctgtgaccagcagcacagccaccgtggtgtcctag

SEQ ID NO: 167365 - DNA, 1461 bp, Artificial Sequence
  Description of Artificial Sequence: Synthetic coding sequence
atggcctggatcaagaggaagtttggagagcggcccccacccaagaggctgacccgggaggccatgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactactgcacagccaagaccctgtacatcagtgacagcgacaagaggaagcacttcatgctgtctgtgaagatgttttatggcaacagtgatgacattggagtcttcctgagcaagaggatcaaggtgatcagcaagcccagcaagaagaagcagagcctgaagaatgctgacctgtgcatcgccagcggcaccaaggtggccctcttcaaccggctgcggagccagacagtgtccacccgctacctgcacgtggagggcggcaacttccacgccagcagccagcagtggggcgccttcttcatccacctgctggatgatgatgagagcgagggggaggagttcaccgtgagagatggctacatccactacggccagacagtgaagctggtgtgcagcgtgacaggcatggccctgcccaggctcatcatcaggaaggtggacaagcagacagccctgctggatgctgatgatcctgtgtcccagctgcacaagtgtgccttctacctgaaggacacagagaggatgtacctgtgcctgagccaggagcgcatcatccagttccaggccaccccctgccccaaggagcccaacaaggagatgatcaatgatggagcctcctggaccatcatcagcacagacaaggccgagtacaccttctatgagggcatgggccctgtgctggcccctgtgacccctgtgcctgtggtggagagcctgcagctgaatggaggaggagatgtggccatgctggagctgaccggccagaacttcacccccaacctgcgggtgtggtttggagatgtggaggccgagaccatgtaccgctgtggggagagcatgctgtgtgtggtgcctgacatcagcgccttccgggagggctggcgctgggtgcggcagcctgtgcaggtgcctgtgaccctggtgagaaatgatggcatcatctacagcaccagcctgaccttcacctacaccccagagcccggcccccggccccactgcagcgctgctggggccatcctgcgggccaacagcagccaggtgcccccaaatgaaagcaacaccaacagcgagggcagctacaccaatgccagcaccaacagcacctctgtgaccagcagcacagccaccgtggtgtcctag

SEQ ID NO: 167366 - DNA, 1458 bp, Artificial Sequence
  Description of Artificial Sequence: Synthetic coding sequence
atgggcggctgcaggaagtttggagagcggcccccacccaagaggctgacccgggaggccatgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactactgcacagccaagaccctgtacatcagtgacagcgacaagaggaagcacttcatgctgtctgtgaagatgttctacggcaacagtgatgacatcggggtcttcctgagcaagaggatcaaggtgatcagcaagcccagcaagaagaagcagagcctgaagaatgctgacctgtgcatcgccagcggcaccaaggtggccctcttcaaccggctgcggagccagacagtgtccacccgctacctgcacgtggagggcggcaacttccacgccagcagccagcagtggggcgccttcttcatccacctgctggatgatgatgaaagtgaaggagaggagttcaccgtgagagatggctacatccactacggccagacagtgaagctggtgtgcagcgtgacaggcatggccctgcccaggctcatcatcaggaaggtggacaagcagacagccctgctggatgctgatgatcctgtgtcccagctgcacaagtgtgccttctacctgaaggacacagagaggatgtacctgtgcctgagccaggagcgcatcatccagttccaggccaccccctgccccaaggagcccaacaaggagatgatcaatgatggagcctcctggaccatcatcagcacagacaaggccgagtacaccttctatgagggcatgggccctgtgctggcccctgtgacccctgtgcctgtggtggagagcctgcagctgaatggaggaggagatgtggccatgctggagctgaccggccagaacttcacccccaacctgcgggtgtggtttggagatgtggaggccgagaccatgtaccgctgtggggagagcatgctgtgtgtggtgcctgacatcagcgccttccgggagggctggcgctgggtgcggcagcctgtgcaggtgcctgtgaccctggtgagaaatgatggcatcatctacagcaccagcctgaccttcacctacaccccagagcccggcccccggccccactgcagcgctgctggggccatcctgcgggccaacagcagccaggtgcccccaaatgaaagcaacaccaacagcgagggcagctacaccaatgccagcaccaacagcacctctgtgaccagcagcacagccaccgtggtgtcctag

SEQ ID NO: 167367 - DNA, 1464 bp, Artificial Sequence
  Description of Artificial Sequence: Synthetic coding sequence
atggcccctgtggtgacaggcaagtttggagagcggcccccacccaagaggctgacccgggaggccatgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactactgcacagccaagaccctgtacatcagtgacagcgacaagaggaagcacttcatgctgtctgtgaagatgttctacggcaacagtgatgacatcggggtcttcctgagcaagaggatcaaggtgatcagcaagcccagcaagaagaagcagagcctgaagaatgctgacctgtgcatcgccagcggcaccaaggtggccctcttcaaccggctgcggagccagacagtgtccacccgctacctgcacgtggagggcggcaacttccacgccagcagccagcagtggggcgccttcttcatccacctgctggatgatgatgaaagtgaaggagaggagttcaccgtgagagatggctacatccactacggccagacagtgaagctggtgtgcagcgtgacaggcatggccctgcccaggctcatcatcaggaaggtggacaagcagacagccctgctggatgctgatgatcctgtgtcccagctgcacaagtgtgccttctacctgaaggacacagagaggatgtacctgtgcctgagccaggagcgcatcatccagttccaggccaccccctgccccaaggagcccaacaaggagatgatcaatgatggagcctcctggaccatcatcagcacagacaaggccgagtacaccttctatgagggcatgggccctgtgctggcccctgtgacccctgtgcctgtggtggagagcctgcagctgaatggaggaggagatgtggccatgctggagctgaccggccagaacttcacccccaacctgcgggtgtggtttggagatgtggaggccgagaccatgtaccgctgtggggagagcatgctgtgtgtggtgcctgacatcagcgccttccgggagggctggcgctgggtgcggcagcctgtgcaggtgcctgtgaccctggtgagaaatgatggcatcatctacagcaccagcctgaccttcacctacaccccagagcccggcccccggccccactgcagcgctgctggggccatcctgcgggccaacagcagccaggtgcccccaaatgaaagcaacaccaacagcgagggcagctacaccaatgccagcaccaacagcacctctgtgaccagcagcacagccaccgtggtgtcctag

SEQ ID NO: 167368 - DNA, 1461 bp, Artificial Sequence; identical to SEQ ID NO: 167365
  Description of Artificial Sequence: Synthetic coding sequence

SEQ ID NO: 167369 - DNA, 1503 bp, Artificial Sequence; identical to SEQ ID NO: 167364
  Description of Artificial Sequence: Synthetic coding sequence

SEQ ID NO: 167370 - DNA, 432 bp, Artificial Sequence
  Description of Artificial Sequence: Synthetic coding sequence
atgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactactgcacagccaagaccctgtacatcagtgacagcgacaagaggaagcacttcatgctgtctgtgaagatgttctacggcaacagtgatgacatcggggtcttcctgagcaagaggatcaaggtgatcagcaagcccagcaagaagaagcagagcctgaagaatgctgactag

SEQ ID NO: 167371 - DNA, 87 bp, Artificial Sequence
  Description of Artificial Sequence: Synthetic coding sequence
atggcctggatcaagaggaagtttggagagcggcccccacccaagaggctgacccgggaggccatgaggaactacctgaaggagtag

SEQ ID NO: 167372 - DNA, 294 bp, Artificial Sequence
  Description of Artificial Sequence: Synthetic coding sequence
atggcctggatcaagaggaagtttggagagcggcccccacccaagaggctgacccgggaggccatgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagtag

SEQ ID NO: 167373 - DNA, 1398 bp, Artificial Sequence
  Description of Artificial Sequence: Synthetic coding sequence
atgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactactgcacagccaagaccctgtacatcagtgacagcgacaagaggaagcacttcatgctgtctgtgaagatgttctacggcaacagtgatgacatcggggtcttcctgagcaagaggatcaaggtgatcagcaagcccagcaagaagaagcagagcctgaagaatgctgacctgtgcatcgccagcggcaccaaggtggccctcttcaaccggctgcggagccagacagtgtccacccgctacctgcacgtggagggcggcaacttccacgccagcagccagcagtggggcgccttcttcatccacctgctggatgatgatgaaagtgaaggagaggagttcaccgtgagagatggctacatccactacggccagacagtgaagctggtgtgcagcgtgacaggcatggccctgcccaggctcatcatcaggaaggtggacaagcagacagccctgctggatgctgatgatcctgtgtcccagctgcacaagtgtgccttctacctgaaggacacagagaggatgtacctgtgcctgagccaggagcgcatcatccagttccaggccaccccctgccccaaggagcccaacaaggagatgatcaatgatggagcctcctggaccatcatcagcacagacaaggccgagtacaccttctatgagggcatgggccctgtgctggcccctgtgacccctgtgcctgtggtggagagcctgcagctgaatggaggaggagatgtggccatgctggagctgaccggccagaacttcacccccaacctgcgggtgtggtttggagatgtggaggccgagaccatgtaccgctgtggggagagcatgctgtgtgtggtgcctgacatcagcgccttccgggagggctggcgctgggtgcggcagcctgtgcaggtgcctgtgaccctggtgagaaatgatggcatcatctacagcaccagcctgaccttcacctacaccccagagcccggcccccggccccactgcagcgctgctggggccatcctgcgggccaacagcagccaggtgcccccaaatgaaagcaacaccaacagcgagggcagctacaccaatgccagcaccaacagcacctctgtgaccagcagcacagccaccgtggtgtcctag

SEQ ID NO: 167374 - DNA, 474 bp, Artificial Sequence
  Description of Artificial Sequence: Synthetic coding sequence
atgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactactgcacagccaagaccctgtacatcagtgacagcgacaagaggaagcacttcatgctgtctgtgaagatgttctacggcaacagtgatgacatcggggtcttcctgagcaagaggatcaaggtgatcagcaagcccagcaagaagaagcagagcctgaagaatgctgacctgtgcatcgccagcggcaccaaggtggccctcttcaacagatag

SEQ ID NO: 167375 - DNA, 150 bp, Artificial Sequence
  Description of Artificial Sequence: Synthetic coding sequence
atggcctggatcaagaggaagtttggagagcggcccccacccaagaggctgacccgggaggccatgaggaactacctgaaggagcggggggaccagacagtgctgatcctgcacgccaaggtggcccagaagagctatggaaatgaatag

SEQ ID NO: 167376 - DNA, 324 bp, Artificial Sequence
  Description of Artificial Sequence: Synthetic coding sequence
atggcctggatcaagaggaagtttggagagcggcccccacccaagaggctgacccgggaggccatgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactag

SEQ ID NO: 167377 - DNA, 285 bp, Artificial Sequence
  Description of Artificial Sequence: Synthetic coding sequence
atggcctggatcaagaggaagtttggagagcggcccccacccaagaggctgacccgggaggccatgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagctag

SEQ ID NO: 167378 - DNA, 537 bp, Artificial Sequence
  Description of Artificial Sequence: Synthetic coding sequence
atggaccacacagagggcagccctgctgaggagcccccagcccacgcccccagccctgggaagtttggagagcggcccccacccaagaggctgacccgggaggccatgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactactgcacagccaagaccctgtacatcagtgacagcgacaagaggaagcacttcatgctgtctgtgaagatgttttatggcaacagtgatgacattggagtcttcctgagcaagaggatcaaggtgatcagcaagcccagcaagaagaagcagagcctgaagaatgctgactag

SEQ ID NO: 167379 - DNA, 333 bp, Artificial Sequence
  Description of Artificial Sequence: Synthetic coding sequence
atggcctggatcaagaggaagtttggagagcggcccccacccaagaggctgacccgggaggccatgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactactgcacctag

SEQ ID NO: 167380 - DNA, 342 bp, Artificial Sequence
  Description of Artificial Sequence: Synthetic coding sequence
atggcctggatcaagaggaagtttggagagcggcccccacccaagaggctgacccgggaggccatgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactactgcacagccaagacctag

SEQ ID NO: 167381 - DNA, 147 bp, Artificial Sequence
  Description of Artificial Sequence: Synthetic coding sequence
atggcctggatcaagaggaagtttggagagcggcccccacccaagaggctgacccgggaggccatgaggaactacctgaaggagcggggggaccagacagtgctgatcctgcacgccaaggtggcccagaagagctatggcaactag

SEQ ID NO: 167382 - DNA, 570 bp, Artificial Sequence
  Description of Artificial Sequence: Synthetic coding sequence
atgaggaactacctgaaggagcggggggaccagacagtgctgatcctgcacgccaaggtggcccagaagagctatggaaatgagaagcgcttcttctgccccccaccctgtgtgtacctgatgggcagcggctggaagaagaagaaggagcagatggagagagatggctgcagcgagcaggagagccagccctgtgccttcatcggcatcggcaacagcgaccaggagatgcagcagctgaacctggagggcaagaactactgcacagccaagaccctgtacatcagtgacagcgacaagaggaagcacttcatgctgtctgtgaagatgttctacggcaacagtgatgacatcggggtcttcctgagcaagaggatcaaggtgatcagcaagcccagcaagaagaagcagagcctgaagaatgctgacctgtgcatcgccagcggcaccaaggtggccctcttcaaccggctgcggagccagacagtgtccacccgctacctgcacgtggagggcggcaacttccacgccagcagccagcagtggggcgccttcttcatccacctgtag

SEQ ID NO: 167383 - DNA, 600 bp, Artificial Sequence
  Description of Artificial Sequence: Synthetic coding sequence
atggcctctgtgtctgccctgacagaggagctggacagcatcaccagcgagctgcatgctgtggagatccagatccaggagctgacagagcggcagcaggagctgatccagaagaagaaggtgctgaccaagaagatcaagcagtgcctggaggacagtgatgctggggccagcaatgaatatgacagcagccctgctgcctggaacaaggaggacttcccctggagcggcaaggtgaaggacatcctgcagaatgtgttcaagctggagaagttccggcccctgcagctggagaccatcaacgtgaccatggccggcaaggaggtgttcctggtgatgcccactggaggcggcaagagcctgtgctaccagctgcctgccctgtgcagtgatggcttcaccctggtgatctgccccctcatcagcctgatggaggaccagctgatggtgctgaagcagctgggcatcagcgccaccatgctgaatgccagcagcagcaaggagcacgtgaagtgggtgcatgctgagatggtgaacaagaacagcgagctgaagctgatctacgtgaccccagagaagatcgccaagagcaagatgtag

SEQ ID NO: 167384 - DNA, 636 bp, Artificial Sequence
  Description of Artificial Sequence: Synthetic coding sequence
atggcctctgtgtctgccctgacagaggagctggacagcatcaccagcgagctgcatgctgtggagatccagatccaggagctgacagagcggcagcaggagctgatccagaagaagaaggtgctgaccaagaagatcaagcagtgcctggaggacagtgatgctggggccagcaatgaatatgacagcagccctgctgcctggaacaaggaggacttcccctggagcggcaaggtgaaggacatcctgcagaatgtgttcaagctggagaagttccggcccctgcagctggagaccatcaacgtgaccatggccggcaaggaggtgttcctggtgatgcccactggaggcggcaagagcctgtgctaccagctgcctgccctgtgcagtgatggcttcaccctggtgatctgccccctcatcagcctgatggaggaccagctgatggtgctgaagcagctgggcatcagcgccaccatgctgaatgccagcagcagcaaggagcacgtgaagtgggtgcatgctgagatggtgaacaagaacagcgagctgaagctgatctacgtgaccccagagaagatcgccaagagcaagatgttcatgagccggctggagaaggcctatgaggccaggtag

SEQ ID NO: 167385 - DNA, 1950 bp, Artificial Sequence
  Description of Artificial Sequence: Synthetic coding sequence
atggcctctgtgtctgccctgacagaggagctggacagcatcaccagcgagctgcatgctgtggagatccagatccaggagctgacagagcggcagcaggagctgatccagaagaagaaggtgctgaccaagaagatcaagcagtgcctggaggacagtgatgctggggccagcaatgaatatgacagcagccctgctgcctggaacaaggaggacttcccctggagcggcaaggtgaaggacatcctgcagaatgtgttcaagctggagaagttccggcccctgcagctggagaccatcaacgtgaccatggccggcaaggaggtgttcctggtgatgcccactggaggcggcaagagcctgtgctaccagctgcctgccctgtgcagtgatggcttcaccctggtgatctgccccctcatcagcctgatggaggaccagctgatggtgctgaagcagctgggcatcagcgccaccatgctgaatgccagcagcagcaaggagcacgtgaagtgggtgcatgctgagatggtgaacaagaacagcgagctgaagctgatctacgtgaccccagagaagatcgccaagagcaagatgttcatgagccggctggagaaggcctatgaggcccggcgcttcaccagaattgctgtggatgaggtgcactgctgcagccagtggggccatgacttccggccagactacaaggccctgggcatcctgaagaggcagttccccaatgccagcctgattggcctgacagccacagccaccaaccacgtgctgacagatgcccagaagatcctgtgcatcgagaagtgcttcaccttcaccgccagcttcaaccggcccaacctgtactatgaggtgcggcagaagcccagcaacacagaggacttcatcgaggacatcgtgaagctgatcaatggccgctacaagggccagagcggcatcatctactgcttcagccagaaggacagcgagcaggtgacagtgtccctgcagaacctgggcatccatgctggggcctaccacgccaacctggagcctgaggacaagaccaccgtgcacaggaagtggagcgccaatgagatccaggtggtggtggccaccgtggccttcggcatgggcatcgacaagccagatgtgcgctttgtgatccaccacagcatgagcaagtccatggagaactactaccaggagagcggccgggccggcagagatgacatgaaggctgactgcatcctgtactacggctttggagacatcttccgcatcagctccatggtggtgatggagaatgtgggccagcagaagctgtatgagatggtgtcctactgccagaacatcagcaagtgccggcgggtgctgatggcccagcactttgatgaggtgtggaacagcgaggcctgcaacaagatgtgtgacaactgctgcaaggacagcgcctttgagaggaagaacatcacagagtactgccgggacctgatcaagatcctgaagcaggccgaggagctgaatgagaagctgacccccctgaagctgattgacagctggatgggcaagggggccgccaagctgcgggtggccggcgtggtggcccccaccctgccccgggaggacctggagaagatcatcgcccacttcctgatccagcagtacctgaaggaggactacagcttcaccgcctatgccaccatctcctacctgaagattggccccaaggccaacctgctgaacaatgaggcccacgccatcaccatgcaggtgaccaagagcacccagaacagcttccgggcagagagcagccagacctgccacagcgagcagggcgacaagaagatggaggagaagaacagcggcaacttccagaagaaggccgccaacatgctgcagcagagcggcagcaagaacacaggagccaagaagaggaagattgatgatgcctag

SEQ ID NO: 167386 - DNA, 1950 bp, Artificial Sequence; identical to SEQ ID NO: 167385
  Description of Artificial Sequence: Synthetic coding sequence

SEQ ID NO: 167387 - DNA, 321 bp, Artificial Sequence
  Description of Artificial Sequence: Synthetic coding sequence
atggcctctgtgtctgccctgacagaggagctggacagcatcaccagcgagctgcatgctgtggagatccagatccaggagctgacagagcggcagcaggagctgatccagaagaagaaggtgctgaccaagaagatcaagcagtgcctggaggacagtgatgctggggccagcaatgaatatgacagcagccctgctgcctggaacaaggaggacttcccctggagcggcaaggtgaaggacatcctgcagaatgtgttcaagctggagaagttccggcccctgcagctggagaccatcaacgtgaccatggccggctag

SEQ ID NO: 167388 - DNA, 294 bp, Artificial Sequence
  Description of Artificial Sequence: Synthetic coding sequence
atggcctctgtgtctgccctgacagaggagctggacagcatcaccagcgagctgcatgctgtggagatccagatccaggagctgacagagcggcagcaggagctgatccagaagaagaaggtgctgaccaagaagatcaagcagtgcctggaggacagtgatgctggggccagcaatgaatatgacagcagccctgctgcctggaacaaggaggacttcccctggagcggcaaggtgaaggacatcctgcagaatgtgttcaagctggagaagttccggcccctgcagctgtag

SEQ ID NO: 167389 - DNA, 219 bp, Artificial Sequence
  Description of Artificial Sequence: Synthetic coding sequence
atggcctctgtgtctgccctgacagaggagctggacagcatcaccagcgagctgcatgctgtggagatccagatccaggagctgacagagcggcagcaggagctgatccagaagaagaaggtgctgaccaagaagatcaagcagtgcctggaggacagtgatgctggggccagcaatgaatatgacagcagccctgctgcctggaacaaggaggactag

SEQ ID NO: 167390 - DNA, 396 bp, Artificial Sequence
  Description of Artificial Sequence: Synthetic coding sequence
atggcctctgtgtctgccctgacagaggagctggacagcatcaccagcgagctgcatgctgtggagatccagatccaggagctgacagagcggcagcaggagctgatccagaagaagaaggtgctgaccaagaagatcaagcagtgcctggaggacagtgatgctggggccagcaatgaatatgacagcagccctgctgcctggaacaaggaggacttcccctggagcggcaaggtgaaggacatcctgcagaatgtgttcaagctggagaagttccggcccctgcagctggagaccatcaacgtgaccatggccggcaaggaggtgttcctggtgatgcccactggaggcggcaagagcctgtgctaccagctgcctgccctgtgcagcgactag

SEQ ID NO: 167391 - DNA, 2976 bp, Artificial Sequence
  Description of Artificial Sequence: Synthetic coding sequence
atgagcagccaccacaccaccttcccctttgatcctgagcggcgggtgcgcagcaccctgaagaaggtgtttggatttgacagcttcaagacccccctgcaggagagcgccaccatggctgtggtgaagggcaacaaggatgtgtttgtgtgcatgcccaccggggccggcaagagcctgtgctaccagctgcctgccctgctggccaagggcatcaccatcgtggtgagccccctcatcgccctgatccaggaccaggtggaccacctgctgaccctgaaggtgcgggtgagcagcctgaacagcaagctgagcgcccaggagaggaaggagctgctggccgacctggagcgggagaagccccagaccaagatcctgtacatcaccccagagatggccgccagcagcagcttccagcccaccctgaacagcctggtgagccgccacctgctgagctacctggtggtggatgaggcccactgtgtgtcccagtggggccatgacttccggccagactacctgcggctgggcgccctgcggagccggctgggccacgccccctgtgtggccctgacagccacagccaccccccaggtgcaggaggatgtgtttgctgccctgcacctgaagaagcctgtggccatcttcaagaccccctgcttccgggccaacctcttctatgatgtgcagttcaaggagctgatcagtgacccctacggcaacctgaaggacttctgcctgaaggccctgggccaggaggccgacaagggcctgagcggctgcggcatcgtgtactgcaggacccgggaggcctgtgagcagctggccatcgagctgagctgccggggcgtgaatgccaaggcctaccacgccggcctgaaggccagcgagaggaccctggtgcagaatgactggatggaggagaaggtgcctgtgattgtggccaccatcagctttggcatgggcgtggacaaggccaacgtgcgctttgtggcccactggaacatcgccaagtccatggccggctactaccaggagagcggccgggccggcagagatggcaagcccagctggtgccgcctgtactacagcagaaatgaccgggaccaggtgtccttcctgatcaggaaggaggtggccaagctgcaggagaagaggggcaacaaggccagtgacaaggccaccatcatggcctttgatgccctggtgaccttctgtgaggagctgggctgcagacatgctgccatcgccaagtactttggagatgccctgcctgcctgtgccaagggctgtgaccactgccagaaccccacagctgtgagaagaaggctggaggccctggagaggagcagctcctggagcaagacctgcatcggccccagccagggcaatggatttgatcctgagctgtatgaaggaggcaggaagggctacggggacttcagccgctatgatgagggcagcggcggcagcggagatgagggcagagatgaggcccacaagcgggagtggaacctcttctaccagaagcagatgcagctgaggaagggcaaggaccccaagattgaggagtttgtgcccccagatgagaactgccccctgaaggaggccagcagccgccgcatcccccggctgactgtgaaggcccgggagcactgcctgcggctgctggaggaggccctgagcagcaaccggcagagcaccaggacagcagatgaggccgacctgcgggccaaggctgtggagctggagcacgagaccttcagaaatgccaaggtggccaacctgtacaaggcctctgtgctgaagaaggtggccgacatccaccgggccagcaaggatggccagccctatgacatgggcggcagcgccaagagctgcagcgcccaggccgagcccccagagcccaatgaatatgacatccccccagccagccacgtgtacagcctgaagcccaagagggtgggcgccggcttccccaagggcagctgccccttccagacagccacagagctgatggagaccacccgcatccgggagcaggccccccagcctgagcggggcggggagcacgagccccccagccggccctgtggcctgctggatgaagatggcagcgagcccctgcccggccccagaggagaggtgcctgggggcagcgcccactatggaggccccagccctgagaagaaggccaagagcagcagcggcggcagcagcctggccaagggccgggccagcaagaagcagcagctgctggccacagctgcccacaaggacagccagagcatcgcccgcttcttctgccggcgggtggagagccctgccctgctggccagcgcccctgaggccgagggcgcctgccccagctgtgaaggagtgcagggcccccccatggcccctgagaagtacacaggagaggaggatggagctgggggccacagccctgccccaccccagacagaagaatgtctgcgggagcggcccagcacctgccccccccgggaccagggcaccccagaggtgcagcccaccccagccaaggacacctggaagggcaagaggcccaggagccagcaggagaaccctgagagccagccccagaagaggccccggcccagcgccaagcccagcgtggtggccgaggtgaagggctctgtgtctgccagcgagcagggcaccctgaaccccacagcccaggaccccttccagctgagcgcccctggggtgtccctgaaggaggccgccaacgtggtggtgaagtgcctgacccccttctacaaggagggcaagtttgccagcaaggagctgttcaagggctttgcccggcacctgagccacctgctgacccagaagaccagccctggccgctctgtgaaggaggaggcccagaacctgatccgccacttcttccacggccgggcccgctgtgagagcgaggccgactggcacggcctgtgtggcccccagaggtag

SEQ ID NO: 167392 - DNA, 1308 bp, Artificial Sequence
  Description of Artificial Sequence: Synthetic coding sequence
atgagcagccaccacaccaccttcccctttgatcctgagcggcgggtgcgcagcaccctgaagaaggtgtttggatttgacagcttcaagacccccctgcaggagagcgccaccatggctgtggtgaagggcaacaaggatgtgtttgtgtgcatgcccaccggggccggcaagagcctgtgctaccagctgcctgccctgctggccaagggcatcaccatcgtggtgagccccctcatcgccctgatccaggaccaggtggaccacctgctgaccctgaaggtgcgggtgagcagcctgaacagcaagctgagcgcccaggagaggaaggagctgctggccgacctggagcgggagaagccccagaccaagatcctgtacatcaccccagagatggccgccagcagcagcttccagcccaccctgaacagcctggtgagccgccacctgctgagctacctggtggtggatgaggcccactgtgtgtcccagtggggccatgacttccggccagactacctgcggctgggcgccctgcggagccggctgggccacgccccctgtgtggccctgacagccacagccaccccccaggtgcaggaggatgtgtttgctgccctgcacctgaagaagcctgtggccatcttcaagaccccctgcttccgggccaacctcttctatgatgtgcagttcaaggagctgatcagtgacccctacggcaacctgaaggacttctgcctgaaggccctgggccaggaggccgacaagggcctgagcggctgcggcatcgtgtactgcaggacccgggaggcctgtgagcagctggccatcgagctgagctgccggggcgtgaatgccaaggcctaccacgccggcctgaaggccagcgagaggaccctggtgcagaatgactggatggaggagaaggtgcctgtgattgtggccaccatcagctttggcatgggcgtggacaaggccaacgtgcgctttgtggcccactggaacatcgccaagtccatggccggctactaccaggagagcggccgggccggcagagatggcaagcccagctggtgccgcctgtactacagcagaaatgaccgggaccaggtgtccttcctgatcaggaaggaggtggccaagctgcaggagaagaggggcaacaaggccagtgacaaggccaccatcatggcctttgatgccctggtgaccttctgtgaggagctgggccgctggggccggggccacggcaagagcctgcgggccgcctggtgcagccaggtggtgtccagacatgctgagctgtag

SEQ ID NO: 167393 - DNA, 1233 bp, Artificial Sequence
  Description of Artificial Sequence: Synthetic coding sequence
atgagcagccaccacaccaccttcccctttgatcctgagcggcgggtgcgcagcaccctgaagaaggtgtttggatttgacagcttcaagacccccctgcaggagagcgccaccatggctgtggtgaagggcaacaaggatgtgtttgtgtgcatgcccaccggggccggcaagagcctgtgctaccagctgcctgccctgctggccaagggcatcaccatcgtggtgagccccctcatcgccctgatccaggaccaggtggaccacctgctgaccctgaaggtgcgggtgagcagcctgaacagcaagctgagcgcccaggagaggaaggagctgctggccgacctggagcgggagaagccccagaccaagatcctgtacatcaccccagagatggccgccagcagcagcttccagcccaccctgaacagcctggtgagccgccacctgctgagctacctggtggtggatgaggcccactgtgtgtcccagtggggccatgacttccggccagactacctgcggctgggcgccctgcggagccggctgggccacgccccctgtgtggccctgacagccacagccaccccccaggtgcaggaggatgtgtttgctgccctgcacctgaagaagcctgtggccatcttcaagaccccctgcttccgggccaacctcttctatgatgtgcagttcaaggagctgatcagtgacccctacggcaacctgaaggacttctgcctgaaggccctgggccaggaggccgacaagggcctgagcggctgcggcatcgtgtactgcaggacccgggaggcctgtgagcagctggccatcgagctgagctgccggggcgtgaatgccaaggcctaccacgccggcctgaaggccagcgagaggaccctggtgcagaatgactggatggaggagaaggtgcctgtgattgtggccaccatcagctttggcatgggcgtggacaaggccaacgtgcgctttgtggcccactggaacatcgccaagtccatggccggctactaccaggagagcggccgggccggcagagatggcaagcccagctggtgccgcctgtactacagcagaaatgaccgggaccaggtgtccttcctgatcaggaaggaggtggccaagctgcaggagaagaggggcaacaaggccagtgacaaggccaccatcatggcctttgatgccctggtgaccttctgtgaggagctgggctag

SEQ ID NO: 167394 - DNA, 3057 bp, Artificial Sequence
  Description of Artificial Sequence: Synthetic coding sequence
atgagcagccaccacaccaccttcccctttgatcctgagcggcgggtgcgcagcaccctgaagaaggtgtttggatttgacagcttcaagacccccctgcaggagagcgccaccatggctgtggtgaagggcaacaaggatgtgtttgtgtgcatgcccaccggggccggcaagagcctgtgctaccagctgcctgccctgctggccaagggcatcaccatcgtggtgagccccctcatcgccctgatccaggaccaggtggaccacctgctgaccctgaaggtgcgggtgagcagcctgaacagcaagctgagcgcccaggagaggaaggagctgctggccgacctggagcgggagaagccccagaccaagatcctgtacatcaccccagagatggccgccagcagcagcttccagcccaccctgaacagcctggtgagccgccacctgctgagctacctggtggtggatgaggcccactgtgtgtcccagtggggccatgacttccggccagactacctgcggctgggcgccctgcggagccggctgggccacgccccctgtgtggccctgacagccacagccaccccccaggtgcaggaggatgtgtttgctgccctgcacctgaagaagcctgtggccatcttcaagaccccctgcttccgggccaacctcttctatgatgtgcagttcaaggagctgatcagtgacccctacggcaacctgaaggacttctgcctgaaggccctgggccaggaggccgacaagggcctgagcggctgcggcatcgtgtactgcaggacccgggaggcctgtgagcagctggccatcgagctgagctgccggggcgtgaatgccaaggcctaccacgccggcctgaaggccagcgagaggaccctggtgcagaatgactggatggaggagaaggtgcctgtgattgtggccaccatcagctttggcatgggcgtggacaaggccaacgtgcgctttgtggcccactggaacatcgccaagtccatggccggctactaccaggagagcggccgggccggcagagatggcaagcccagctggtgccgcctgtactacagcagaaatgaccgggaccaggtgtccttcctgatcaggaaggaggtggccaagctgcaggagaagaggggcaacaaggccagtgacaaggccaccatcatggcctttgatgccctggtgaccttctgtgaggagctgggctgcagacatgctgccatcgccaagtactttggagatgccctgcctgcctgtgccaagggctgtgaccactgccagaaccccacagctgtgagaagaaggctggaggccctggagaggagcagctcctggagcaagacctgcatcggccccagccagggcaatggatttgatcctgagctgtatgaaggaggcaggaagggctacggggacttcagccgctatgatgagggcagcggcggcagcggagatgagggcagagatgaggcccacaagcgggagtggaacctcttctaccagaagcagatgcagctgaggaagggcaaggaccccaagattgaggagtttgtgcccccagatgagaactgccccctgaaggaggccagcagccgccgcatcccccggctgactgtgaaggcccgggagcactgcctgcggctgctggaggaggccctgagcagcaaccggcagagcaccaggacagcagatgaggccgacctgcgggccaaggctgtggagctggagcacgagaccttcagaaatgccaaggtggccaacctgtacaaggcctctgtgctgaagaaggtggccgacatccaccgggccagcaaggatggccagccctatgacatgggcggcagcgccaagagctgcagcgcccaggccgagcccccagagcccaatgaatatgacatccccccagccagccacgtgtacagcctgaagcccaagagggtgggcgccggcttccccaagggcagctgccccttccagacagccacagagctgatggagaccacccgcatccgggagcaggccccccagcctgagcggggcggggagcacgagccccccagccggccctgtggcctgctggatgaagatggcagcgagcccctgcccggccccagaggagaggtgcctgggggcagcgcccactatggaggccccagccctgagaagaaggccaagagcagcagcggcggcagcagcctggccaagggccgggccagcaagaagcagcagctgctggccacagctgcccacaaggacagccagagcatcgcccgcttcttctgccggcgggtggagagccctgccctgctggccagcgcccctgaggccgagggcgcctgccccagctgtgaaggagtgcagggcccccccatggcccctgagaagtacacaggagaggaggatggagctgggggccacagccctgccccaccccagacagaagaatgtctgcgggagcggcccagcacctgccccccccgggaccagggcaccccagaggtgcagcccaccccagccaaggacacctggaagggcaagaggcccaggagccagcaggagaaccctgagagccagccccagaagaggccccggcccagcgccaagcccagcgtggtggccgaggtgaagggctctgtgtctgccagcgagcagggcaccctgaaccccacagcccaggaccccttccagctgagcgcccctggggtgtccctgaaggaggccgccaacgtggtggtgaagtgcctgacccccttctacaaggagggcaagtttgccagcaaggagctgttcaagggctttgcccggcacctgagccacctgctgacccagaagaccagccctggccgctctgtgaaggaggaggcccagaacctgatccgccacttcttccacggccgggcccgctgtgagagcggcccccacggctgggtgttctgggacacctgccggggccagaaggtggagggcggcggcgctgctgctggccggcggggcaggaagagcggccccagccccagcagcaagtctggatag

SEQ ID NO: 167395 - DNA, 1761 bp, Artificial Sequence
  Description of Artificial Sequence: Synthetic coding sequence
atgttcctggtgcgctgcagacatgctgccatcgccaagtactttggagatgccctgcctgcctgtgccaagggctgtgaccactgccagaaccccacagctgtgagaagaaggctggaggccctggagaggagcagctcctggagcaagacctgcatcggccccagccagggcaatggatttgatcctgagctgtatgagggcggcaggaagggctatggagacttcagccgctatgatgagggcagcggcggcagcggagatgagggcagagatgaggcccacaagcgggagtggaacctcttctaccagaagcagatgcagctgaggaagggcaaggaccccaagattgaggagtttgtgcccccagatgagaactgccccctgaaggaggccagcagccgccgcatcccccggctgactgtgaaggcccgggagcactgcctgcggctgctggaggaggccctgagcagcaaccggcagagcaccaggacagcagatgaagctgacctgcgggccaaggctgtggagctggagcacgagaccttcagaaatgccaaggtggccaacctgtacaaggcctctgtgctgaagaaggtggccgacatccaccgggccagcaaggatggccagccctatgacatgggcggcagcgccaagagctgcagcgcccaggccgagcccccagagcccaatgaatatgacatccccccagccagccacgtgtacagcctgaagcccaagagggtgggcgccggcttccccaagggcagctgccccttccagacagccacagagctgatggagaccacccgcatccgggagcaggccccccagcctgagcggggcggggagcacgagccccccagccggccctgtggcctgctggatgaagatggcagcgagcccctgcccggccccagaggagaggtgcctgggggcagcgcccactacggcggccccagccctgagaagaaggccaagagcagcagcggcggcagcagcctggccaagggccgggccagcaagaagcagcagctgctggccacagctgcccacaaggacagccagagcatcgcccgcttcttctgcagaagagtggagagccctgccctgctggccagcgcccctgaggccgagggcgcctgccccagctgtgagggcgtgcagggcccccccatggcccctgagaagtacaccggggaggaggatggagctgggggccacagccctgccccaccccagacagaggagtgcctgcgggagcggcccagcacctgccccccccgggaccagggcaccccagaggtgcagcccaccccagccaaggacacctggaagggcaagaggcccaggagccagcaggagaaccctgagagccagccccagaagaggccccggcccagcgccaagcccagcgtggtggccgaggtgaagggctctgtgtctgccagcgagcagggcaccctgaaccccacagcccaggaccccttccagctgagcgcccctggggtgtccctgaaggaggccgccaacgtggtggtgaagtgcctgacccccttctacaaggagggcaagtttgccagcaaggagctgttcaagggctttgcccggcacctgagccacctgctgacccagaagaccagccctggccgctctgtgaaggaggaggcccagaacctgatccgccacttcttccacggccgggcccgctgtgagagcgaggccgactggcacggcctgtgtggcccccagaggtag

SEQ ID NO: 167396 - DNA, 1200 bp, Artificial Sequence; identical to SEQ ID NO: 157323
  Description of Artificial Sequence: Synthetic coding sequence

SEQ ID NO: 167397 - DNA, 528 bp, Artificial Sequence
  Description of Artificial Sequence: Synthetic coding sequence
atgctgccccccatggccctgcccagcgtgtcctggatgctgctgagctgcctgatcctgctgtgccaggtgcagggcgaggagacccagaaggagctgcccagcccccgcatcagctgccccaagggcagcaaggcctacggcagcccctgctacgccctcttcctgagccccaagtcctggatggatgctgacctggcctgccagaagaggccttctgggaagctggtgtctgtgctgtctggagctgagggcagctttgtgagcagcctggtgcgcagcatcagcaacagctacagctacatctggattggcctgcatgaccccacccagggcagcgagccagatggagatggctgggagtggagcagcacagatgtgatgaactactttgcctgggagaagaaccccagcaccatcctgaaccctggccactgcggcagcctgagccgcagcacaggcttcctgaagtggaaggactacaactgtgatgccaagctgccctacgtgtgcaagttcaaggactag

SEQ ID NO: 167398 - DNA, 528 bp, Artificial Sequence; identical to SEQ ID NO: 167397
  Description of Artificial Sequence: Synthetic coding sequence

SEQ ID NO: 167399 - DNA, 390 bp, Artificial Sequence
  Description of Artificial Sequence: Synthetic coding sequence
atgctgccccccatggccctgcccagcgtgtcctggatgctgctgagctgcctgatcctgctgtgccaggtgcagggcgaggagacccagaaggagctgcccagcccccgcatcagctgccccaagggcagcaaggcctacggcagcccctgctacgccctcttcctgagccccaagtcctggatggatgctgatggcagcgagccagatggagatggctgggagtggagcagcacagatgtgatgaactactttgcctgggagaagaaccccagcaccatcctgaaccctggccactgcggcagcctgagccgcagcacaggcttcctgaagtggaaggactacaactgtgatgccaagctgccctacgtgtgcaagttcaaggactag

SEQ ID NO: 167400 - DNA, 477 bp, Artificial Sequence
  Description of Artificial Sequence: Synthetic coding sequence
atggccagccgctccatgaggctgctgctgctgctgagctgcctggccaagacaggagtgctgggggacatcatcatgaggcccagctgtgcccctggctggttctaccacaagagcaactgctacggctacttcaggaagctgaggaactggagcgatgctgagctggagtgccagagctatggaaatggagcccacctggccagcatcctgagcctgaaggaggccagcaccatcgccgagtacatcagcggctaccagaggagccagcccatctggattggcctgcatgacccccagaagaggcagcagtggcagtggattgatggagccatgtacctgtaccgctcctggagcggcaagtccatgggcggcaacaagcactgtgccgagatgagcagcaacaacaacttcctgacctggagcagcaatgaatgcaacaagaggcagcacttcctgtgcaagtaccggccctag

SEQ ID NO: 167401 - DNA, 477 bp, Artificial Sequence; identical to SEQ ID NO: 167400
  Description of Artificial Sequence: Synthetic coding sequence

SEQ ID NO: 167402 - DNA, 405 bp, Artificial Sequence
  Description of Artificial Sequence: Synthetic coding sequence
atggccagccgctccatgaggctgctgctgctgctgagctgcctggccaagacaggagtgctgggggacatcatcatgaggcccagctgtgcccctggctggttctaccacaagagcaactgctacggctacttcaggaagctgaggaactggagcgatgctgaggtgaggaacctgctgcctgcctggccaggcctgagccgggccaaggaccagcctgagccccagatcagctttgattctggcagctctgtgctgcccggccactatgaggagaagcccctgtggctggtgaagtggagggaggagggctgtgtgttcaacagcttcaacagcgtgtccattgctgaggccggggctgtgtgccagaccctggatggcctgcaggcccacacagacacctag

SEQ ID NO: 167403 - DNA, 375 bp, Artificial Sequence
  Description of Artificial Sequence: Synthetic coding sequence
atggccagccgctccatgaggctgctgctgctgctgagctgcctggccaagacaggagtgctgggggacatcatcatgaggcccagctgtgcccctggctggttctaccacaagagcaactgctacggctacttcaggaagctgaggaactggagcgatgctgagctggagtgccagagctatggaaatggagcccacctggccagcatcctgagcctgaaggaggccagcaccatcgccgagtacatcagcggctaccagaggagccagcccatctggattggcctgcatgacccccagaagcagcccctgaacagctgcctcttcttcctgtggccctgggagggcctgcctgtggagagcctgctgggctag

SEQ ID NO: 167404 - DNA, 900 bp, Artificial Sequence
  Description of Artificial Sequence: Synthetic coding sequence
atgagcagcatcaagattgaatgtgtgctgcctgagaactgccgctgtggggagagccctgtgtgggaggaggtgagcaacagcctgctgtttgtggacatcccagccaagaaggtgtgccgctgggacagcttcaccaagcaggtgcagagggtgaccatggatgcccctgtgtcctctgtggccctgcggcagagcggcggctacgtggccaccatcggcaccaagttctgtgccctgaactggaaggagcagagcgctgtggtgctggccaccgtggacaatgacaagaagaacaaccgcttcaatgatggcaaggtggaccctgctggccgctactttgctggcaccatggccgaggagacagccccagctgtgctggagcggcaccagggcgccctgtacagcctcttcccagaccaccacgtgaagaagtactttgaccaggtggacatcagcaatggcctggactggagcctggaccacaagatcttctactacatcgacagcctgagctacagcgtggatgcctttgattatgacctgcagacaggccagatcagcaacagaagatctgtgtacaagctggagaaggaggagcagatcccagatggcatgtgcattgatgctgagggcaagctgtgggtggcctgctacaacggcggccgggtcatccggctggaccctgtgacaggcaagaggctgcagacagtgaagctgcctgtggacaagaccaccagctgctgcttcggcggcaagaactacagcgagatgtatgtgacctgtgccagagatggcatggaccctgagggcctgctgcggcagcctgaggccggcggcatcttcaagatcaccggcctgggcgtgaagggcatcgccccctacagctatgccggctag

SEQ ID NO: 167405 - DNA, 900 bp, Artificial Sequence; identical to SEQ ID NO: 167404
  Description of Artificial Sequence: Synthetic coding sequence

SEQ ID NO: 167406 - DNA, 900 bp, Artificial Sequence; identical to SEQ ID NO: 167404
  Description of Artificial Sequence: Synthetic coding sequence

SEQ ID NO: 167407 - DNA, 684 bp, Artificial Sequence
  Description of Artificial Sequence: Synthetic coding sequence
atgagcagcatcaagattgaatgtgtgctgcctgagaactgccgctgtggggagagccctgtgtgggaggaggtgagcaacagcctgctgtttgtggacatcccagccaagaaggtgtgccgctgggacagcttcaccaagcaggtgcagagggtgaccatggatgcccctgtgtcctctgtggccctgcggcagagcggcggctacgtggccaccatcggcaccaagttctgtgccctgaactggaaggagcagagcgctgtggtgctggccaccgtggacaatgacaagaagaacaaccgcttcaatgatggcaaggtggaccctgctggccgctactttgctgccaacagaagatctgtgtacaagctggagaaggaggagcagatcccagatggcatgtgcattgatgctgagggcaagctgtgggtggcctgctacaacggcggccgggtcatccggctggaccctgtgacaggcaagaggctgcagacagtgaagctgcctgtggacaagaccaccagctgctgcttcggcggcaagaactacagcgagatgtatgtgacctgtgccagagatggcatggaccctgagggcctgctgcggcagcctgaggccggcggcatcttcaagatcaccggcctgggcgtgaagggcatcgccccctacagctatgccggctag

SEQ ID NO: 167408 - DNA, 3876 bp, Artificial Sequence
  Description of Artificial Sequence: Synthetic coding sequence
atgagcagcgctgtgggcccccggggcccccggccccccaccgtgcccccacccatgcaggagctgcctgacctgagccacctgacagaggaggagaggaacatcatcatggctgtgatggaccggcagaaggaggaggaggagaaggaggaggccatgctgaagtgtgtggtgcgggacatggccaagccagctgcctgcaagaccccaagaaatgctgagaaccagccccaccagcccagcccccggctgcaccagcagtttgagagctacaaggagcaggtgaggaagatcggggaggaggcccggcgctaccagggcgagcacaaggatgatgcccccacctgtggcatctgccacaagaccaagtttgctgatggctgcggccacctgtgcagctactgcaggaccaagttctgtgcccgctgtggcggccgggtgtccctgcggagcaacaatgaagacaagtatgtgatgtgggtgtgcaacctgtgcaggaagcagcaggagatcctgaccaagagcggggcctggttcttcggcagcggcccccagcagaccagccaggacggcaccctgagtgacacagccaccggggccggcagcgaggtgccccgggagaagaaggcccggctgcaggagaggagccgcagccagacccccctgagcacagctgctgccagcagccaggatgctgccccacccagcgcccccccagacaggagcaaaggagctgagcccagccagcaggccctgggccctgagcagaagcaggccagcagccgcagccgctctgagcccccccgggagaggaagaagaccccaggcctgtctgagcagaatggaaaaggagccctgaagtctgagaggaagagggtgcccaagaccagcgcccagcctgtggagggcgctgtggaggagcgggagaggaaggagcggcgggagagccggcggctggagaagggccgcagccaggactacccagacaccccagagaagagagatgagggcaaggccgcagatgaggagaagcagaggaaggaggaggactaccagacccgctacagaagtgaccccaacctggcccgctaccctgtgaagcccccacctgaggagcagcagatgaggatgcacgcccgggtgtcccgggcccggcatgagcggcggcacagtgatgtggccctgcccaggacagaggccggggccgccctgcctgagggcaaggccggcaagagggccccagctgctgcccgggccagccccccagacagcccccgggcctacagcgctgagaggacagctgagacccgggcccctggggccaagcagctgaccaaccacagccccccagcccccaggcatggccctgtgcctgctgaggcccctgagctgaaggcccaggagcccctgaggaagcagagccggctggaccccagcagcgctgtgctgatgaggaaggccaagcgggagaaggtggagaccatgctgagaaatgacagcctgagcagtgaccagagcgagagcgtgcggcccagcccccccaagccccacaggagcaagaggggcggcaagaagaggcagatgtctgtgagcagcagcgaggaggagggcgtgtccaccccagagtacaccagctgtgaagatgtggagctggagagcgagagcgtgtctgagaagggggacctggactactactggctggaccctgccacctggcacagccgggagaccagccccatcagcagccaccctgtgacctggcagcccagcaaggagggggaccggctgattggccgggtcatcctgaacaagaggaccaccatgcccaaggacagcggggccctgctgggcctgaaggtggtgggcggcaagatgacagacctgggccgcctgggcgccttcatcaccaaggtgaagaagggcagcctggctgatgtggtgggccacctgcgggctggagatgaggtgctggagtggaatggcaagcccctgcccggggccaccaatgaggaggtgtacaacatcatcctggagagcaagtctgagccccaggtggagatcatcgtgtcccggcccatcggggacatcccccgcatccctgagagcagccacccccccctggagagcagcagcagcagctttgagagccagaagatggagcggcccagcatcagcgtcatcagccccaccagccctggggccctgaaggatgccccccaggtgctgcccggccagctgtctgtgaagctgtggtatgacaaggtgggccaccagctgattgtgaatgtgctgcaggccacagacctgcctgcccgggtggatggccggcccaggaacccctacgtgaagatgtacttcctgcctgacagaagtgacaagagcaagaggaggaccaagacagtgaagaagatcctggagcccaagtggaaccagacctttgtgtacagccacgtgcaccggcgggacttccgggagaggatgctggagatcaccgtgtgggaccagccccgggtgcaggaggaggagagcgagttcctgggggagatcctgattgagctggagacagccctgctggatgatgagccccactggtacaagctgcagacccatgatgagagcagcctgcccctgccccagcccagccccttcatgccccggcggcacatccacggggagagcagcagcaagaagctgcagaggagccagaggatcagtgacagcgacatcagtgactatgaggtggatgatggcatcggcgtggtgcccccaggctaccgcagcagcgcccgggagagcaagagcaccaccctgactgtgcctgagcagcagaggaccacccaccacaggagccgctctgtgagcccccacagaggaaatgaccagggcaagcccaggagccggctgcccaacgtgcccctgcagaggagcctggatgagatccaccccacccggcgcagccgcagccccaccaggcaccatgatgccagccgcagccctgtggaccacaggaccagagatgtggacagccagtacctgtctgagcaggacaggatgcaccggcagaggagccccacccagagccccccagctgacaccagcttcagcagcagaagaggccggcagctgccccaggtgcctgtgcgcagcggcagcattgagcaggagagcggccacaagaagctgaagagcaccatccagaggagcacagaaacaggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatgggagacatccagatcggcatggaggacaagaagggccagctggaggtggaggtgatccgggcccggagcctgacccagaagccaggcagcaagagcaccccagccccctacgtgaaggtgtacctgctggagaatggagcctgcatcgccaagaagaagacccgcatcgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgtttcctcccagcagcctggtggaccccaccctgacccccctgacccggcgggccagccagagcagcctggagagcagcacaggccccccctgcatccgctcctag

SEQ ID NO: 167409 - DNA, 4428 bp, Artificial Sequence
  Description of Artificial Sequence: Synthetic coding sequence
atgagcagcgctgtgggcccccggggcccccggccccccaccgtgcccccacccatgcaggagctgcctgacctgagccacctgacagaggaggagaggaacatcatcatggctgtgatggaccggcagaaggaggaggaggagaaggaggaggccatgctgaagtgtgtggtgcgggacatggccaagccagctgcctgcaagaccccaagaaatgctgagaaccagccccaccagcccagcccccggctgcaccagcagtttgagagctacaaggagcaggtgaggaagatcggggaggaggcccggcgctaccagggcgagcacaaggatgatgcccccacctgtggcatctgccacaagaccaagtttgctgatggctgcggccacctgtgcagctactgcaggaccaagttctgtgcccgctgtggcggccgggtgtccctgcggagcaacaatgaagacatctgtgtgatgtgggtgtgcaacctgtgcaggaagcagcaggagatcctgaccaagagcggggcctggttcttcggcagcggcccccagcagaccagccaggacggcaccctgagtgacacagccaccggggccggcagcgaggtgccccgggagaagaaggcccggctgcaggagaggagccgcagccagacccccctgagcacagctgctgccagcagccaggatgctgccccacccagcgcccccccagacaggagcaaaggagctgagcccagccagcaggccctgggccctgagcagaagcaggccagcagccgcagccgctctgagcccccccgggagaggaagaagaccccaggcctgtctgagcagaatggaaaaggagccctgaagtctgagaggaagagggtgcccaagaccagcgcccagcctgtggagggcgctgtggaggagcgggagaggaaggagcggcgggagagccggcggctggagaagggccgcagccaggactacccagacaccccagagaagagagatgagggcaaggccgcagatgaggagaagcagaggaaggaggaggactaccagacccgctacagaagtgaccccaacctggcccgctaccctgtgaagcccccacctgaggagcagcagatgaggatgcacgcccgggtgtcccgggcccggcatgagcggcggcacagtgatgtggccctgcccaggacagaggccggggccgccctgcctgagggcaaggccggcaagagggccccagctgctgcccgggccagccccccagacagcccccgggcctacagcgctgagaggacagctgagacccgggcccctggggccaagcagctgaccaaccacagccccccagcccccaggcatggccctgtgcctgctgaggcccctgagctgaaggcccaggagcccctgaggaagcagagccggctggaccccagcagcgctgtgctgatgaggaaggccaagcgggagaaggtggagaccatgctgagaaatgacagcctgagcagtgaccagagcgagagcgtgcggcccagcccccccaagccccacaggagcaagaggggcggcaagaagaggcagatgtctgtgagcagcagcgaggaggagggcgtgtccaccccagagtacaccagctgtgaagatgtggagctggagagcgagagcgtgtctgagaagggggacctggactactactggctggaccctgccacctggcacagccgggagaccagccccatcagcagccaccctgtgacctggcagcccagcaaggagggggaccggctgattggccgggtcatcctgaacaagaggaccaccatgcccaaggacagcggggccctgctgggcctgaaggtggtgggcggcaagatgacagacctgggccgcctgggcgccttcatcaccaaggtgaagaagggcagcctggctgatgtggtgggccacctgcgggctggagatgaggtgctggagtggaatggcaagcccctgcccggggccaccaatgaggaggtgtacaacatcatcctggagagcaagtctgagccccaggtggagatcatcgtgtcccggcccatcggggacatcccccgcatccctgagagcagccacccccccctggagagcagcagcagcagctttgagagccagaagatggagcggcccagcatcagcgtcatcagccccaccagccctggggccctgaaggatgccccccaggtgctgcccggccagctgtctgtgaagctgtggtatgacaaggtgggccaccagctgattgtgaatgtgctgcaggccacagacctgcctgcccgggtggatggccggcccaggaacccctacgtgaagatgtacttcctgcctgacagaagtgacaagagcaagaggaggaccaagacagtgaagaagatcctggagcccaagtggaaccagacctttgtgtacagccacgtgcaccggcgggacttccgggagaggatgctggagatcaccgtgtgggaccagccccgggtgcaggaggaggagagcgagttcctgggggagatcctgattgagctggagacagccctgctggatgatgagccccactggtacaagctgcagacccatgatgagagcagcctgcccctgccccagcccagccccttcatgccccggcggcacatccacggggagagcagcagcaagaagctgcagaggagccagaggatcagtgacagcgacatcagtgactatgaggtggatgatggcatcggcgtggtgcccccaggctaccgcagcagcgcccgggagagcaagagcaccaccctgactgtgcctgagcagcagaggaccacccaccacaggagccgctctgtgagcccccacagaggaaatgaccagggcaagcccaggagccggctgcccaacgtgcccctgcagaggagcctggatgagatccaccccacccggcgcagccgcagccccaccaggcaccatgatgccagccgcagccctgtggaccacaggaccagagatgtggacagccagtacctgtctgagcaggacagcgagctgctgatgctgccccgggccaagaggggccgctctgctgagtgcctgcacaccaccaggatgcaccggcagaggagccccacccagagccccccagctgacaccagcttcagcagccggcggggccggcagctgccccaggtgcctgtgcgcagcggcagcattgagcaggccagcctggtggtggaggagaggacccggcagatgaagatgaaggtgcaccgcttcaagcagaccaccggcagcggcagcagccaggagctggaccgggagcagtacagcaagtacaacatccacaaggaccagtaccgcagctgtgacaacgtgtctgccaagagcagtgacagtgatgtgtctgatgtgtctgccatcagcaggaccagcagcgccagccggctgagcagcaccagcttcatgtctgagcagagcgagcggccccggggccgcatccggaggatgggcaccagcggccgcagcatcatgaagagcacctctgtgtctggagagatgtacaccctggagcacaatgatggcagccagagcgacacagctgtgggcaccgtgggcgctgggggcaagaagagaagaagcagcctgagcgccaaggtggtggccatcgtgtccagaagaagccgcagcaccagccagctgagccagacagagagcggccacaagaagctgaagagcaccatccagaggagcacagaaacaggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatgggagacatccagatcggcatggaggacaagaagggccagctggaggtggaggtgatccgggcccggagcctgacccagaagccaggcagcaagagcaccccagccccctacgtgaaggtgtacctgctggagaatggagcctgcatcgccaagaagaagacccgcatcgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgtttcctcccagcagcctggtggaccccaccctgacccccctgacccggcgggccagccagagcagcctggagagcagcacaggccccccctgcatccgctcctag

SEQ ID NO: 167410 - DNA, 4116 bp, Artificial Sequence
  Description of Artificial Sequence: Synthetic coding sequence
atgagcagcgctgtgggcccccggggcccccggccccccaccgtgcccccacccatgcaggagctgcctgacctgagccacctgacagaggaggagaggaacatcatcatggctgtgatggaccggcagaaggaggaggaggagaaggaggaggccatgctgaagtgtgtggtgcgggacatggccaagccagctgcctgcaagaccccaagaaatgctgagaaccagccccaccagcccagcccccggctgcaccagcagtttgagagctacaaggagcaggtgaggaagatcggggaggaggcccggcgctaccagggcgagcacaaggatgatgcccccacctgtggcatctgccacaagaccaagtttgctgatggctgcggccacctgtgcagctactgcaggaccaagttctgtgcccgctgtggcggccgggtgtccctgcggagcaacaatgaaaacaagatcgtgatgtgggtgtgcaacctgtgcaggaagcagcaggagatcctgaccaagagcggggcctggttcttcggcagcggcccccagcagaccagccaggacggcaccctgagtgacacagccaccggggccggcagcgaggtgccccgggagaagaaggcccggctgcaggagaggagccgcagccagacccccctgagcacagctgctgccagcagccaggatgctgccccacccagcgcccccccagacaggagcaaaggagctgagcccagccagcaggccctgggccctgagcagaagcaggccagcagccgcagccgctctgagcccccccgggagaggaagaagaccccaggcctgtctgagcagaatggaaaaggagccctgaagtctgagaggaagagggtgcccaagaccagcgcccagcctgtggagggcgctgtggaggagcgggagaggaaggagcggcgggagagccggcggctggagaagggccgcagccaggactacccagacaccccagagaagagagatgagggcaaggccgcagatgaggagaagcagaggaaggaggaggactaccagacccgctacagaagtgaccccaacctggcccgctaccctgtgaagcccccacctgaggagcagcagatgaggatgcacgcccgggtgtcccgggcccggcatgagcggcggcacagtgatgtggccctgcccaggacagaggccggggccgccctgcctgagggcaaggccggcaagagggccccagctgctgcccgggccagccccccagacagcccccgggcctacagcgctgagaggacagctgagacccgggcccctggggccaagcagctgaccaaccacagccccccagcccccaggcatggccctgtgcctgctgaggcccctgagctgaaggcccaggagcccctgaggaagcagagccggctggaccccagcagcgctgtgctgatgaggaaggccaagcgggagaaggtggagaccatgctgagaaatgacagcctgagcagtgaccagagcgagagcgtgcggcccagcccccccaagccccacaggagcaagaggggcggcaagaagaggcagatgtctgtgagcagcagcgaggaggagggcgtgtccaccccagagtacaccagctgtgaagatgtggagctggagagcgagagcgtgtctgagaagggggacctggactactactggctggaccctgccacctggcacagccgggagaccagccccatcagcagccaccctgtgacctggcagcccagcaaggagggggaccggctgattggccgggtcatcctgaacaagaggaccaccatgcccaaggacagcggggccctgctgggcctgaaggtggtgggcggcaagatgacagacctgggccgcctgggcgccttcatcaccaaggtgaagaagggcagcctggctgatgtggtgggccacctgcgggctggagatgaggtgctggagtggaatggcaagcccctgcccggggccaccaatgaggaggtgtacaacatcatcctggagagcaagtctgagccccaggtggagatcatcgtgtcccggcccatcggggacatcccccgcatccctgagagcagccacccccccctggagagcagcagcagcagctttgagagccagaagatggagcggcccagcatcagcgtcatcagccccaccagccctggggccctgaaggatgccccccaggtgctgcccggccagctgtctgtgaagctgtggtatgacaaggtgggccaccagctgattgtgaatgtgctgcaggccacagacctgcctgcccgggtggatggccggcccaggaacccctacgtgaagatgtacttcctgcctgacagaagtgacaagagcaagaggaggaccaagacagtgaagaagatcctggagcccaagtggaaccagacctttgtgtacagccacgtgcaccggcgggacttccgggagaggatgctggagatcaccgtgtgggaccagccccgggtgcaggaggaggagagcgagttcctgggggagatcctgattgagctggagacagccctgctggatgatgagccccactggtacaagctgcagacccatgatgagagcagcctgcccctgccccagcccagccccttcatgccccggcggcacatccacggggagagcagcagcaagaagctgcagaggagccagaggatcagtgacagcgacatcagtgactatgaggtggatgatggcatcggcgtggtgccccctgtgggctaccgcagcagcgcccgggagagcaagagcaccaccctgactgtgcctgagcagcagaggaccacccaccacaggagccgctctgtgagcccccacagaggaaatgaccagggcaagcccaggagccggctgcccaacgtgcccctgcagaggagcctggatgagatccaccccaccaggaggagccgcagccccaccaggcaccatgatgccagccgcagccctgtggaccacaggaccagagatgtggacagccagtacctgtctgagcaggacagcgagctgctgatgctgccccgggccaagaggggccgctctgcagaatgtctgcacaccaccagcgagctgcagcccttcctggaccgggcccggagcgccagcaccaactgcctgcggccagacaccagcctgcacagccctgagcgggagcggggccgctggagccccagcctggacagaagaagaccacccagcccccgcatccagatccagcacgccagcccagaaaatgacaggatgcaccggcagaggagccccacccagagccccccagctgacaccagcttcagcagcagaagaggccggcagctgccccaggtgcctgtgcgcagcggcagcattgagcaggagagcggccacaagaagctgaagagcaccatccagaggagcacagaaacaggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatgggagacatccagatcggcatggaggacaagaagggccagctggaggtggaggtgatccgggcccggagcctgacccagaagccaggcagcaagagcaccccagccccctacgtgaaggtgtacctgctggagaatggagcctgcatcgccaagaagaagacccgcatcgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgtttcctcccagcagcctggtggaccccaccctgacccccctgacccggcgggccagccagagcagcctggagagcagcacaggccccccctgcatccgctcctag

SEQ ID NO: 167411 - DNA, 4626 bp, Artificial Sequence
  Description of Artificial Sequence: Synthetic coding sequence
atgagcagcgctgtgggcccccggggcccccggccccccaccgtgcccccacccatgcaggagctgcctgacctgagccacctgacagaggaggagaggaacatcatcatggctgtgatggaccggcagaaggaggaggaggagaaggaggaggccatgctgaagtgtgtggtgcgggacatggccaagccagctgcctgcaagaccccaagaaatgctgagaaccagccccaccagcccagcccccggctgcaccagcagtttgagagctacaaggagcaggtgaggaagatcggggaggaggcccggcgctaccagggcgagcacaaggatgatgcccccacctgtggcatctgccacaagaccaagtttgctgatggctgcggccacctgtgcagctactgcaggaccaagttctgtgcccgctgtggcggccgggtgtccctgcggagcaacaatgaagacaagtatgtgatgtgggtgtgcaacctgtgcaggaagcagcaggagatcctgaccaagagcggggcctggttcttcggcagcggcccccagcagaccagccaggacggcaccctgagtgacacagccaccggggccggcagcgaggtgccccgggagaagaaggcccggctgcaggagaggagccgcagccagacccccctgagcacagctgctgccagcagccaggatgctgccccacccagcgcccccccagacaggagcaaaggagctgagcccagccagcaggccctgggccctgagcagaagcaggccagcagccgcagccgctctgagcccccccgggagaggaagaagaccccaggcctgtctgagcagaatggaaaaggagccctgaagtctgagaggaagagggtgcccaagaccagcgcccagcctgtggagggcgctgtggaggagcgggagaggaaggagcggcgggagagccggcggctggagaagggccgcagccaggactacccagacaccccagagaagagagatgagggcaaggccgcagatgaggagaagcagaggaaggaggaggactaccagacccgctacagaagtgaccccaacctggcccgctaccctgtgaagcccccacctgaggagcagcagatgaggatgcacgcccgggtgtcccgggcccggcatgagcggcggcacagtgatgtggccctgcccaggacagaggccggggccgccctgcctgagggcaaggccggcaagagggccccagctgctgcccgggccagccccccagacagcccccgggcctacagcgctgagaggacagctgagacccgggcccctggggccaagcagctgaccaaccacagccccccagcccccaggcatggccctgtgcctgctgaggcccctgagctgaaggcccaggagcccctgaggaagcagagccggctggaccccagcagcgctgtgctgatgaggaaggccaagcgggagaaggtggagaccatgctgagaaatgacagcctgagcagtgaccagagcgagagcgtgcggcccagcccccccaagccccacaggagcaagaggggcggcaagaagaggcagatgtctgtgagcagcagcgaggaggagggcgtgtccaccccagagtacaccagctgtgaagatgtggagctggagagcgagagcgtgtctgagaagggggacctggactactactggctggaccctgccacctggcacagccgggagaccagccccatcagcagccaccctgtgacctggcagcccagcaaggagggggaccggctgattggccgggtcatcctgaacaagaggaccaccatgcccaaggacagcggggccctgctgggcctgaaggtggtgggcggcaagatgacagacctgggccgcctgggcgccttcatcaccaaggtgaagaagggcagcctggctgatgtggtgggccacctgcgggctggagatgaggtgctggagtggaatggcaagcccctgcccggggccaccaatgaggaggtgtacaacatcatcctggagagcaagtctgagccccaggtggagatcatcgtgtcccggcccatcggggacatcccccgcatccctgagagcagccacccccccctggagagcagcagcagcagctttgagagccagaagatggagcggcccagcatcagcgtcatcagccccaccagccctggggccctgaaggatgccccccaggtgctgcccggccagctgtctgtgaagctgtggtatgacaaggtgggccaccagctgattgtgaatgtgctgcaggccacagacctgcctgcccgggtggatggccggcccaggaacccctacgtgaagatgtacttcctgcctgacagaagtgacaagagcaagaggaggaccaagacagtgaagaagatcctggagcccaagtggaaccagacctttgtgtacagccacgtgcaccggcgggacttccgggagaggatgctggagatcaccgtgtgggaccagccccgggtgcaggaggaggagagcgagttcctgggggagatcctgattgagctggagacagccctgctggatgatgagccccactggtacaagctgcagacccatgatgagagcagcctgcccctgccccagcccagccccttcatgccccggcggcacatccacggggagagcagcagcaagaagctgcagaggagccagaggatcagtgacagcgacatcagtgactatgaggtggatgatggcatcggcgtggtgccccctgtgggctaccgcagcagcgcccgggagagcaagagcaccaccctgactgtgcctgagcagcagaggaccacccaccacaggagccgctctgtgagcccccacagaggaaatgaccagggcaagcccaggagccggctgcccaacgtgcccctgcagaggagcctggatgagatccaccccaccaggaggagccgcagccccaccaggcaccatgatgccagccgcagccctgtggaccacaggaccagagatgtggacagccagtacctgtctgagcaggacagcgagctgctgatgctgccccgggccaagaggggccgctctgcagaatgtctgcacaccaccaggcacctggtgcgccactacaagaccctgccccccaagatgcccctgctgcagagcagcagccactggaacatctacagcgagctgcagcccttcctggaccgggcccggagcgccagcaccaactgcctgcggccagacaccagcctgcacagccctgagcgggagaggatgcaccggcagaggagccccacccagagccccccagctgacaccagcttcagcagcagaagaggccggcagctgccccaggtgcctgtgcgcagcggcagcattgagcaggccagcctggtggtggaggagaggacccggcagatgaagatgaaggtgcaccgcttcaagcagaccactggaagtggcagcagccaggagctggaccgggagcagtacagcaagtacaacatccacaaggaccagtaccgcagctgtgacaacgtgtctgccaagagcagtgacagtgatgtgtctgatgtgtctgccatcagcaggaccagcagcgccagccggctgagcagcaccagcttcatgtctgagcagagcgagcggccccggggccgcatcagcagcttcacccccaagatgcagggccgcaggatgggcaccagcggccgcagcatcatgaagagcacctctgtgtctggagagatgtacaccctggagcacaatgatggcagccagagcgacacagctgtgggcaccgtgggcgctgggggcaagaagagaagaagcagcctgagcgccaaggtggtggccatcgtgtccagaagaagccgcagcaccagccagctgagccagacagagagcggccacaagaagctgaagagcaccatccagaggagcacagaaacaggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatgggagacatccagatcggcatggaggacaagaagggccagctggaggtggaggtgatccgggcccggagcctgacccagaagccaggcagcaagagcaccccagccccctacgtgaaggtgtacctgctggagaatggagcctgcatcgccaagaagaagacccgcatcgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgtttcctcccagcagcctggtggaccccaccctgacccccctgacccggcgggccagccagagcagcctggagagcagcacaggccccccctgcatccgctcctag

SEQ ID NO: 167412 - DNA, 4446 bp, Artificial Sequence
  Description of Artificial Sequence: Synthetic coding sequence
atgagcagcgctgtgggcccccggggcccccggccccccaccgtgcccccacccatgcaggagctgcctgacctgagccacctgacagaggaggagaggaacatcatcatggctgtgatggaccggcagaaggaggaggaggagaaggaggaggccatgctgaagtgtgtggtgcgggacatggccaagccagctgcctgcaagaccccaagaaatgctgagaaccagccccaccagcccagcccccggctgcaccagcagtttgagagctacaaggagcaggtgaggaagatcggggaggaggcccggcgctaccagggcgagcacaaggatgatgcccccacctgtggcatctgccacaagaccaagtttgctgatggctgcggccacctgtgcagctactgcaggaccaagttctgtgcccgctgtggcggccgggtgtccctgcggagcaacaatgaaaacaagatcgtgatgtgggtgtgcaacctgtgcaggaagcagcaggagatcctgaccaagagcggggcctggttcttcggcagcggcccccagcagaccagccaggacggcaccctgagtgacacagccaccggggccggcagcgaggtgccccgggagaagaaggcccggctgcaggagaggagccgcagccagacccccctgagcacagctgctgccagcagccaggatgctgccccacccagcgcccccccagacaggagcaaaggagctgagcccagccagcaggccctgggccctgagcagaagcaggccagcagccgcagccgctctgagcccccccgggagaggaagaagaccccaggcctgtctgagcagaatggaaaaggagccctgaagtctgagaggaagagggtgcccaagaccagcgcccagcctgtggagggcgctgtggaggagcgggagaggaaggagcggcgggagagccggcggctggagaagggccgcagccaggactacccagacaccccagagaagagagatgagggcaaggccgcagatgaggagaagcagaggaaggaggaggactaccagacccgctacagaagtgaccccaacctggcccgctaccctgtgaagcccccacctgaggagcagcagatgaggatgcacgcccgggtgtcccgggcccggcatgagcggcggcacagtgatgtggccctgcccaggacagaggccggggccgccctgcctgagggcaaggccggcaagagggccccagctgctgcccgggccagccccccagacagcccccgggcctacagcgctgagaggacagctgagacccgggcccctggggccaagcagctgaccaaccacagccccccagcccccaggcatggccctgtgcctgctgaggcccctgagctgaaggcccaggagcccctgaggaagcagagccggctggaccccagcagcgctgtgctgatgaggaaggccaagcgggagaaggtggagaccatgctgagaaatgacagcctgagcagtgaccagagcgagagcgtgcggcccagcccccccaagccccacaggagcaagaggggcggcaagaagaggcagatgtctgtgagcagcagcgaggaggagggcgtgtccaccccagagtacaccagctgtgaagatgtggagctggagagcgagagcgtgtctgagaagggggacctggactactactggctggaccctgccacctggcacagccgggagaccagccccatcagcagccaccctgtgacctggcagcccagcaaggagggggaccggctgattggccgggtcatcctgaacaagaggaccaccatgcccaaggacagcggggccctgctgggcctgaaggtggtgggcggcaagatgacagacctgggccgcctgggcgccttcatcaccaaggtgaagaagggcagcctggctgatgtggtgggccacctgcgggctggagatgaggtgctggagtggaatggcaagcccctgcccggggccaccaatgaggaggtgtacaacatcatcctggagagcaagtctgagccccaggtggagatcatcgtgtcccggcccatcggggacatcccccgcatccctgagagcagccacccccccctggagagcagcagcagcagctttgagagccagaagatggagcggcccagcatcagcgtcatcagccccaccagccctggggccctgaaggatgccccccaggtgctgcccggccagctgtctgtgaagctgtggtatgacaaggtgggccaccagctgattgtgaatgtgctgcaggccacagacctgcctgcccgggtggatggccggcccaggaacccctacgtgaagatgtacttcctgcctgacagaagtgacaagagcaagaggaggaccaagacagtgaagaagatcctggagcccaagtggaaccagacctttgtgtacagccacgtgcaccggcgggacttccgggagaggatgctggagatcaccgtgtgggaccagccccgggtgcaggaggaggagagcgagttcctgggggagatcctgattgagctggagacagccctgctggatgatgagccccactggtacaagctgcagacccatgatgagagcagcctgcccctgccccagcccagccccttcatgccccggcggcacatccacggggagagcagcagcaagaagctgcagaggagccagaggatcagtgacagcgacatcagtgactatgaggtggatgatggcatcggcgtggtgccccctgtgggctaccgcagcagcgcccgggagagcaagagcaccaccctgactgtgcctgagcagcagaggaccacccaccacaggagccgctctgtgagcccccacagaggaaatgaccagggcaagcccaggagccggctgcccaacgtgcccctgcagaggagcctggatgagatccaccccaccaggaggagccgcagccccaccaggcaccatgatgccagccgcagccctgtggaccacaggaccagagatgtggacagccagtacctgtctgagcaggacagcgagctgctgatgctgccccgggccaagaggggccgctctgcagaatgtctgcacaccaccagcgagctgcagcccttcctggaccgggcccggagcgccagcaccaactgcctgcggccagacaccagcctgcacagccctgagcgggagaggatgcaccggcagaggagccccacccagagccccccagctgacaccagcttcagcagcagaagaggccggcagctgccccaggtgcctgtgcgcagcggcagcattgagcaggccagcctggtggtggaggagaggacccggcagatgaagatgaaggtgcaccgcttcaagcagaccactggaagtggcagcagccaggagctggaccgggagcagtacagcaagtacaacatccacaaggaccagtaccgcagctgtgacaacgtgtctgccaagagcagtgacagtgatgtgtctgatgtgtctgccatcagcaggaccagcagcgccagccggctgagcagcaccagcttcatgtctgagcagagcgagcggccccggggccgcatcagcagcttcacccccaagatgcagggccgcaggatgggcaccagcggccgcagcatcatgaagagcacctctgtgtctggagagatgtacaccctggagcacaatgatggcagccagagcgacacagctgtgggcaccgtgggcgctgggggcaagaagagaagaagcagcctgagcgccaaggtggtggccatcgtgtccagaagaagccgcagcaccagccagctgagccagacagagagcggccacaagaagctgaagagcaccatccagaggagcacagaaacaggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatggccccctacgtgaaggtgtacctgctggagaatggagcctgcatcgccaagaagaagacccgcatcgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgtttcctcccagcagcctggtggaccccaccctgacccccctgacccggcgggccagccagagcagcctggagagcagcacaggccccccctgcatccgctcctag

SEQ ID NO: 167413 - DNA, 4446 bp, Artificial Sequence
  Description of Artificial Sequence: Synthetic coding sequence
atgagcagcgctgtgggcccccggggcccccggccccccaccgtgcccccacccatgcaggagctgcctgacctgagccacctgacagaggaggagaggaacatcatcatggctgtgatggaccggcagaaggaggaggaggagaaggaggaggccatgctgaagtgtgtggtgcgggacatggccaagccagctgcctgcaagaccccaagaaatgctgagaaccagccccaccagcccagcccccggctgcaccagcagtttgagagctacaaggagcaggtgaggaagatcggggaggaggcccggcgctaccagggcgagcacaaggatgatgcccccacctgtggcatctgccacaagaccaagtttgctgatggctgcggccacctgtgcagctactgcaggaccaagttctgtgcccgctgtggcggccgggtgtccctgcggagcaacaatgaagacaaggtggtgatgtgggtgtgcaacctgtgcaggaagcagcaggagatcctgaccaagagcggggcctggttcttcggcagcggcccccagcagaccagccaggacggcaccctgagtgacacagccaccggggccggcagcgaggtgccccgggagaagaaggcccggctgcaggagaggagccgcagccagacccccctgagcacagctgctgccagcagccaggatgctgccccacccagcgcccccccagacaggagcaaaggagctgagcccagccagcaggccctgggccctgagcagaagcaggccagcagccgcagccgctctgagcccccccgggagaggaagaagaccccaggcctgtctgagcagaatggaaaaggagccctgaagtctgagaggaagagggtgcccaagaccagcgcccagcctgtggagggcgctgtggaggagcgggagaggaaggagcggcgggagagccggcggctggagaagggccgcagccaggactacccagacaccccagagaagagagatgagggcaaggccgcagatgaggagaagcagaggaaggaggaggactaccagacccgctacagaagtgaccccaacctggcccgctaccctgtgaagcccccacctgaggagcagcagatgaggatgcacgcccgggtgtcccgggcccggcatgagcggcggcacagtgatgtggccctgcccaggacagaggccggggccgccctgcctgagggcaaggccggcaagagggccccagctgctgcccgggccagccccccagacagcccccgggcctacagcgctgagaggacagctgagacccgggcccctggggccaagcagctgaccaaccacagccccccagcccccaggcatggccctgtgcctgctgaggcccctgagctgaaggcccaggagcccctgaggaagcagagccggctggaccccagcagcgctgtgctgatgaggaaggccaagcgggagaaggtggagaccatgctgagaaatgacagcctgagcagtgaccagagcgagagcgtgcggcccagcccccccaagccccacaggagcaagaggggcggcaagaagaggcagatgtctgtgagcagcagcgaggaggagggcgtgtccaccccagagtacaccagctgtgaagatgtggagctggagagcgagagcgtgtctgagaagggggacctggactactactggctggaccctgccacctggcacagccgggagaccagccccatcagcagccaccctgtgacctggcagcccagcaaggagggggaccggctgattggccgggtcatcctgaacaagaggaccaccatgcccaaggacagcggggccctgctgggcctgaaggtggtgggcggcaagatgacagacctgggccgcctgggcgccttcatcaccaaggtgaagaagggcagcctggctgatgtggtgggccacctgcgggctggagatgaggtgctggagtggaatggcaagcccctgcccggggccaccaatgaggaggtgtacaacatcatcctggagagcaagtctgagccccaggtggagatcatcgtgtcccggcccatcggggacatcccccgcatccctgagagcagccacccccccctggagagcagcagcagcagctttgagagccagaagatggagcggcccagcatcagcgtcatcagccccaccagccctggggccctgaaggatgccccccaggtgctgcccggccagctgtctgtgaagctgtggtatgacaaggtgggccaccagctgattgtgaatgtgctgcaggccacagacctgcctgcccgggtggatggccggcccaggaacccctacgtgaagatgtacttcctgcctgacagaagtgacaagagcaagaggaggaccaagacagtgaagaagatcctggagcccaagtggaaccagacctttgtgtacagccacgtgcaccggcgggacttccgggagaggatgctggagatcaccgtgtgggaccagccccgggtgcaggaggaggagagcgagttcctgggggagatcctgattgagctggagacagccctgctggatgatgagccccactggtacaagctgcagacccatgatgagagcagcctgcccctgccccagcccagccccttcatgccccggcggcacatccacggggagagcagcagcaagaagctgcagaggagccagaggatcagtgacagcgacatcagtgactatgaggtggatgatggcatcggcgtggtgccccctgtgggctaccgcagcagcgcccgggagagcaagagcaccaccctgactgtgcctgagcagcagaggaccacccaccacaggagccgctctgtgagcccccacagaggaaatgaccagggcaagcccaggagccggctgcccaacgtgcccctgcagaggagcctggatgagatccaccccaccaggaggagccgcagccccaccaggcaccatgatgccagccgcagccctgtggaccacaggaccagagatgtggacagccagtacctgtctgagcaggacagcgagctgctgatgctgccccgggccaagaggggccgctctgcagaatgtctgcacaccaccagcgagctgcagcccttcctggaccgggcccggagcgccagcaccaactgcctgcggccagacaccagcctgcacagccctgagcgggagaggatgcaccggcagaggagccccacccagagccccccagctgacaccagcttcagcagcagaagaggccggcagctgccccaggtgcctgtgcgcagcggcagcattgagcaggccagcctggtggtggaggagaggacccggcagatgaagatgaaggtgcaccgcttcaagcagaccactggaagtggcagcagccaggagctggaccgggagcagtacagcaagtacaacatccacaaggaccagtaccgcagctgtgacaacgtgtctgccaagagcagtgacagtgatgtgtctgatgtgtctgccatcagcaggaccagcagcgccagccggctgagcagcaccagcttcatgtctgagcagagcgagcggccccggggccgcatcagcagcttcacccccaagatgcagggccgcaggatgggcaccagcggccgcagcatcatgaagagcacctctgtgtctggagagatgtacaccctggagcacaatgatggcagccagagcgacacagctgtgggcaccgtgggcgctgggggcaagaagagaagaagcagcctgagcgccaaggtggtggccatcgtgtccagaagaagccgcagcaccagccagctgagccagacagagagcggccacaagaagctgaagagcaccatccagaggagcacagaaacaggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatggccccctacgtgaaggtgtacctgctggagaatggagcctgcatcgccaagaagaagacccgcatcgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgtttcctcccagcagcctggtggaccccaccctgacccccctgacccggcgggccagccagagcagcctggagagcagcacaggccccccctgcatccgctcctag

SEQ ID NO: 167414 - DNA, 5079 bp, Artificial Sequence
  Description of Artificial Sequence: Synthetic coding sequence
atgagcagcgctgtgggcccccggggcccccggccccccaccgtgcccccacccatgcaggagctgcctgacctgagccacctgacagaggaggagaggaacatcatcatggctgtgatggaccggcagaaggaggaggaggagaaggaggaggccatgctgaagtgtgtggtgcgggacatggccaagccagctgcctgcaagaccccaagaaatgctgagaaccagccccaccagcccagcccccggctgcaccagcagtttgagagctacaaggagcaggtgaggaagatcggggaggaggcccggcgctaccagggcgagcacaaggatgatgcccccacctgtggcatctgccacaagaccaagtttgctgatggctgcggccacctgtgcagctactgcaggaccaagttctgtgcccgctgtggcggccgggtgtccctgcggagcaacaatgaagacaaggtggtgatgtgggtgtgcaacctgtgcaggaagcagcaggagatcctgaccaagagcggggcctggttcttcggcagcggcccccagcagaccagccaggacggcaccctgagtgacacagccaccggggccggcagcgaggtgccccgggagaagaaggcccggctgcaggagaggagccgcagccagacccccctgagcacagctgctgccagcagccaggatgctgccccacccagcgcccccccagacaggagcaaaggagctgagcccagccagcaggccctgggccctgagcagaagcaggccagcagccgcagccgctctgagcccccccgggagaggaagaagaccccaggcctgtctgagcagaatggaaaaggagccctgaagtctgagaggaagagggtgcccaagaccagcgcccagcctgtggagggcgctgtggaggagcgggagaggaaggagcggcgggagagccggcggctggagaagggccgcagccaggactacccagacaccccagagaagagagatgagggcaaggccgcagatgaggagaagcagaggaaggaggaggactaccagacccgctacagaagtgaccccaacctggcccgctaccctgtgaagcccccacctgaggagcagcagatgaggatgcacgcccgggtgtcccgggcccggcatgagcggcggcacagtgatgtggccctgcccaggacagaggccggggccgccctgcctgagggcaaggccggcaagagggccccagctgctgcccgggccagccccccagacagcccccgggcctacagcgctgagaggacagctgagacccgggcccctggggccaagcagctgaccaaccacagccccccagcccccaggcatggccctgtgcctgctgaggcccctgagctgaaggcccaggagcccctgaggaagcagagccggctggaccccagcagcgctgtgctgatgaggaaggccaagcgggagaaggtggagaccatgctgagaaatgacagcctgagcagtgaccagagcgagagcgtgcggcccagcccccccaagccccacaggagcaagaggggcggcaagaagaggcagatgtctgtgagcagcagcgaggaggagggcgtgtccaccccagagtacaccagctgtgaagatgtggagctggagagcgagagcgtgtctgagaagggggacctggactactactggctggaccctgccacctggcacagccgggagaccagccccatcagcagccaccctgtgacctggcagcccagcaaggagggggaccggctgattggccgggtcatcctgaacaagaggaccaccatgcccaaggacagcggggccctgctgggcctgaaggtggtgggcggcaagatgacagacctgggccgcctgggcgccttcatcaccaaggtgaagaagggcagcctggctgatgtggtgggccacctgcgggctggagatgaggtgctggagtggaatggcaagcccctgcccggggccaccaatgaggaggtgtacaacatcatcctggagagcaagtctgagccccaggtggagatcatcgtgtcccggcccatcggggacatcccccgcatccctgagagcagccacccccccctggagagcagcagcagcagctttgagagccagaagatggagcggcccagcatcagcgtcatcagccccaccagccctggggccctgaaggatgccccccaggtgctgcccggccagctgtctgtgaagctgtggtatgacaaggtgggccaccagctgattgtgaatgtgctgcaggccacagacctgcctgcccgggtggatggccggcccaggaacccctacgtgaagatgtacttcctgcctgacagaagtgacaagagcaagaggaggaccaagacagtgaagaagatcctggagcccaagtggaaccagacctttgtgtacagccacgtgcaccggcgggacttccgggagaggatgctggagatcaccgtgtgggaccagccccgggtgcaggaggaggagagcgagttcctgggggagatcctgattgagctggagacagccctgctggatgatgagccccactggtacaagctgcagacccatgatgagagcagcctgcccctgccccagcccagccccttcatgccccggcggcacatccacggggagagcagcagcaagaagctgcagaggagccagaggatcagtgacagcgacatcagtgactatgaggtggatgatggcatcggcgtggtgccccctgtgggctaccgcagcagcgcccgggagagcaagagcaccaccctgactgtgcctgagcagcagaggaccacccaccacaggagccgctctgtgagcccccacagaggaaatgaccagggcaagcccaggagccggctgcccaacgtgcccctgcagaggagcctggatgagatccaccccaccaggaggagccgcagccccaccaggcaccatgatgccagccgcagccctgtggaccacaggaccagagatgtggacagccagtacctgtctgagcaggacagcgagctgctgatgctgccccgggccaagaggggccgctctgcagaatgtctgcacaccaccaggcacctggtgcgccactacaagaccctgccccccaagatgcccctgctgcagagcagcagccactggaacatctacagcagcatcctgcctgcccacaccaagaccaagtctgtgacccggcaggacatcagcctgcaccacgagtgcttcaacagcacagtgctgcgcttcacagatgagatcctggtgtctgagctgcagcccttcctggaccgggcccggagcgccagcaccaactgcctgcggccagacaccagcctgcacagccctgagcgggagcggggccgctggagccccagcctggacagaagaagaccacccagcccccgcatccagatccagcacgccagcccagaaaatgacagacacagcaggaagtctgagaggagcagcatccagaagcagaccaggaaaggaacagccagtgatgctgagcgggtgctgcccacctgcctgagcagaagaggacatgctgccccccgggccacagaccagcctgtgatccggggcaagcacccagcccggagccgcagcagcgagcacagcagcatccgcaccctgtgcagcatgcaccacctggtgcctgggggcagcgccccacccagccccctgctgaccaggatgcaccggcagaggagccccacccagagccccccagctgacaccagcttcagcagccggcggggccggcagctgccccaggtgcctgtgcgcagcggcagcattgagcaggccagcctggtggtggaggagaggacccggcagatgaagatgaaggtgcaccgcttcaagcagaccaccggcagcggcagcagccaggagctggaccgggagcagtacagcaagtacaacatccacaaggaccagtaccgcagctgtgacaacgtgtctgccaagagcagtgacagtgatgtgtctgatgtgtctgccatcagcaggaccagcagcgccagccggctgagcagcaccagcttcatgtctgagcagagcgagcggccccggggccgcatcagcagcttcacccccaagatgcagggccgcaggatgggcaccagcggccgcagcatcatgaagagcacctctgtgtctggagagatgtacaccctggagcacaatgatggcagccagagcgacacagctgtgggcaccgtgggcgccggcggcaagaagaggaggagcagcctgagcgccaaggtggtggccatcgtgagccgccgcagccgcagcaccagccagctgagccagacagaaagtggccacaagaagctgaagagcaccatccagaggagcacagagaccggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatgggagacatccagatcggcatggaggacaagaagggccagctggaggtggaggtgatccgggcccggagcctgacccagaagccaggcagcaagagcaccccagccccctacgtgaaggtgtacctgctggagaatggagcctgcatcgccaagaagaagaccagaattgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgttcccccccagcagcctggtggaccccaccctgacccccctgacccggcgggccagccagagcagcctggagagcagcactggaccaccctgcatccgctcctag

SEQ ID NO: 167415 - DNA, 1497 bp, Artificial Sequence
  Description of Artificial Sequence: Synthetic coding sequence
atgctgccccgggccaagaggggccgctctgctgagtgcctgcacaccaccaggcacagcaggaagtctgagaggagcagcatccagaagcagaccaggaagggcacagccagtgatgctgagaggatgcaccggcagaggagccccacccagagccccccagctgacaccagcttcagcagccggcggggccggcagctgccccaggtgcctgtgcgcagcggcagcattgagcaggagcaggagaagtacaacagcagcaccaaggccagcctggtggtggaggagaggacccggcagatgaagatgaaggtgcaccgcttcaagcagaccaccggcagcggcagcagccaggagctggaccgggagcagtacagcaagtacaacatccacaaggaccagtaccgcagctgtgacaacgtgtctgccaagagcagtgacagtgatgtgtctgatgtgtctgccatcagcaggaccagcagcgccagccggctgagcagcaccagcttcatgtctgagcagagcgagcggccccggggccgcatcagcagcttcacccccaagatgcagggccgcaggatgggcaccagcggccgcagcatcatgaagagcacctctgtgtctggagagatgtacaccctggagcacaatgatggcagccagagcgacacagctgtgggcaccgtgggcgccggcggcaagaagaggaggagcagcctgagcgccaaggtggtggccatcgtgagccgccgcagccgcagcaccagccagctgagccagacagaaagtggccacaagaagctgaagagcaccatccagaggagcacagagaccggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatgggagacatccagatcggcatggaggacaagaagggccagctggaggtggaggtgatccgggcccggagcctgacccagaagccaggcagcaagagcaccccagccccctacgtgaaggtgtacctgctggagaatggagcctgcatcgccaagaagaagaccagaattgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgttcccccccagcagcctggtggaccccaccctgacccccctgacccggcgggccagccagagcagcctggagagcagcactggaccaccctgcatccgctcctag

SEQ ID NO: 167416 - DNA, 3039 bp, Artificial Sequence
  Description of Artificial Sequence: Synthetic coding sequence
atgtgtgcccctggcatccacgtgagcagcgagggctgggaggaggtgcgctctgtggacagcgaggagggcaccatcgaggccaggagagctgtggccggggacctggactactactggctggaccctgccacctggcacagccgggagaccagccccatcagcagccaccctgtgacctggcagcccagcaaggagggggaccggctgattggccgggtcatcctgaacaagaggaccaccatgcccaaggacagcggggccctgctgggcctgaaggtggtgggcggcaagatgacagacctgggccgcctgggcgccttcatcaccaaggtgaagaagggcagcctggctgatgtggtgggccacctgcgggctggagatgaggtgctggagtggaatggcaagcccctgcccggggccaccaatgaggaggtgtacaacatcatcctggagagcaagtctgagccccaggtggagatcatcgtgtcccggcccatcggggacatcccccgcatccctgagagcagccacccccccctggagagcagcagcagcagctttgagagccagaagatggagcggcccagcatcagcgtcatcagccccaccagccctggggccctgaaggatgccccccaggtgctgcccggccagctgtctgtgaagctgtggtatgacaaggtgggccaccagctgattgtgaatgtgctgcaggccacagacctgcctgcccgggtggatggccggcccaggaacccctacgtgaagatgtacttcctgcctgacagaagtgacaagagcaagaggaggaccaagacagtgaagaagatcctggagcccaagtggaaccagacctttgtgtacagccacgtgcaccggcgggacttccgggagaggatgctggagatcaccgtgtgggaccagccccgggtgcaggaggaggagagcgagttcctgggggagatcctgattgagctggagacagccctgctggatgatgagccccactggtacaagctgcagacccatgatgagagcagcctgcccctgccccagcccagccccttcatgccccggcggcacatccacggggagagcagcagcaagaagctgcagaggagccagaggatcagtgacagcgacatcagtgactatgaggtggatgatggcatcggcgtggtgcccccaggctaccgcagcagcgcccgggagagcaagagcaccaccctgactgtgcctgagcagcagaggaccacccaccacaggagccgctctgtgagcccccacagaggaaatgaccagggcaagcccaggagccggctgcccaacgtgcccctgcagaggagcctggatgagatccaccccacccggcgcagccgcagccccaccaggcaccatgatgccagccgcagccctgtggaccacaggaccagagatgtggacagccagtacctgtctgagcaggacagcgagctgctgatgctgccccgggccaagaggggccgctctgctgagtgcctgcacaccaccagcgagctgcagcccttcctggaccgggcccggagcgccagcaccaactgcctgcggccagacaccagcctgcacagccctgagcgggagcggcacagcaggaagtctgagaggagcagcatccagaagcagaccaggaagggcacagccagtgatgctgagaggatgcaccggcagaggagccccacccagagccccccagctgacaccagcttcagcagccggcggggccggcagctgccccaggtgcctgtgcgcagcggcagcattgagcaggccagcctggtggtggaggagaggacccggcagatgaagatgaaggtgcaccgcttcaagcagaccaccggcagcggcagcagccaggagctggaccgggagcagtacagcaagtacaacatccacaaggaccagtaccgcagctgtgacaacgtgtctgccaagagcagtgacagtgatgtgtctgatgtgtctgccatcagcaggaccagcagcgccagccggctgagcagcaccagcttcatgtctgagcagagcgagcggccccggggccgcatcagcagcttcacccccaagatgcagggccgcaggatgggcaccagcggccgcagcatcatgaagagcacctctgtgtctggagagatgtacaccctggagcacaatgatggcagccagagcgacacagctgtgggcaccgtgggcgccggcggcaagaagaggaggagcagcctgagcgccaaggtggtggccatcgtgagccgccgcagccgcagcaccagccagctgagccagacagaaagtggccacaagaagctgaagagcaccatccagaggagcacagagaccggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatgggagacatccagatcggcatggaggacaagaagggccagctggaggtggaggtgatccgggcccggagcctgacccagaagccaggcagcaagagcaccccagccccctacgtgaaggtgtacctgctggagaatggagcctgcatcgccaagaagaagaccagaattgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgttcccccccagcagcctggtggaccccaccctgacccccctgacccggcgggccagccagagcagcctggagagcagcactggaccaccctgcatccgctcctag

SEQ ID NO: 167417 - DNA, 660 bp, Artificial Sequence
  Description of Artificial Sequence: Synthetic coding sequence
atggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatgggagacatccagatcggcatggaggacaagaagggccagctggaggtggaggtgatccgggcccggagcctgacccagaagccaggcagcaagagcaccccagccccctacgtgaaggtgtacctgctggagaatggagcctgcatcgccaagaagaagacccgcatcgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgtttcctcccagcagcctggtggaccccaccctgacccccctgacccggcgggccagccagagcagcctggagagcagcacaggccccccctgcatccgctcctag

SEQ ID NO: 167418 - DNA, 2283 bp, Artificial Sequence
  Description of Artificial Sequence: Synthetic coding sequence
atgcccaaggacagcggggccctgctgggcctgaaggtggtgggcggcaagatgacagacctgggccgcctgggcgccttcatcaccaaggtgaagaagggcagcctggctgatgtggtgggccacctgcgggctggagatgaggtgctggagtggaatggcaagcccctgcccggggccaccaatgaggaggtgtacaacatcatcctggagagcaagtctgagccccaggtggagatcatcgtgtcccggcccatcggggacatcccccgcatccctgagagcagccacccccccctggagagcagcagcagcagctttgagagccagaagatggagcggcccagcatcagcgtcatcagccccaccagccctggggccctgaaggatgccccccaggtgctgcccggccagctgtctgtgaagctgtggtatgacaaggtgggccaccagctgattgtgaatgtgctgcaggccacagacctgcctgcccgggtggatggccggcccaggaacccctacgtgaagatgtacttcctgcctgacagaagtgacaagagcaagaggaggaccaagacagtgaagaagatcctggagcccaagtggaaccagacctttgtgtacagccacgtgcacagaagagacttccgggagaggatgctggagatcaccgtgtgggaccagccccgggtgcaggaggaggagagcgagttcctgggggagatcctgattgagctggagacagccctgctggatgatgagccccactggtacaagctgcagacccatgatgagagcagcctgcccctgccccagcccagccccttcatgcccaggaggcacatccatggagagagcagcagcaagaagctgcagaggagccagaggatcagtgacagcgacatcagtgactatgaggtggatgatggcattggagtggtgccccctgtgggctaccgcagcagcgcccgggagagcaagagcaccaccctgactgtgcctgagcagcagaggaccacccaccacaggagccgctctgtgagcccccacagaggaaatgaccagggcaagcccaggagccggctgcccaacgtgcccctgcagaggagcctggatgagatccaccccacccggcgcagccgcagccccaccaggcaccatgatgccagccgcagccctgtggaccacaggaccagagatgtggacagccagtacctgtctgagcaggacagcgagctgctgatgctgccccgggccaagaggggccgctctgctgagtgcctgcacaccaccagcgagctgcagcccttcctggaccgggcccggagcgccagcaccaactgcctgcggccagacaccagcctgcacagccctgagcgggagcggcacagcaggaagtctgagaggagcagcatccagaagcagaccaggaagggcacagccagtgatgctgagaggatgcaccggcagaggagccccacccagagccccccagctgacaccagcttcagcagccggcggggccggcagctgccccaggtgcctgtgcgcagcggcagcattgagcaggagagcggccacaagaagctgaagagcaccatccagaggagcacagagaccggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatgggagacatccagatcggcatggaggacaagaagggccagctggaggtggaggtgatccgggcccggagcctgacccagaagccaggcagcaagagcaccccagccccctacgtgaaggtgtacctgctggagaatggagcctgcatcgccaagaagaagaccagaattgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgttcccccccagcagcctggtggaccccaccctgacccccctgacccggcgggccagccagagcagcctggagagcagcactggaccaccctgcatccgctcctag

SEQ ID NO: 167419 - DNA, 2481 bp, Artificial Sequence
  Description of Artificial Sequence: Synthetic coding sequence
atgtttgctggcttcctgcagttcctgctgctgcacaccctgcacagcggcaccggggacctggactactactggctggaccctgccacctggcacagccgggagaccagccccatcagcagccaccctgtgacctggcagcccagcaaggagggggacaggctcatcggccgggtcatcctgaacaagaggaccaccatgcccaaggacagcggggccctgctgggcctgaaggtggtgggcggcaagatgacagacctgggccgcctgggcgccttcatcaccaaggtgaagaagggcagcctggctgatgtggtgggccacctgcgggctggagatgaggtgctggagtggaatggcaagcccctgcccggggccaccaatgaggaggtgtacaacatcatcctggagagcaagtctgagccccaggtggagatcatcgtgtcccggcccatcggggacatcccccgcatccctgagagcagccacccccccctggagagcagcagcagcagctttgagagccagaagatggagcggcccagcatcagcgtcatcagccccaccagccctggggccctgaaggatgccccccaggtgctgcccggccagctgtctgtgaagctgtggtatgacaaggtgggccaccagctgattgtgaatgtgctgcaggccacagacctgcctgcccgggtggatggccggcccaggaacccctacgtgaagatgtacttcctgcctgacagaagtgacaagagcaagaggaggaccaagacagtgaagaagatcctggagcccaagtggaaccagacctttgtgtacagccacgtgcacagaagagacttccgggagaggatgctggagatcaccgtgtgggaccagccccgggtgcaggaggaggagagcgagttcctgggggagatcctgattgagctggagacagccctgctggatgatgagccccactggtacaagctgcagacccatgatgagagcagcctgcccctgccccagcccagccccttcatgcccaggaggcacatccatggagagagcagcagcaagaagctgcagaggagccagaggatcagtgacagcgacatcagtgactatgaggtggatgatggcattggagtggtgccccctgtgggctaccgcagcagcgcccgggagagcaagagcaccaccctgactgtgcctgagcagcagaggaccacccaccacaggagccgctctgtgagcccccacagaggaaatgaccagggcaagcccaggagccggctgcccaacgtgcccctgcagaggagcctggatgagatccaccccacccggcgcagccgcagccccaccaggcaccatgatgccagccgcagccctgtggaccacaggaccagagatgtggacagccagtacctgtctgagcaggacagcgagctgctgatgctgccccgggccaagaggggccgctctgctgagtgcctgcacaccaccagcgagctgcagcccttcctggaccgggcccggagcgccagcaccaactgcctgcggccagacaccagcctgcacagccctgagcgggagcggcacagcaggaagtctgagaggagcagcatccagaagcagaccaggaagggcacagccagtgatgctgagaggatgcaccggcagaggagccccacccagagccccccagctgacaccagcttcagcagccggcggggccggcagctgccccaggtgcctgtgcgcagcggcagcattgagcaggagagcggccacaagaagctgaagagcaccatccagaggagcacagagaccggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatgggagacatccagatcggcatggaggacaagaagggccagctggaggtggaggtgatccgggcccggagcctgacccagaagccaggcagcaagagcaccccagccccctacgtgaaggtgtacctgctggagaatggagcctgcatcgccaagaagaagaccagaattgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgttcccccccagcagcctggtggaccccaccctgacccccctgacccggcgggccagccagagcagcctggagagcagcactggaccaccctgcatccgctcctag

SEQ ID NO: 167420 - DNA, 2454 bp, Artificial Sequence
  Description of Artificial Sequence: Synthetic coding sequence
atgtgtgcccctggcatccacgtgagcagcgagggctgggaggaggtgcgctctgtggacagcgaggagggcaccatcgaggccaggagagctgtggccggggacctggactactactggctggaccctgccacctggcacagccgggagaccagccccatcagcagccaccctgtgacctggcagcccagcaaggagggggaccggctgattggccgggtcatcctgaacaagaggaccaccatgcccaaggacagcggggccctgctgggcctgaaggtggtgggcggcaagatgacagacctgggccgcctgggcgccttcatcaccaaggtgaagaagggcagcctggctgatgtggtgggccacctgcgggctggagatgaggtgctggagtggaatggcaagcccctgcccggggccaccaatgaggaggtgtacaacatcatcctggagagcaagtctgagccccaggtggagatcatcgtgtcccggcccatcggggacatcccccgcatccctgagagcagccacccccccctggagagcagcagcagcagctttgagagccagaagatggagcggcccagcatcagcgtcatcagccccaccagccctggggccctgaaggatgccccccaggtgctgcccggccagctgtctgtgaagctgtggtatgacaaggtgggccaccagctgattgtgaatgtgctgcaggccacagacctgcctgcccgggtggatggccggcccaggaacccctacgtgaagatgtacttcctgcctgacagaagtgacaagagcaagaggaggaccaagacagtgaagaagatcctggagcccaagtggaaccagacctttgtgtacagccacgtgcaccggcgggacttccgggagaggatgctggagatcaccgtgtgggaccagccccgggtgcaggaggaggagagcgagttcctgggggagatcctgattgagctggagacagccctgctggatgatgagccccactggtacaagctgcagacccatgatgagagcagcctgcccctgccccagcccagccccttcatgccccggcggcacatccacggggagagcagcagcaagaagctgcagaggagccagaggatcagtgacagcgacatcagtgactatgaggtggatgatggcatcggcgtggtgccccctgtgggctaccgcagcagcgcccgggagagcaagagcaccaccctgactgtgcctgagcagcagaggaccacccaccacaggagccgctctgtgagcccccacagaggaaatgaccagggcaagcccaggagccggctgcccaacgtgcccctgcagaggagcctggatgagatccaccccaccaggaggagccgcagccccaccaggcaccatgatgccagccgcagccctgtggaccacaggaccagagatgtggacagccagtacctgtctgagcaggacagcgagctgctgatgctgccccgggccaagaggggccgctctgcagaatgtctgcacaccaccagcgagctgcagcccttcctggaccgggcccggagcgccagcaccaactgcctgcggccagacaccagcctgcacagccctgagcgggagaggatgcaccggcagaggagccccacccagagccccccagctgacaccagcttcagcagcagaagaggccggcagctgccccaggtgcctgtgcgcagcggcagcattgagcaggagagcggccacaagaagctgaagagcaccatccagaggagcacagaaacaggcatggctgctgagatgaggaagatggtgcggcagcccagccgggagagcacagatggcagcatcaacagctacagcagcgagggcaacctgatcttccctggggtgcggctgggcgctgacagccagttcagtgacttcctggatggcctgggccctgcccagctggtgggccggcagaccctggccaccccagccatgggagacatccagatcggcatggaggacaagaagggccagctggaggtggaggtgatccgggcccggagcctgacccagaagccaggcagcaagagcaccccagccccctacgtgaaggtgtacctgctggagaatggagcctgcatcgccaagaagaagacccgcatcgccaggaagaccctggaccccctgtaccagcagagcctggtgtttgatgagagcccccagggcaaggtgctgcaggtgattgtgtggggagactatggccgcatggaccacaagtgcttcatgggcgtggcccagatcctgctggaggagctggacctgagctccatggtgattggctggtacaagctgtttcctcccagcagcctggtggaccccaccctgacccccctgacccggcgggccagccagagcagcctggagagcagcacaggccccccctgcatccgctcctag

SEQ ID NO: 167421 - DNA, 3567 bp, Artificial Sequence
  Description of Artificial Sequence: Synthetic coding sequence
atgcagtttgagaccctgcggcaggtgtgcaacagcgtgctgagccacttccacggcgtcttcagcagcccccccaacatcctgcagaatgagctgtttggccagaccctgaacaatgccaggaagaggagccccagcgtgtcccgggaccagaacagaagatatgaccagcgggaggagcgggaggagtacagccagtatgccaccagtgacacagccatgcccaggagccccagcgactatgctgaccggcgcagccagcacgagccccagttctatgaggacagcgaccacctgagctacagagacagcaacagaagaagccaccgccacagcaaggagtacatcgtggatgatgaagatgtggagagcagagatgaatatgaaaggcagaggcgggaggaggagtaccagagccgctacagaagtgaccccaacctggcccgctaccctgtgaagccccagccctatgaggagcagatgagaattcatgctgaggtgtcccgggcccggcatgagcggcggcacagtgatgtgtccctggccaatgctgacctggaggacagccgcatctccatgctgaggatggaccggcccagccggcagaggagcatcagcgagcggcgggccgccatggagaaccagaggagctacagcatggagaggacccgggaggcccagggccccagcagctatgcccagaggaccaccaaccacagcccccccaccccaagaagaagccccctgcccatcgacagaccagacctgcggaggacagacagcctgaggaagcagcaccacctggaccccagcagcgctgtgaggaagaccaagcgggagaagatggagaccatgctgagaaatgacagcctgagcagtgaccagagcgagagcgtgcggcccccaccacccaagccccacaagagcaagaagggcggcaagatgaggcagatcagcctgagcagcagcgaggaggagctggccagcaccccagagtacaccagctgtgatgatgtggagattgaaagtgaatctgtgtctgagaagggggacagccagaagggcaagaggaagaccagcgagcaggccgtgctgagtgacagcaacaccaggtctgagcggcagaaggagatgatgtactttggaggccacagcctggaggaggacctggagtggagcgagccccagatcaaggacagcggcgtggacacctgcagcagcaccaccctgaatgaggagcacagccacagcgacaagcaccctgtgacctggcagcccagcaaggatggagacaggctcatcggccgcatcctgctgaacaagaggctgaaggatggctctgtgccccgggacagcggggccatgctgggcctgaaggtggtgggcggcaagatgacagagagcggccgcctgtgtgccttcatcaccaaggtgaagaagggcagcctggccgacacagtgggccacctgcggcctggagatgaggtgctggagtggaatggccgcctgctgcagggcgccacctttgaggaggtgtacaacatcatcctggagagcaagccagagccccaggtggagctggtggtgtcccggcccatcggggacatcccccgcatcccagacagcacccacgcccagctggagagcagcagcagcagctttgagagccagaagatggaccggcccagcatctctgtgaccagccccatgagccctggcatgctgagagatgtgccccagttcctgagcggccagctgagcatcaagctgtggtttgacaaggtgggccaccagctgattgtgaccatcctgggcgccaaggacctgcccagcagagaagatggccggcccaggaacccctacgtgaagatctacttcctgcctgacagaagtgacaagaacaagaggaggaccaagacagtgaagaagaccctggagcccaagtggaaccagaccttcatctacagccctgtgcaccggcgggagttccgggagaggatgctggagatcaccctgtgggaccaggcccgggtgcgggaggaggagagcgagttcctgggggagatcctgattgagctggagacagccctgctggatgatgagccccactggtacaagctgcagacccatgatgtgagcagcctgcccctgccccaccccagcccctacatgccccggcggcagctgcacggggagagccccacccggcggctgcagaggagcaagaggatcagtgacagcgaggtgtctgactatgactgtgatgatggcatcggcgtggtgtctgactacagacatgatggccgggacctgcagagcagcaccctgtctgtgcctgagcaggtgatgagcagcaaccactgcagccccagcggcagcccccaccgggtggatgtgattggccgcaccaggtcctggagccccagcgtgcccccaccccagagcagaaatgtggagcagggcctgcggggcaccaggaccatgacaggccactacaacaccatcagcaggatggacagacaccgggtgatggatgaccactacagcccagaccgggaccgggactgtgaggccgctgaccggcagccctaccacaggagccgcagcacagagcagaggcccctgctggagaggaccaccaccaggagccgcagcacagagaggccagacaccaacctgatgaggtccatgcccagcctgatgacaggccgcagcgccccacccagccctgccctgagccgcagccaccccaggactggatctgtgcagaccagccccagcagcacccctgtggccggccggcggggccggcagctgccccagctgccccccaagggcaccctggacaggaaggccggcggcaagaagctgcggagcacagtgcagaggagcacagaaacaggcctggccgtggagatgaggaactggatgacccggcaggccagccgggagagcacagatggctccatgaacagctacagcagcgagggcaacctgatcttccctggggtgcggctggccagtgacagccagttcagtgacttcctggatggcctgggccctgcccagctggtgggccggcagaccctggccaccccagccatgggagacatccaggtgggcatgatggacaagaagggccagctggaggtggagatcatccgggcccggggcctggtggtgaagccaggcagcaagaccctgcctgccccctacgtgaaggtgtacctgctggacaacggggtgtgcatcgccaagaagaagaccaaggtggccaggaagaccctggagcccctgtaccagcagctgctgagctttgaggagagcccccagggcaaggtgctgcagatcatcgtgtggggagactatggccgcatggaccacaagagcttcatgggcgtggcccagatcctgctggatgagctggagctgagcaacatggtgattggctggttcaagctgttcccccccagcagcctggtggaccccaccctggcccccctgacccggcgggccagccagagcagcctggagagcagcacaggccccagctacagccgctcctag

SEQ ID NO: 167422 - DNA, 4161 bp, Artificial Sequence
  Description of Artificial Sequence: Synthetic coding sequence
atgtctgcccctgtgggcccccggggccgcctggcccccatcccagctgccagccagccccccctgcagcctgagatgccagacctgagccacctgacagaggaggagaggaagatcatcctggccgtgatggaccggcagaagaaggaggtgaaggaggagcacaagccccagctgacccagtggttccccttcagcggcatcacagagctggtgaacaacgtgctgcagccccagcagaagcagcagaatgagaaggagccccagaccaagctgcaccagcagtttgagatgtacaaggagcaggtgaagaagatgggagaggagagccagcagcagcaggagcagaagggagatgcccccacctgtggcatctgccacaagaccaagtttgctgatggctgcggccacaactgcagctactgccagaccaagttctgtgcccgctgtggcggccgggtgtccctgcggagcaacaaggtgatgtgggtgtgcaacctgtgcaggaagcagcaggagatcctgaccaagagcggggcctggttctacaacagcggcagcaacaccccccagcagcctgaccagaaggtgctgcggggcctgagaaatgaggaggccccccaggagaagaagcccaagctgcacgagcagacccagttccagggccccagcggggacctgtctgtgcctgctgtggagaagagccgcagccacggcctgacccggcagcacagcatcaagaatggcagcggcgtgaagcaccacatcgccagtgacatcgccagtgacaggaagaggagccccagcgtgtcccgggaccagaacagaagatatgaccagcgggaggagcgggaggagtacagccagtatgccaccagtgacacagccatgcccaggagccccagcgactatgctgacagaagaagccagcacgagccccagttctatgaagattctgaccacctgagctacagagacagcaacagaagaagccaccgccacagcaaggagtacatcgtggatgatgaagatgtggagagcagagatgaatatgagcggcagaggcgggaggaggagtaccagagccgctacagaagtgaccccaacctggcccgctaccctgtgaagccccagccctatgaggagcagatgagaattcatgctgaggtgtcccgggcccggcatgaaagaagacacagtgatgtgtccctggccaatgctgacctggaggacagccgcatctccatgctgaggatggaccggcccagccggcagaggagcatcagcgagaggagagctgccatggagaaccagaggagctacagcatggagaggacccgggaggcccagggccccagcagctatgcccagaggaccaccaaccacagcccccccaccccccggcgcagccccctgcccatcgacagaccagacctgcggaggacagacagcctgaggaagcagcaccacctggaccccagcagcgctgtgaggaagaccaagcgggagaagatggagaccatgctgagaaatgacagcctgagcagtgaccagagcgagagcgtgcggcccccaccacccaagccccacaagagcaagaagggcggcaagatgaggcagatcagcctgagcagcagcgaggaggagctggccagcaccccagagtacaccagctgtgatgatgtggagattgagagcgagagcgtgtctgagaagggggacatggactacaactggctggaccacacctcctggcacagcagcgaggccagccccatgagcctgcaccctgtgacctggcagcccagcaaggatggagacaggctcatcggccgcatcctgctgaacaagaggctgaaggatggctctgtgccccgggacagcggggccatgctgggcctgaaggtggtgggcggcaagatgacagagagcggccgcctgtgtgccttcatcaccaaggtgaagaagggcagcctggccgacacagtgggccacctgcggcctggagatgaggtgctggagtggaatggccgcctgctgcagggcgccacctttgaggaggtgtacaacatcatcctggagagcaagccagagccccaggtggagctggtggtgtcccggcccatcggggacatcccccgcatcccagacagcacccacgcccagctggagagcagcagcagcagctttgagagccagaagatggaccggcccagcatctctgtgaccagccccatgagccctggcatgctgagagatgtgccccagttcctgagcggccagctgagcatcaagctgtggtttgacaaggtgggccaccagctgattgtgaccatcctgggcgccaaggacctgcccagcagagaagatggccggcccaggaacccctacgtgaagatctacttcctgcctgacagaagtgacaagaacaagaggaggaccaagacagtgaagaagaccctggagcccaagtggaaccagaccttcatctacagccctgtgcaccggcgggagttccgggagaggatgctggagatcaccctgtgggaccaggcccgggtgcgggaggaggagagcgagttcctgggggagatcctgattgagctggagacagccctgctggatgatgagccccactggtacaagctgcagacccatgatgtgagcagcctgcccctgccccaccccagcccctacatgccccggcggcagctgcacggggagagccccacccggcggctgcagaggagcaagaggatcagtgacagcgaggtgtctgactatgactgtgatgatggcatcggcgtggtgtctgactacagacatgatggccgggacctgcagagcagcaccctgtctgtgcctgagcaggtgatgagcagcaaccactgcagccccagcggcagcccccaccgggtggatgtgattggccgcaccaggtcctggagccccagcgtgcccccaccccagagcagaaatgtggagcagggcctgcggggcaccaggaccatgacaggccactacaacaccatcagcaggatggacagacaccgggtgatggatgaccactacagcccagaccgggacagccacttcctgaccctgcccaggagccgctacagccagaccatcgaccaccaccacagagatggccgggactgtgaggccgctgaccggcagccctaccacaggagccgcagcacagagcagaggcccctgctggagaggaccaccaccaggagccgcagcacagagaggccagacaccaacctgatgaggtccatgcccagcctgatgacaggccgcagcgccccacccagccctgccctgagccgcagccaccccaggactggatctgtgcagaccagccccagcagcacccctgtggccggccggcggggccggcagctgccccagctgccccccaagggcaccctggacaggaaggccggcggcaagaagctgcggagcacagtgcagaggagcacagaaacaggcctggccgtggagatgaggaactggatgacccggcaggccagccgggagagcacagatggctccatgaacagctacagcagcgagggcaacctgatcttccctggggtgcggctggccagtgacagccagttcagtgacttcctggatggcctgggccctgcccagctggtgggccggcagaccctggccaccccagccatgggagacatccaggtgggcatgatggacaagaagggccagctggaggtggagatcatccgggcccggggcctggtggtgaagccaggcagcaagaccctgcctgccccctacgtgaaggtgtacctgctggacaacggggtgtgcatcgccaagaagaagaccaaggtggccaggaagaccctggagcccctgtaccagcagctgctgagctttgaggagagcccccagggcaaggtgctgcagatcatcgtgtggggagactatggccgcatggaccacaagagcttcatgggcgtggcccagatcctgctggatgagctggagctgagcaacatggtgattggctggttcaagctgttcccccccagcagcctggtggaccccaccctggcccccctgacccggcgggccagccagagcagcctggagagcagcacaggccccagctacagccgctcctag

SEQ ID NO: 167423 - DNA, 858 bp, Artificial Sequence
  Description of Artificial Sequence: Synthetic coding sequence
atgggccggcagggcctgggcggggccagcgctgctggccgctccatgcagaggagccagagccgcagcagcctgagcgccagctttgaggccctggccggctacttcccctgcatgaacagcctggaggaggaggagggggaggccggcggcaagaagctgcggagcacagtgcagaggagcacagagaccggcctggccgtggagatgaggaactggatgacccggcaggccagccgggagagcacagatggctccatgaacagctacagcagcgagggcaacctgatcttccctggggtgcggctggccagtgacagccagttcagtgacttcctggatggcctgggccctgcccagctggtgggccggcagaccctggccaccccagccatgggagacatccaggtgggcatgatggacaagaagggccagctggaggtggagatcatccgggcccggggcctggtggtgaagccaggcagcaagaccctgcctgccccctacgtgaaggtgtacctgctggacaatggagtgtgcatcgccaagaagaagaccaaggtggccaggaagaccctggagcccctgtaccagcagctgctgagctttgaggagagcccccagggcaaggtgctgcagatcatcgtgtggggagactatggccgcatggaccacaagagcttcatgggcgtggcccagatcctgctggatgagctggagctgagcaacatggtgattggctggttcaagctgtttcctcccagcagcctggtggaccccaccctggcccccctgacccggcgggccagccagagcagcctggagagcagcacaggccccagctacagccgctcctag

SEQ ID NO: 167424 - DNA, 384 bp, Artificial Sequence
  Description of Artificial Sequence: Synthetic coding sequence
atgacagagagcggccgcctgtgtgccttcatcaccaaggtgaagaagggcagcctggccgacacagtgggccacctgcggcctggagatgaggtgctggagtggaatggccgcctgctgcagggcgccacctttgaggaggtgtacaacatcatcctggagagcaagccagagccccaggtggagctggtggtgtcccggcccatcggggacatcccccgcatcccagacagcacccacgcccagctggagagcagcctgcccggcctggcctggtggctgaccagggtcatcccagccctgtgggaggccgaggccggcggcagccggggccaggagattgagaccatcctggccaacacagtgaagccccggctgtactag

SEQ ID NO: 167425 - DNA, 4236 bp, Artificial Sequence
  Description of Artificial Sequence: Synthetic coding sequence
atgtctgcccctgtgggcccccggggccgcctggcccccatcccagctgccagccagccccccctgcagcctgagatgccagacctgagccacctgacagaggaggagaggaagatcatcctggccgtgatggaccggcagaagaaggaggtgaaggaggagcacaagccccagctgacccagtggttccccttcagcggcatcacagagctggtgaacaacgtgctgcagccccagcagaagcagcagaatgagaaggagccccagaccaagctgcaccagcagtttgagatgtacaaggagcaggtgaagaagatgggagaggagagccagcagcagcaggagcagaagggagatgcccccacctgtggcatctgccacaagaccaagtttgctgatggctgcggccacaactgcagctactgccagaccaagttctgtgcccgctgtggcggccgggtgtccctgcggagcaacaaggtgatgtgggtgtgcaacctgtgcaggaagcagcaggagatcctgaccaagagcggggcctggttctacaacagcggcagcaacaccccccagcagcctgaccagaaggtgctgcggggcctgagaaatgaggaggccccccaggagaagaagcccaagctgcacgagcagacccagttccagggccccagcggggacctgtctgtgcctgctgtggagaagagccgcagccacggcctgacccggcagcacagcatcaagaatggcagcggcgtgaagcaccacatcgccagtgacatcgccagtgacaggaagaggagccccagcgtgtcccgggaccagaacagaagatatgaccagcgggaggagcgggaggagtacagccagtatgccaccagtgacacagccatgcccaggagccccagcgactatgctgacagaagaagccagcacgagccccagttctatgaagattctgaccacctgagctacagagacagcaacagaagaagccaccgccacagcaaggagtacatcgtggatgatgaagatgtggagagcagagatgaatatgagcggcagaggcgggaggaggagtaccagagccgctacagaagtgaccccaacctggcccgctaccctgtgaagccccagccctatgaggagcagatgagaattcatgctgaggtgtcccgggcccggcatgaaagaagacacagtgatgtgtccctggccaatgctgacctggaggacagccgcatctccatgctgaggatggaccggcccagccggcagaggagcatcagcgagaggagagctgccatggagaaccagaggagctacagcatggagaggacccgggaggcccagggccccagcagctatgcccagaggaccaccaaccacagcccccccaccccccggcgcagccccctgcccatcgacagaccagacctgcggaggacagacagcctgaggaagcagcaccacctggaccccagcagcgctgtgaggaagaccaagcgggagaagatggagaccatgctgagaaatgacagcctgagcagtgaccagagcgagagcgtgcggcccccaccacccaagccccacaagagcaagaagggcggcaagatgaggcagatcagcctgagcagcagcgaggaggagctggccagcaccccagagtacaccagctgtgatgatgtggagattgagagcgagagcgtgtctgagaagggggacagccagaagggcaagaggaagaccagcgagcaggccgtgctgagtgacagcaacaccaggtctgagcggcagaaggagatgatgtactttggaggccacagcctggaggaggacctggagtggagcgagccccagatcaaggacagcggcgtggacacctgcagcagcaccaccctgaatgaggagcacagccacagcgacaagcaccctgtgacctggcagcccagcaaggatggagaccggctgattggccgcatcctgctgaacaagaggctgaaggatggctctgtgccccgggacagcggggccatgctgggcctgaaggtggtgggcggcaagatgacagaaagtggccgcctgtgtgccttcatcaccaaggtgaagaagggcagcctggccgacacagtgggccacctgcggcctggagatgaggtgctggagtggaatggccgcctgctgcagggcgccacctttgaggaggtgtacaacatcatcctggagagcaagccagagccccaggtggagctggtggtgtcccggcccatcggggacatcccccgcatcccagacagcacccacgcccagctggagagcagcagcagcagctttgagagccagaagatggaccggcccagcatctctgtgaccagccccatgagccctggcatgctgagagatgtgccccagttcctgagcggccagctgagcatcaagctgtggtttgacaaggtgggccaccagctgattgtgaccatcctgggcgccaaggacctgcccagccgggaggatggccggcccaggaacccctacgtgaagatctacttcctgcctgacagaagtgacaagaacaagaggaggaccaagacagtgaagaagaccctggagcccaagtggaaccagaccttcatctacagccctgtgcacagaagagagttccgggagaggatgctggagatcaccctgtgggaccaggcccgggtgcgggaggaggagagcgagttcctgggggagatcctgattgagctggagacagccctgctggatgatgagccccactggtacaagctgcagacccatgatgtgagcagcctgcccctgccccaccccagcccctacatgccccggcggcagctgcatggagagagccccacccggcggctgcagaggagcaagaggatcagtgacagcgaggtgtctgactatgactgtgatgatggcattggagtggtgtctgactacagacatgatggccgggacctgcagagcagcaccctgtctgtgcctgagcaggtgatgagcagcaaccactgcagccccagcggcagcccccaccgggtggatgtgattggaagaaccaggtcctggagccccagcgtgcccccaccccagagcagaaatgtggagcagggcctgcggggcaccaggaccatgacaggccactacaacaccatcagcaggatggacagacaccgggtgatggatgaccactacagcccagaccgggaccgggactgtgaggccgctgaccggcagccctaccacaggagccgcagcacagagcagaggcccctgctggagaggaccaccaccaggagccgcagcacagagaggccagacaccaacctgatgaggtccatgcccagcctgatgacaggccgcagcgccccacccagccctgccctgagccgcagccaccccaggacaggctctgtgcagaccagccccagcagcacccctgtggccggcagaagaggccggcagctgccccagctgccccccaagggcaccctggacaggaaggccggcggcaagaagctgcggagcacagtgcagaggagcacagagaccggcctggccgtggagatgaggaactggatgacccggcaggccagccgggagagcacagatggctccatgaacagctacagcagcgagggcaacctgatcttccctggggtgcggctggccagtgacagccagttcagtgacttcctggatggcctgggccctgcccagctggtgggccggcagaccctggccaccccagccatgggagacatccaggtgggcatgatggacaagaagggccagctggaggtggagatcatccgggcccggggcctggtggtgaagccaggcagcaagaccctgcctgccccctacgtgaaggtgtacctgctggacaatggagtgtgcatcgccaagaagaagaccaaggtggccaggaagaccctggagcccctgtaccagcagctgctgagctttgaggagagcccccagggcaaggtgctgcagatcatcgtgtggggagactatggccgcatggaccacaagagcttcatgggcgtggcccagatcctgctggatgagctggagctgagcaacatggtgattggctggttcaagctgtttcctcccagcagcctggtggaccccaccctggcccccctgacccggcgggccagccagagcagcctggagagcagcacaggccccagctacagccgctcctag

SEQ ID NO: 167426 - DNA, 4050 bp, Artificial Sequence
  Description of Artificial Sequence: Synthetic coding sequence
atgtctgcccctgtgggcccccggggccgcctggcccccatcccagctgccagccagccccccctgcagcctgagatgccagacctgagccacctgacagaggaggagaggaagatcatcctggccgtgatggaccggcagaagaaggaggaggagaaggagcagagcgtgctgaagaagctgcaccagcagtttgagatgtacaaggagcaggtgaagaagatgggagaggagagccagcagcagcaggagcagaagggagatgcccccacctgtggcatctgccacaagaccaagtttgctgatggctgcggccacaactgcagctactgccagaccaagttctgtgcccgctgtggcggccgggtgtccctgcggagcaacaaggtgatgtgggtgtgcaacctgtgcaggaagcagcaggagatcctgaccaagagcggggcctggttctacaacagcggcagcaacaccccccagcagcctgaccagaaggtgctgcggggcctgagaaatgaggaggccccccaggagaagaagcccaagctgcacgagcagacccagttccagggccccagcggggacctgtctgtgcctgctgtggagaagagccgcagccacggcctgacccggcagcacagcatcaagaatggaagtggagtgaagcaccacatcgccagtgacatcgccagtgacaggaagaggagccccagcgtgtcccgggaccagaacagaagatatgaccagcgggaggagcgggaggagtacagccagtatgccaccagtgacacagccatgcccaggagccccagcgactatgctgaccggcgcagccagcacgagccccagttctatgaggacagcgaccacctgagctacagagacagcaacagaagaagccaccgccacagcaaggagtacatcgtggatgatgaagatgtggagagcagagatgaatatgaaaggcagaggcgggaggaggagtaccagagccgctacagaagtgaccccaacctggcccgctaccctgtgaagccccagccctatgaggagcagatgagaattcatgctgaggtgtcccgggcccggcatgagcggcggcacagtgatgtgtccctggccaatgctgacctggaggacagccgcatctccatgctgaggatggaccggcccagccggcagaggagcatcagcgagcggcgggccgccatggagaaccagaggagctacagcatggagaggacccgggaggcccagggccccagcagctatgcccagaggaccaccaaccacagcccccccaccccaagaagaagccccctgcccatcgacagaccagacctgcggaggacagacagcctgaggaagcagcaccacctggaccccagcagcgctgtgaggaagaccaagcgggagaagatggagaccatgctgagaaatgacagcctgagcagtgaccagagcgagagcgtgcggcccccaccacccaagccccacaagagcaagaagggcggcaagatgaggcagatcagcctgagcagcagcgaggaggagctggccagcaccccagagtacaccagctgtgatgatgtggagattgaaagtgaatctgtgtctgagaagggggacatggactacaactggctggaccacacctcctggcacagcagcgaggccagccccatgagcctgcaccctgtgacctggcagcccagcaaggatggagaccggctgattggccgcatcctgctgaacaagaggctgaaggatggctctgtgccccgggacagcggggccatgctgggcctgaaggtggtgggcggcaagatgacagaaagtggccgcctgtgtgccttcatcaccaaggtgaagaagggcagcctggccgacacagtgggccacctgcggcctggagatgaggtgctggagtggaatggccgcctgctgcagggcgccacctttgaggaggtgtacaacatcatcctggagagcaagccagagccccaggtggagctggtggtgtcccggcccatcggggacatcccccgcatcccagacagcacccacgcccagctggagagcagcagcagcagctttgagagccagaagatggaccggcccagcatctctgtgaccagccccatgagccctggcatgctgagagatgtgccccagttcctgagcggccagctgagcagccagagcctgagcaggaggaccaccccatttgtgccccgggtgcagatcaagctgtggtttgacaaggtgggccaccagctgattgtgaccatcctgggcgccaaggacctgcccagccgggaggatggccggcccaggaacccctacgtgaagatctacttcctgcctgacagaagtgacaagaacaagaggaggaccaagacagtgaagaagaccctggagcccaagtggaaccagaccttcatctacagccctgtgcacagaagagagttccgggagaggatgctggagatcaccctgtgggaccaggcccgggtgcgggaggaggagagcgagttcctgggggagatcctgattgagctggagacagccctgctggatgatgagccccactggtacaagctgcagacccatgatgtgagcagcctgcccctgccccaccccagcccctacatgccccggcggcagctgcatggagagagccccacccggcggctgcagaggagcaagaggatcagtgacagcgaggtgtctgactatgactgtgatgatggcattggagtggtgtctgactacagacatgatggccgggacctgcagagcagcaccctgtctgtgcctgagcaggtgatgagcagcaaccactgcagccccagcggcagcccccaccgggtggatgtgattggaagaaccaggtcctggagccccagcgtgcccccaccccagagcagaaatgtggagcagggcctgcggggcaccaggaccatgacaggccactacaacaccatcagcaggatggacagacaccgggtgatggatgaccactacagcccagaccgggaccgggactgtgaggccgctgaccggcagccctaccacaggagccgcagcacagagcagaggcccctgctggagaggaccaccaccaggagccgcagcacagagaggccagacaccaacctgatgaggtccatgcccagcctgatgacaggccgcagcgccccacccagccctgccctgagccgcagccaccccaggacaggctctgtgcagaccagccccagcagcacccctgtggccggcagaagaggccggcagctgccccagctgccccccaagggcaccctggacaggaaggccggcggcaagaagctgcggagcacagtgcagaggagcacagagaccggcctggccgtggagatgaggaactggatgacccggcaggccagccgggagagcacagatggctccatgaacagctacagcagcgagggcaacctgatcttccctggggtgcggctggccagtgacagccagttcagtgacttcctggatggcctgggccctgcccagctggtgggccggcagaccctggccaccccagccatgggagacatccaggtgggcatgatggacaagaagggccagctggaggtggagatcatccgggcccggggcctggtggtgaagccaggcagcaagaccctgcctgccccctacgtgaaggtgtacctgctggacaatggagtgtgcatcgccaagaagaagaccaaggtggccaggaagaccctggagcccctgtaccagcagctgctgagctttgaggagagcccccagggcaaggtgctgcagatcatcgtgtggggagactatggccgcatggaccacaagagcttcatgggcgtggcccagatcctgctggatgagctggagctgagcaacatggtgattggctggttcaagctgtttcctcccagcagcctggtggaccccaccctggcccccctgacccggcgggccagccagagcagcctggagagcagcacaggccccagctacagccgctcctag

SEQ ID NO: 167427 - DNA, 3492 bp, Artificial Sequence
  Description of Artificial Sequence: Synthetic coding sequence
atgcagtttgagaccctgcggcaggtgtgcaacagcgtgctgagccacttccacggcgtcttcagcagcccccccaacatcctgcagaatgagctgtttggccagaccctgaacaatgccaggaagaggagccccagcgtgtcccgggaccagaacagaagatatgaccagcgggaggagcgggaggagtacagccagtatgccaccagtgacacagccatgcccaggagccccagcgactatgctgaccggcgcagccagcacgagccccagttctatgaggacagcgaccacctgagctacagagacagcaacagaagaagccaccgccacagcaaggagtacatcgtggatgatgaagatgtggagagcagagatgaatatgaaaggcagaggcgggaggaggagtaccagagccgctacagaagtgaccccaacctggcccgctaccctgtgaagccccagccctatgaggagcagatgagaattcatgctgaggtgtcccgggcccggcatgagcggcggcacagtgatgtgtccctggccaatgctgacctggaggacagccgcatctccatgctgaggatggaccggcccagccggcagaggagcatcagcgagcggcgggccgccatggagaaccagaggagctacagcatggagaggacccgggaggcccagggccccagcagctatgcccagaggaccaccaaccacagcccccccaccccaagaagaagccccctgcccatcgacagaccagacctgcggaggacagacagcctgaggaagcagcaccacctggaccccagcagcgctgtgaggaagaccaagcgggagaagatggagaccatgctgagaaatgacagcctgagcagtgaccagagcgagagcgtgcggcccccaccacccaagccccacaagagcaagaagggcggcaagatgaggcagatcagcctgagcagcagcgaggaggagctggccagcaccccagagtacaccagctgtgatgatgtggagattgaaagtgaatctgtgtctgagaagggggacatggactacaactggctggaccacacctcctggcacagcagcgaggccagccccatgagcctgcaccctgtgacctggcagcccagcaaggatggagaccggctgattggccgcatcctgctgaacaagaggctgaaggatggctctgtgccccgggacagcggggccatgctgggcctgaaggtggtgggcggcaagatgacagaaagtggccgcctgtgtgccttcatcaccaaggtgaagaagggcagcctggccgacacagtgggccacctgcggcctggagatgaggtgctggagtggaatggccgcctgctgcagggcgccacctttgaggaggtgtacaacatcatcctggagagcaagccagagccccaggtggagctggtggtgtcccggcccatcggggacatcccccgcatcccagacagcacccacgcccagctggagagcagcagcagcagctttgagagccagaagatggaccggcccagcatctctgtgaccagccccatgagccctggcatgctgagagatgtgccccagttcctgagcggccagctgagcatcaagctgtggtttgacaaggtgggccaccagctgattgtgaccatcctgggcgccaaggacctgcccagccgggaggatggccggcccaggaacccctacgtgaagatctacttcctgcctgacagaagtgacaagaacaagaggaggaccaagacagtgaagaagaccctggagcccaagtggaaccagaccttcatctacagccctgtgcacagaagagagttccgggagaggatgctggagatcaccctgtgggaccaggcccgggtgcgggaggaggagagcgagttcctgggggagatcctgattgagctggagacagccctgctggatgatgagccccactggtacaagctgcagacccatgatgtgagcagcctgcccctgccccaccccagcccctacatgccccggcggcagctgcatggagagagccccacccggcggctgcagaggagcaagaggatcagtgacagcgaggtgtctgactatgactgtgatgatggcattggagtggtgtctgactacagacatgatggccgggacctgcagagcagcaccctgtctgtgcctgagcaggtgatgagcagcaaccactgcagccccagcggcagcccccaccgggtggatgtgattggaagaaccaggtcctggagccccagcgtgcccccaccccagagcagaaatgtggagcagggcctgcggggcaccaggaccatgacaggccactacaacaccatcagcaggatggacagacaccgggtgatggatgaccactacagcccagaccgggacagccacttcctgaccctgcccaggagccgctacagccagaccatcgaccaccaccacagagatggccgggactgtgaggccgctgaccggcagccctaccacaggagccgcagcacagagcagaggcccctgctggagaggaccaccaccaggagccgcagcacagagaggccagacaccaacctgatgaggtccatgcccagcctgatgacaggccgcagcgccccacccagccctgccctgagccgcagccaccccaggacaggctctgtgcagaccagccccagcagcacccctgtggccggcagaagaggccggcagctgccccagctgccccccaagggcaccctggacaggaaggccggcggcaagaagctgcggagcacagtgcagaggagcacagagaccggcctggccgtggagatgaggaactggatgacccggcaggccagccgggagagcacagatggctccatgaacagctacagcagcgagggcaacctgatcttccctggggtgcggctggccagtgacagccagttcagtgacttcctggatggcctgggccctgcccagctggtgggccggcagaccctggccaccccagccatgggagacatccaggtgggcatgatggacaagaagggccagctggaggtggagatcatccgggcccggggcctggtggtgaagccaggcagcaagaccctgcctgccccctacgtgaaggtgtacctgctggacaatggagtgtgcatcgccaagaagaagaccaaggtggccaggaagaccctggagcccctgtaccagcagctgctgagctttgaggagagcccccagggcaaggtgctgcagatcatcgtgtggggagactatggccgcatggaccacaagagcttcatgggcgtggcccagatcctgctggatgagctggagctgagcaacatggtgattggctggttcaagctgtttcctcccagcagcctggtggaccccaccctggcccccctgacccggcgggccagccagagcagcctggagagcagcacaggccccagctacagccgctcctag

SEQ ID NO: 167428 - DNA, 927 bp, Artificial Sequence
  Description of Artificial Sequence: Synthetic coding sequence
atgtttaatggagagcccggccctgccagcagcggggccagcagaaatgtggtgcgcagcagcagcatcagcggggagatctgtggcagccagcaggccggcggcggggccggcaccaccacagccaagaagagaagaagcagcctgggcgccaagatggtggccatcgtgggcctgacccagtggagcaagagcaccctgcagctgccccagcctgagggcgccaccaagaagctgcggagcaacatccgccgcagcacagaaacaggaattgctgtggagatgaggagccgggtgacccggcagggcagccgggagagcacagatggcagcaccaacagcaacagcagtgatggcaccttcatcttccccaccacccggctgggcgctgagagccagttcagtgacttcctggatggcctgggccctgcccagatcgtgggccggcagaccctggccaccccacccatgggagatgtgcacatcgccatcatggacaggagcggccagctggaggtggaggtgattgaggcccggggcctgacccccaagccaggcagcaagagcctgcctgccacctacatcaaggtgtacctgctggagaatggagcctgcctggccaagaagaagaccaagatgaccaagaagacctgtgaccccctgtaccagcaggccctgctgtttgatgagggcccccagggcaaggtgctgcaggtgattgtgtggggagactatggccgcatggaccacaagtgcttcatgggcatggcccagatcatgctggatgagctggacctgtctgctgctgtgacaggctggtacaagctgttccccaccagctctgtggccgacagcaccctgggcagcctgacccggcggctgagccagagcagcctggagagcgccaccagccccagctgcagctag

SEQ ID NO: 167429 - DNA, 927 bp, Artificial Sequence; identical to SEQ ID NO: 167428
  Description of Artificial Sequence: Synthetic coding sequence

SEQ ID NO: 167430 - DNA, 810 bp, Artificial Sequence
  Description of Artificial Sequence: Synthetic coding sequence
atggagaggagccagagccggctgagcctgagcgccagctttgaggccctggccatctacttcccctgcatgaacagctttgatgatgaagatgctggggacagccggcggctgaagggggccatccagaggagcacagagaccggcctggccgtggagatgcccagcaggaccctgcggcaggccagccatgagagcattgaggacagcatgaacagctatggcagcgagggcaacctgaactacggcggcgtgtgcctggccagtgatgcccagttcagtgacttcctgggctccatgggccctgcccagtttgtgggccggcagaccctggccaccacccccatgggagatgtggagatcggcctgcaggagagaaatggccagctggaggtggacatcatccaggcccggggcctgacagccaagccaggcagcaagaccctgcctgctgcctacatcaaggcctacctgctggagaatggcatctgcatcgccaagaagaagaccaaggtggccaggaagagcctggaccccctgtacaaccaggtgctgctcttccctgagagcccccagggcaaggtgctgcaggtgattgtgtggggcaactacggccgcatggagaggaagcagttcatgggcgtggcccgggtgctgctggaggagctggacctgaccaccctggccgtgggctggtacaagctgttccccaccagctccatggtggaccctgccaccggccccctgctgcggcaggccagccagctgagcctggagagcacagtgggcccctgtggggagaggagctag

SEQ ID NO: 167431 - DNA, 813 bp, Artificial Sequence
  Description of Artificial Sequence: Synthetic coding sequence
atggagaggagccagagccggctgagcctgagcgccagctttgaggccctggccatctacttcccctgcatgaacagctttgatgatgaagatgctgagggggacagccggcggctgaagggggccatccagaggagcacagaaacaggcctggccgtggagatgcccagcaggaccctgcggcaggccagccatgagagcattgaagattccatgaacagctatggcagcgagggcaacctgaactatggaggagtgtgcctggccagtgatgcccagttcagtgacttcctgggctccatgggccctgcccagtttgtgggccggcagaccctggccaccacccccatgggagatgtggagatcggcctgcaggagagaaatggccagctggaggtggacatcatccaggcccggggcctgacagccaagccaggcagcaagaccctgcctgctgcctacatcaaggcctacctgctggagaatggcatctgcatcgccaagaagaagaccaaggtggccaggaagagcctggaccccctgtacaaccaggtgctgctcttccctgagagcccccagggcaaggtgctgcaggtgattgtgtggggcaactacggccgcatggagaggaagcagttcatgggcgtggcccgggtgctgctggaggagctggacctgaccaccctggccgtgggctggtacaagctgttccccaccagctccatggtggaccctgccaccggccccctgctgcggcaggccagccagctgagcctggagagcacagtgggcccctgtggggagaggagctag

SEQ ID NO: 167432 - DNA, 759 bp, Artificial Sequence
  Description of Artificial Sequence: Synthetic coding sequence
atggaggatggagtggccggcccccagctgggcgctgctgctgaggccgctgaggccgctgaggcccgggcccggcctggggtgaccctgcggccctttgcccccctgtctggagctgctgaggctgatgaaggaggaggagactggagcttcatcgactgtgagatggaggaggtggacctgcaggacctgcccagcgccaccatcgcctgccacctggacccccgggtgtttgtggatggcctgtgccgggccaagtttgagagcctcttccgcacctatgacaaggacatcaccttccagtacttcaagagcttcaagagggtgcgcatcaacttcagcaaccccttctctgctgctgatgcccggctgcagctgcacaagacagagttcctgggcaaggagatgaagctgtactttgcccagaccctgcacatcggcagcagccacctggccccacccaacccagacaagcagttcctgatcagccccccagccagcccccctgtgggctggaagcaggtggaggatgccacccctgtgatcaactatgacctgctgtatgccatcagcaagctgggccctggagagaagtatgagctgcatgctgccacagacaccacccccagcgtggtggtgcacgtgtgtgagagtgaccaggagaaggaggaggaggaggagatggagaggatgaggcggcccaagcccaagatcatccagacccggcggcctgagtacacccccatccacctgtcctag

SEQ ID NO: 167433 - DNA, 594 bp, Artificial Sequence
  Description of Artificial Sequence: Synthetic coding sequence
atgcacttcaggaacttcaactacagcttcagcagcctcatcgcctgtgtggccaacagcgacatcttcagcgagagcgagacccgggccaagtttgagagcctcttccgcacctatgacaaggacatcaccttccagtacttcaagagcttcaagagggtgcgcatcaacttcagcaaccccttctctgctgctgatgcccggctgcagctgcacaagacagagttcctgggcaaggagatgaagctgtactttgcccagaccctgcacatcggcagcagccacctggccccacccaacccagacaagcagttcctgatcagccccccagccagcccccctgtgggctggaagcaggtggaggatgccacccctgtgatcaactatgacctgctgtatgccatcagcaagctgggccctggagagaagtatgagctgcacgccgccacagacaccaccccatctgtggtggtgcacgtgtgtgagagtgaccaggagaaggaggaggaggaggagatggagaggatgagaagacccaagcccaagatcatccagaccaggaggcctgagtacacccccatccacctgtcctag

SEQ ID NO: 167434 - DNA, 729 bp, Artificial Sequence
  Description of Artificial Sequence: Synthetic coding sequence
atgcagggcgagcagggcagaagactcttccggctgctgctgaatgacctgcccggccgggaccggctgccctgcagctacccccagccccacgtggagcaggccagcaccagcgccagcccccggctgctggccgtgaacatccctgaggacaccctgctgagctacccagagagcagcctgcccctgcagaggcactgtgccttccaccgcttcagcaaggccaagtttgagagcctcttccgcacctatgacaaggacatcaccttccagtacttcaagagcttcaagagggtgcgcatcaacttcagcaaccccttctctgctgctgatgcccggctgcagctgcacaagacagagttcctgggcaaggagatgaagctgtactttgcccagaccctgcacatcggcagcagccacctggccccacccaacccagacaagcagttcctgatcagccccccagccagcccccctgtgggctggaagcaggtggaggatgccacccctgtgatcaactatgacctgctgtatgccatcagcaagctgggccctggagagaagtatgagctgcatgctgccacagacaccacccccagcgtggtggtgcacgtgtgtgagagtgaccaggagaaggaggaggaggaggagatggagaggatgaggcggcccaagcccaagatcatccagacccggcggcctgagtacacccccatccacctgtcctag

SEQ ID NO: 167435 - DNA, 354 bp, Artificial Sequence
  Description of Artificial Sequence: Synthetic coding sequence
atgaagctgtactttgcccagaccctgcacatcggcagcagccacctggccccacccaacccagacaagcagttcctgatcagccccccagccagcccccctgtgggctggaagcaggtggaggatgccacccctgtgatcaactatgacctgctgtatgccatcagcaagctgggccctggagagaagtatgagctgcacgccgccacagacaccaccccatctgtggtggtgcacgtgtgtgagagtgaccaggagaaggaggaggaggaggagatggagaggatgagaagacccaagcccaagatcatccagaccaggaggcctgagtacacccccatccacctgtcctag

SEQ ID NO: 167436 - DNA, 354 bp, Artificial Sequence; identical to SEQ ID NO: 167435
  Description of Artificial Sequence: Synthetic coding sequence

SEQ ID NO: 167437 - DNA, 354 bp, Artificial Sequence; identical to SEQ ID NO: 167435
  Description of Artificial Sequence: Synthetic coding sequence

SEQ ID NO: 167438 - DNA, 732 bp, Artificial Sequence
  Description of Artificial Sequence: Synthetic coding sequence
atgagaggagagagctacttcatcggcatgaggagccctggccagcagggccacgtgcctgaagatggcggcctcttcctgctgtgctgcatcgaccgggactgggccgtgacccgctgctttgctgaggaggccttccaggccatcacagacttcaatgacctgcccaacagcctgtttgcctgcaatgtgcaccagagcgtgtttgaaggagaggagagcaaggagaagtttgagggcctcttccgcacctatgatgactgtgtgaccttccagctgttcaagagcttccggcgggtgcgcatcaacttcagcaaccccaagtctgctgcccgggccagaattgagctgcacgagacccagttccggggcaagaagctgaagctgtactttgcccaggtgcagaccccagagacagatggagacaagctgcacctggccccaccccagcctgccaagcagttcctgatcagcccccccagcagcccccctgtgggctggcagcccatcaatgatgccacccctgtgctgaactatgacctgctgtatgctgtggccaagctgggccctggagagaagtatgagctgcacgccggcacagagagcaccccatctgtggtggtgcacgtgtgtgacagcgacatcgaggaggaggaggaccccaagaccagccccaagcccaagatcatccagaccaggaggcctggcctgccccccagcgtgagcaactag

SEQ ID NO: 167439 - DNA, 594 bp, Artificial Sequence
  Description of Artificial Sequence: Synthetic coding sequence
atgcctgcccccagcatggactgtgatgtgtccaccctggtggcctgtgtggtggatgtggaggtgttcaccaaccaggaggtgaaggagaagtttgagggcctcttccgcacctatgatgactgtgtgaccttccagctgttcaagagcttccggcgggtgcgcatcaacttcagcaaccccaagtctgctgcccgggccagaattgagctgcacgagacccagttccggggcaagaagctgaagctgtactttgcccaggtgcagaccccagagacagatggagacaagctgcacctggccccaccccagcctgccaagcagttcctgatcagcccccccagcagcccccctgtgggctggcagcccatcaatgatgccacccctgtgctgaactatgacctgctgtatgctgtggccaagctgggccctggagagaagtatgagctgcacgccggcacagagagcaccccatctgtggtggtgcacgtgtgtgacagcgacatcgaggaggaggaggaccccaagaccagccccaagcccaagatcatccagaccaggaggcctggcctgccccccagcgtgagcaactag

SEQ ID NO: 167440 - DNA, 732 bp, Artificial Sequence; identical to SEQ ID NO: 167438
  Description of Artificial Sequence: Synthetic coding sequence

SEQ ID NO: 167441 - DNA, 732 bp, Artificial Sequence; identical to SEQ ID NO: 167438
  Description of Artificial Sequence: Synthetic coding sequence

SEQ ID NO: 167442 - DNA, 1596 bp, Artificial Sequence
  Description of Artificial Sequence: Synthetic coding sequence
atggtggatgtgggcaagtggcccatcttcaccctgctgagcccccaggagatcgccagcatcaggaaggcctgtgtgtttggcaccagcgccagcgaggccctgtatgtgacagacaatgatgaggtgtttgtgtttggcctgaactacagcaactgcctgggcaccggggacaaccagagcaccctggtgcccaagaagctggagggcctgtgtgggaagaagatcaagagcctgtcctatggcagcggcccccacgtgctgctgagcacagaagatggagtggtgtatgcctggggccacaacggctacagccagctgggcaatggcaccaccaaccagggcatcgcccctgtgcaggtgtgcaccaacctgctgatcaagcaggtggtggaggtggcctgtggcagccaccacagcatggccctggccgcagatggagaggtgtttgcctggggctacaacaactgtggccaggtgggcagcggcagcacagccaaccagcccacccccaggaaggtgaccaactgcctgcacatcaagagggtggtgggcatcgcctgtggccagaccagctccatggctgtgctggacaatggagaggtgtatggctggggctacaatggaaatggccagctgggcctgggcaacaacggcaaccagctgacccctgtgcgggtggccgccctgcacagcgtgtgtgtgaaccagatcgtgtgtggctacgcccacaccctggccctgacagatgagggcctgctgtatgcctggggcgccaacacctacggccagctgggcactggaaacaagaacaacctgctgagccctgcccacatcatggtggagaaggagcgggtggtggagattgctgcctgccacagcgcccacaccagcgctgccaagacccagggcggccacgtgtacatgtggggccagtgccggggccagagcgtcatcctgccccacctgacccacttcagctgcacagatgatgtgtttgcctgctttgccaccccagctgtgtcctggaggctgctgtctgtggagcacgaggacttcctgactgtggccgagagcctgaagaaggagtttgacagccctgagacagctgacctgaagttcagaattgatggcaagtacatccacgtgcacaaggctgtgctgaagatccgctgtgagcacttccgctccatgttccagagctactggaatgaagacatgaaggaggtgattgaaattgaccagttctcctaccctgtgtaccgggccttcctgcagtacctgtacacagacacagtggacctgcccccagaagatgccatcggcctgctggacctggccaccagctactgtgagaaccggctgaagaagctgtgccagcacatcatcaagaggggcatcaccgtggagaatgccttcagcctcttctctgctgctgtgcgctatgatgctgaggacctggaggagttctgcttcaagttctgcatcaaccacctgacagaggtgacccagacagctgccttctggcagatggatggccccctgctgaaggagttcatcgccaaggccagcaaatgtggggccttcaagaactag

SEQ ID NO: 167443 - DNA, 1596 bp, Artificial Sequence; identical to SEQ ID NO: 167442
  Description of Artificial Sequence: Synthetic coding sequence

SEQ ID NO: 167444 - DNA, 1068 bp, Artificial Sequence
  Description of Artificial Sequence: Synthetic coding sequence
atggtggatgtgggcaagtggcccatcttcaccctgctgagcccccaggagatcgccagcatcaggaaggcctgtgtgtttggcaccagcgccagcgaggccctgtatgtgacagacaatgatgaggtgtttgtgtttggcctgaactacagcaactgcctgggcaccggggacaaccagagcaccctggtgcccaagaagctggagggcctgtgtgggaagaagatcaagagcctgtcctatggcagcggcccccacgtgctgctgagcacagaagatggagtggtgtatgcctggggccacaacggctacagccagctgggcaatggcaccaccaaccagggcatcgcccctgtgcaggtgtgcaccaacctgctgatcaagcaggtggtggaggtggcctgtggcagccaccacagcatggccctggccgcagatggagaggtgtttgcctggggctacaacaactgtggccaggtgggcagcggcagcacagccaaccagcccacccccaggaaggtgaccaactgcctgcacatcaagagggtggtgggcatcgcctgtggccagaccagctccatggctgtgctggacaatggagaggtgtatggctggggctacaatggaaatggccagctgggcctgggcaacaacggcaaccagctgacccctgtgcgggtggccgccctgcacagcgtgtgtgtgaaccagatcgtgtgtggctacgcccacaccctggccctgacagatgagggcctgctgtatgcctggggcgccaacacctacggccagctgggcactggaaacaagaacaacctgctgagccctgcccacatcatggtggagaaggagcgggtggtggagattgctgcctgccacagcgcccacaccagcgctgccaagacccagggcggccacgtgtacatgtggggccagtgccggggccagagcgtcatcctgccccacctgacccacttcagctgcacagatgatgtgtttgcctgctttgccaccccagctgtgtcctggaggctgctgtctgtggtgtccatcgtgattggcaagtag

SEQ ID NO: 167445 - DNA, 1656 bp, Artificial Sequence
  Description of Artificial Sequence: Synthetic coding sequence
atggaggaggagctgcccctcttcagcggggacagcggcaagcctgtgcaggccaccctgagcagcctgaagatgctggatgtgggcaagtggcccatcttcagcctgtgcagcgaggaggagctgcagctgatccggcaggcctgtgtgtttggatctgctggaaatgaggtgctgtacaccaccgtgaatgatgagatctttgtgctgggcaccaactgctgcggctgcctgggcctgggagatgtgcagagcaccatcgagccccggcggctggacagcctgaatggcaagaagatcgcctgcctgtcctatggcagcggcccccacatcgtgctggccaccacagaaggagaggtgttcacctggggccacaatgcctacagccagctgggcaatggcaccaccaaccacggcctggtgccctgccacatcagcaccaacctgagcaacaagcaggtgattgaggtggcctgtggcagctaccacagcctggtgctgaccagtgatggagaggtgtttgcctggggctacaacaacagcggccaggtgggcagcggcagcacagtgaaccagcccatcccccggcgggtgacaggctgcctgcagaacaaggtggtggtgaccatcgcctgtggccagatgtgctgcatggctgtggtggacacaggagaggtgtatgtgtggggctacaatggaaatggccagctgggcctgggcaacagcggcaaccagcccaccccctgccgggtggccgccctgcagggcatccgggtgcagagggtggcctgtggctacgcccacaccctggtgctgacagatgagggccaggtgtatgcctggggcgccaacagctatggccagctgggcactggaaacaagagcaaccagagctaccccacccctgtgacagtggagaaggaccgcatcattgaaattgctgcctgccacagcacccacaccagcgctgccaagacccagggcggccacgtgtacatgtggggccagtgccggggccagagcgtcatcctgccccacctgacccacttcagctgcacagatgatgtgtttgcctgctttgccaccccagctgtgacctggaggctgctgtctgtggagccagatgaccacctgactgtggccgagagcctgaagcgggagtttgacaacccagacacagctgacctgaagttcctggtggatggcaagtacatctatgcccacaaggtgctgctgaagatccgctgtgagcacttccgcagcagcctggaggacaatgaagatgacatcgtggagatgtctgagttctcctaccctgtgtaccgggccttcctggagtacctgtacacagacagcatcagcctgagccctgaggaggccgtgggcctgctggacctggccaccttctaccgggagaaccggctgaagaagctgtgccagcagaccatcaagcagggcatctgtgaggagaatgccatcgccctgctgtctgctgctgtgaagtatgatgcccaggacctggaggagttctgcttccgcttctgcatcaaccacctgactgtggtgacccagaccagcggctttgctgagatggaccatgacctgctgaagaacttcatcagcaaggccagccgggtgggcgccttcaagaactag

SEQ ID NO: 167446 - DNA, 1671 bp, Artificial Sequence
  Description of Artificial Sequence: Synthetic coding sequence
atgtctgccctgccccgggacctggagctgagcaacccccgggagaagctgaccaagcctgtgcaggccaccctgagcagcctgaagatgctggatgtgggcaagtggcccatcttcagcctgtgcagcgaggaggagctgcagctgatccggcaggcctgtgtgtttggcagcgctggaaatgaggtgctgtacaccaccgtgaatgatgagatctttgtgctgggcaccaactgctgcggctgcctgggcctgggagatgtgcagagcaccatcgagccccggcggctggacagcctgaatggcaagaagatcgcctgcctgtcctatggcagcggcccccacatcgtgctggccaccacagaaggagaggtgttcacctggggccacaatgcctacagccagctgggcaatggcaccaccaaccacggcctggtgccctgccacatcagcaccaacctgagcaacaagcaggtgattgaggtggcctgtggcagctaccacagcctggtgctgaccagtgatggagaggtgtttgcctggggctacaacaacagcggccaggtgggcagcggcagcacagtgaaccagcccatccccaggagagtgacaggctgcctgcagaacaaggtggtggtgaccatcgcctgtggccagatgtgctgcatggctgtggtggacaccggggaggtgtatgtgtggggctacaatggaaatggccagctgggcctgggcaacagcggcaaccagcccaccccctgccgggtggccgccctgcagggcatccgggtgcagagggtggcctgtggctacgcccacaccctggtgctgacagatgagggccaggtgtatgcctggggcgccaacagctatggccagctgggcaccggcaacaagagcaaccagagctaccccacccctgtgacagtggagaaggaccgcatcatcgagattgctgcctgccacagcacccacaccagcgctgccaagacccagggcggccacgtgtacatgtggggccagtgccggggccagagcgtcatcctgccccacctgacccacttcagctgcacagatgatgtgtttgcctgctttgccaccccagctgtgacctggaggctgctgtctgtggagccagatgaccacctgactgtggccgagagcctgaagcgggagtttgacaacccagacacagctgacctgaagttcctggtggatggcaagtacatctatgcccacaaggtgctgctgaagatccgctgtgagcacttccgcagcagcctggaggacaatgaagatgacatcgtggagatgtctgagttctcctaccctgtgtaccgggccttcctggagtacctgtacacagacagcatcagcctgagccctgaggaggccgtgggcctgctggacctggccaccttctacagagaaaatcggctgaagaagctgtgccagcagaccatcaagcagggcatctgtgaagaaaatgccatcgccctgctgtctgctgctgtgaagtatgatgcccaggacctggaggagttctgcttccgcttctgcatcaaccacctgactgtggtgacccagaccagcggctttgctgagatggaccatgacctgctgaagaacttcatcagcaaggccagccgggtgggcgccttcaagaactag

SEQ ID NO: 167447 - DNA, 1512 bp, Artificial Sequence
  Description of Artificial Sequence: Synthetic coding sequence
atgctgcaggacggcagctgcaagcagatgctgctgatgctgctgattgtgcagcctgtgcaggccaccctgagcagcctgaagatgctggatgtgggcaagtggcccatcttcagcctgtgcagcgaggaggagctgcagctgatccggcaggcctgtgtgtttggatctgctggaaatgaggtgctgtacaccaccgtgaatgatgagatctttgtgctgggcaccaactgctgcggctgcctgggcctgggagatgtgcagagcaccatcgagccccggcggctggacagcctgaatggcaagaagatcgcctgcctgtcctatggcagcggcccccacatcgtgctggccaccacagaaggagaggtgttcacctggggccacaatgcctacagccagctgggcaatggcaccaccaaccacggcctggtgccctgccacatcagcaccaacctgagcaacaagcaggtgattgaggtggcctgtggcagctaccacagcctggtgctgaccagtgatggagaggtgtttgcctggggctacaacaacagcggccaggtgggcagcggcagcacagtgaaccagcccatcccccggcgggtgacaggctgcctgcagaacaaggtggtggtgaccatcgcctgtggccagatgtgctgcatggctgtggtggacacaggagaggtgtatgtgtggggctacaatggaaatggccagctgggcctgggcaacagcggcaaccagcccaccccctgccgggtggccgccctgcagggcatccgggtgcagagggtggcctgtggctacacccacaccagcgctgccaagacccagggcggccacgtgtacatgtggggccagtgccggggccagagcgtcatcctgccccacctgacccacttcagctgcacagatgatgtgtttgcctgctttgccaccccagctgtgacctggaggctgctgtctgtggagccagatgaccacctgactgtggccgagagcctgaagcgggagtttgacaacccagacacagctgacctgaagttcctggtggatggcaagtacatctatgcccacaaggtgctgctgaagatccgctgtgagcacttccgcagcagcctggaggacaatgaagatgacatcgtggagatgtctgagttctcctaccctgtgtaccgggccttcctggagtacctgtacacagacagcatcagcctgagccctgaggaggccgtgggcctgctggacctggccaccttctaccgggagaaccggctgaagaagctgtgccagcagaccatcaagcagggcatctgtgaggagaatgccatcgccctgctgtctgctgctgtgaagtatgatgcccaggacctggaggagttctgcttccgcttctgcatcaaccacctgactgtggtgacccagaccagcggctttgctgagatggaccatgacctgctgaagaacttcatcagcaaggccagccgggtgggcgccttcaagaactag

SEQ ID NO: 167448 - DNA, 1671 bp, Artificial Sequence
  Description of Artificial Sequence: Synthetic coding sequence
ccctgcagcaaccgctacccaggcggcggcgctgacaaggccccagcctgtgaggagcctgtgcaggccaccctgagcagcctgaagatgctggatgtgggcaagtggcccatcttcagcctgtgcagcgaggaggagctgcagctgatccggcaggcctgtgtgtttggcagcgctggaaatgaggtgctgtacaccaccgtgaatgatgagatctttgtgctgggcaccaactgctgcggctgcctgggcctgggagatgtgcagagcaccatcgagccccggcggctggacagcctgaatggcaagaagatcgcctgcctgtcctatggcagcggcccccacatcgtgctggccaccacagaaggagaggtgttcacctggggccacaatgcctacagccagctgggcaatggcaccaccaaccacggcctggtgccctgccacatcagcaccaacctgagcaacaagcaggtgattgaggtggcctgtggcagctaccacagcctggtgctgaccagtgatggagaggtgtttgcctggggctacaacaacagcggccaggtgggcagcggcagcacagtgaaccagcccatccccaggagagtgacaggctgcctgcagaacaaggtggtggtgaccatcgcctgtggccagatgtgctgcatggctgtggtggacaccggggaggtgtatgtgtggggctacaatggaaatggccagctgggcctgggcaacagcggcaaccagcccaccccctgccgggtggccgccctgcagggcatccgggtgcagagggtggcctgtggctacgcccacaccctggtgctgacagatgagggccaggtgtatgcctggggcgccaacagctatggccagctgggcaccggcaacaagagcaaccagagctaccccacccctgtgacagtggagaaggaccgcatcatcgagattgctgcctgccacagcacccacaccagcgctgccaagacccagggcggccacgtgtacatgtggggccagtgccggggccagagcgtcatcctgccccacctgacccacttcagctgcacagatgatgtgtttgcctgctttgccaccccagctgtgacctggaggctgctgtctgtggagccagatgaccacctgactgtggccgagagcctgaagcgggagtttgacaacccagacacagctgacctgaagttcctggtggatggcaagtacatctatgcccacaaggtgctgctgaagatccgctgtgagcacttccgcagcagcctggaggacaatgaagatgacatcgtggagatgtctgagttctcctaccctgtgtaccgggccttcctggagtacctgtacacagacagcatcagcctgagccctgaggaggccgtgggcctgctggacctggccaccttctacagagaaaatcggctgaagaagctgtgccagcagaccatcaagcagggcatctgtgaagaaaatgccatcgccctgctgtctgctgctgtgaagtatgatgcccaggacctggaggagttctgcttccgcttctgcatcaaccacctgactgtggtgacccagaccagcggctttgctgagatggaccatgacctgctgaagaacttcatcagcaaggccagccgggtgggcgccttcaagaactag

SEQ ID NO: 167449 - DNA, 834 bp, Artificial Sequence
  Description of Artificial Sequence: Synthetic coding sequence
atgtctggagtgaccacagagaccggcagcctggacagcgccaccgtggccaccagccagcccctggccgagtggcagctgtgcaaggcctctgtgtcccggggcatcattgaaattgctgcctgccacagcacccacaccagcgctgccaagacccagggcggccacgtgtacatgtggggccagtgccggggccagagcgtcatcctgccccacctgacccacttcagctgcacagatgatgtgtttgcctgctttgccaccccagctgtgacctggaggctgctgtctgtggagccagatgaccacctgactgtggccgagagcctgaagcgggagtttgacaacccagacacagctgacctgaagttcctggtggatggcaagtacatctatgcccacaaggtgctgctgaagatccgctgtgagcacttccgcagcagcctggaggacaatgaagatgacatcgtggagatgtctgagttctcctaccctgtgtaccgggccttcctggagtacctgtacacagacagcatcagcctgagccctgaggaggccgtgggcctgctggacctggccaccttctaccgggagaaccggctgaagaagctgtgccagcagaccatcaagcagggcatctgtgaggagaatgccatcgccctgctgtctgctgctgtgaagtatgatgcccaggacctggaggagttctgcttccgcttctgcatcaaccacctgactgtggtgacccagaccagcggctttgctgagatggaccatgacctgctgaagaacttcatcagcaaggccagccgggtgggcgccttcaagaactag

SEQ ID NO: 167450 - DNA, 846 bp, Artificial Sequence
  Description of Artificial Sequence: Synthetic coding sequence
atgctggatgtgggcaagtggcccatcttcagcctgtgcagcgaggaggagctgcagctgatccggcaggcctgtgtgtttggatctgctggaaatgaggtgctgtacaccaccgtgaatgatgagatctttgtgctgggcaccaactgctgcggctgcctgggcctgggagatgtgcagagcaccatcgagccccggcggctggacagcctgaatggcaagaagatcgcctgcctgtcctatggcagcggcccccacatcgtgctggccaccacagaaggagaggtgttcacctggggccacaatgcctacagccagctgggcaatggcaccaccaaccacggcctggtgccctgccacatcagcaccaacctgagcaacaagcaggtgattgaggtggcctgtggcagctaccacagcctggtgctgaccagtgatggagaggtgtttgcctggggctacaacaacagcggccaggtgggcagcggcagcacagtgaaccagcccatcccccggcgggtgacaggctgcctgcagaacaaggtggtggtgaccatcgcctgtggccagatgtgctgcatggctgtggtggacacaggagaggtgtatgtgtggggctacaatggaaatggccagctgggcctgggcaacagcggcaaccagcccaccccctgccgggtggccgccctgcagggcatccgggtgcagagggactacagagactgcagcctgagcctgcacacccacgtgtgtggccaggatgctggctgggcccgggtgcacgtgggccctgtgcccggctctgtgcgggaccccccagccccccaccccctgctgctgcactag

SEQ ID NO: 167451 - DNA, 1359 bp, Artificial Sequence
  Description of Artificial Sequence: Synthetic coding sequence
atgagccccaagagaattgccaagagaagaagccccccagcagatgccatccccaagagcaagaaggtgaaggacaccagggctgctgccagccggcgggtgcctggggcccggagctgccagggcgcctgtggccccagccccccagaccagaagaccaggcctgtgagccacaggagccacagcacagagcccggcctggtgctgaccctgggccagggagatgtgggccagctgggcctgggagaaaatgtgatggagaggaagaagccagccctggtgtccatcccagaagatgtggtgcaggccgaggccggcggcatgcacacagtgtgcctgagcaagagcggccaggtgtacagctttggctgcaatgatgagggcgccctgggccgggacacctctgtggagggcagcgagatggtgcctgggaaggtggagctgcaggagaaggtggtgcaggtgtctgctggggacagccacacagctgccctgacagatgatggccgggtcttcctgtggggcagcttccgggacaacaatggagtcatcggcctgctggagcccatgaagaagtccatggtgcctgtgcaggtgcagctggatgtgcctgtggtgaaggtggccagcggaaatgaccacctggtgatgctgacagcagatggagacctgtacaccctgggctgtggggagcagggccagctgggccgggtgcctgagctgtttgccaacagaggaggccggcagggcctggagcggctgctggtgcccaagtgtgtgatgctgaagagccggggcagccggggccacgtgcgcttccaggatgccttctgtggggcctacttcacctttgccatcagccatgagggccacgtgtatggcttcggcctgagcaactaccaccagctgggcaccccaggcacagagagctgcttcatcccccagaacctgaccagcttcaagaacagcaccaagtcctgggtgggcttcagcggcggccagcaccacacagtgtgcatggacagcgagggcaaggcctacagcctgggccgggcagaatatggccgcctgggcctgggggagggcgctgaggagaagagcatccccaccctcatcagccggctgcctgctgtgtcctctgtggcctgtggggcctctgtgggctatgctgtgaccaaggatggccgggtgtttgcctggggcatgggcaccaactaccagctgggcaccggccaggatgaagatgcctggagccctgtggagatgatgggcaagcagctggagaacagagtggtgctgtctgtgtcctctgggggccagcacacagtgctgctggtgaaggacaaggagcagagctag

SEQ ID NO: 167452 - DNA, 1266 bp, Artificial Sequence
  Description of Artificial Sequence: Synthetic coding sequence
atgagccccaagagaattgccaagagaagaagccccccagcagatgccatccccaagagcaagaaggtgaaggtgagccacaggagccacagcacagagcccggcctggtgctgaccctgggccagggagatgtgggccagctgggcctgggggagaatgtgatggagaggaagaagccagccctggtgtccatcccagaagatgtggtgcaggccgaggccggcggcatgcacacagtgtgcctgagcaagagcggccaggtgtacagctttggctgcaatgatgaaggagccctgggccgggacacctctgtggagggcagcgagatggtgcctgggaaggtggagctgcaggagaaggtggtgcaggtgtctgctggggacagccacacagctgccctgacagatgatggccgggtcttcctgtggggcagcttccgggacaacaacggggtgattggcctgctggagcccatgaagaagtccatggtgcctgtgcaggtgcagctggatgtgcctgtggtgaaggtggccagcggaaatgaccacctggtgatgctgacagcagatggagacctgtacaccctgggctgtggggagcagggccagctgggccgggtgcctgagctgtttgccaacagaggaggccggcagggcctggagcggctgctggtgcccaagtgtgtgatgctgaagagccggggcagccggggccacgtgcgcttccaggatgccttctgtggggcctacttcacctttgccatcagccatgagggccacgtgtatggcttcggcctgagcaactaccaccagctgggcaccccaggcacagagagctgcttcatcccccagaacctgaccagcttcaagaacagcaccaagtcctgggtgggcttcagcggcggccagcaccacacagtgtgcatggattctgagggcaaggcctacagcctgggccgggcagaatatggccgcctgggcctgggggagggcgctgaggagaagagcatccccaccctcatcagccggctgcctgctgtgtcctctgtggcctgtggggcctctgtgggctatgctgtgaccaaggatggccgggtgtttgcctggggcatgggcaccaactaccagctgggcaccggccaggatgaagatgcctggagccctgtggagatgatgggcaagcagctggagaacagagtggtgctgtctgtgagcagcggcggccagcacacagtgctgctggtgaaggacaaggagcagagctag

SEQ ID NO: 167453 - DNA, 1266 bp, Artificial Sequence; identical to SEQ ID NO: 167452
  Description of Artificial Sequence: Synthetic coding sequence

SEQ ID NO: 167454 - DNA, 1266 bp, Artificial Sequence; identical to SEQ ID NO: 167452
  Description of Artificial Sequence: Synthetic coding sequence

SEQ ID NO: 167455 - DNA, 693 bp, Artificial Sequence
  Description of Artificial Sequence: Synthetic coding sequence
atgagccccaagagaattgccaagagaagaagccccccagcagatgccatccccaagagcaagaaggtgaaggtgagccacaggagccacagcacagagcccggcctggtgctgaccctgggccagggagatgtgggccagctgggcctgggggagaatgtgatggagaggaagaagccagccctggtgtccatcccagaagatgtggtgcaggccgaggccggcggcatgcacacagtgtgcctgagcaagagcggccaggtgtacagctttggctgcaatgatgaaggagccctgggccgggacacctctgtggagggcagcgagatggtgcctgggaaggtggagctgcaggagaaggtggtgcaggtgtctgctggggacagccacacagctgccctgacagatgatggccgggtcttcctgtggggcagcttccgggacaacaacggggtgattggcctgctggagcccatgaagaagtccatggtgcctgtgcaggtgcagctggatgtgcctgtggtgaaggtggccagcggaaatgaccacctggtgatgctgacagcagatggagacctgtacaccctgggctgtggggagcagggccagctgggccgggtgcctgagctgtttgccaacagaggaggccggcagggcctggagcggctgctggtgcccaagtgtgtgatgtag

SEQ ID NO: 167456 - DNA, 852 bp, Artificial Sequence
  Description of Artificial Sequence: Synthetic coding sequence
atgagccccaagagaattgccaagagaagaagccccccagcagatgccatccccaagagcaagaaggtgaaggtgagccacaggagccacagcacagagcccggcctggtgctgaccctgggccagggagatgtgggccagctgggcctgggggagaatgtgatggagaggaagaagccagccctggtgtccatcccagaagatgtggtgcaggccgaggccggcggcatgcacacagtgtgcctgagcaagagcggccaggtgtacagctttggctgcaatgatgaaggagccctgggccgggacacctctgtggagggcagcgagatggtgcctgggaaggtggagctgcaggagaaggtggtgcaggtgtctgctggggacagccacacagctgccctgacagatgatggccgggtcttcctgtggggcagcttccgggacaacaacggggtgattggcctgctggagcccatgaagaagtccatggtgcctgtgcaggtgcagctggatgtgcctgtggtgaaggtggccagcggaaatgaccacctggtgatgctgacagcagatggagacctgtacaccctgggctgtggggagcagggccagctgggccgggtgcctgagctgtttgccaacagaggaggccggcagggcctggagcggctgctggtgcccaagtgtgtgatgctgaagagccggggcagccggggccacgtgcgcttccaggatgccttctgtggggcctacttcacctttgccatcagccatgagggccacgtgtatggcttcggcctgagcaactaccaccagctgggcaccccaggcacagagagctgcttcatcccctag

SEQ ID NO: 167457 - DNA, 708 bp, Artificial Sequence
  Description of Artificial Sequence: Synthetic coding sequence
atggcccgggaggagtgcaaggccctgctggatggcctgaacaagaccacagcctgctaccaccacctggtgctgactgtgggcggcagcgctgacagccagaacctgcggcaggagctgcagaagacccggcagaaggcccaggagctggccgtgtccacctgtgcccggctgacagctgtgctgcgggaccggggcctggccgcagatgaaagagctgagtttgagcggctgtgggtggccttcagcggctgcctggacctgctggaggccgacatgaggcgggccctggagctgggcgccgccttccccctgcacgccccccggcggcccctggtgaggactggagtggccggggccagcagcggcgtggccgcccgggccctgagcaccaggagcctgcggctggaggccgagggggactttgatgtggccgacctgcgggagctggagcgggaggtgctgcaggtgggggagatgattgacaacatggagatgaaggtgaatgtgccccgctggacagtgcaggcccggcaggccgccggggctgagctgctgagcacagtgtctgctggccccagctctgtggtgtccctgcaggagcggggcggcggctgtgaccccaggaaggccctggccgccatcctgtttggagctgtgctgctggccgctgtggccctggccgtgtgtgtggccaagctgtcctag

SEQ ID NO: 167458 - DNA, 630 bp, Artificial Sequence
  Description of Artificial Sequence: Synthetic coding sequence
atgagagctgctgccatcagcacccccaagctggacaagatgcctggcatgttcttcagcgccaaccccaaggagctgaagggcaccacccacagcctgctggatgacaagatgcagaagagaagacccaagaccttcggcatggacatgaaggcctacctgcgctccatgatcccccacctggagagcggcatgaagagcagcaagagcaaggatgtgctgtctgctgctgaggtgatgcagtggagccagagcctggagaagctgctggccaaccagacaggccagaatgtgtttggcagcttcctgaagtctgagttcagcgaggagaacatcgagttctggctggcctgtgaggactacaagaagacagaaagtgacctgctgccctgcaaggccgaggagatctacaaggcctttgtgcacagtgatgctgccaagcagatcaacatcgacttccgcacccgggagagcacagccaagaagatcaaggcccccacccccacctgctttgatgaggcccagaaggtgatctacaccctgatggagaaggacagctacccccgcttcctgaagagtgacatctacctgaacctgctgaatgacctgcaggccaacagcctgaagtag

SEQ ID NO: 167459 - DNA, 1044 bp, Artificial Sequence
  Description of Artificial Sequence: Synthetic coding sequence
atgcctgggaagcccaagcacctgggcgtgcccaacggccgcatggtgctggccgtgtctgatggagagctgagcagcaccaccggcccccagggccagggcgagggccggggcagcagcctgagcatccacagcctgcccagcggccccagcagccccttccccacctttgtgagcagcaagtctgagagccacaggaagagcctgggcagcacagaaggagagagcgagagcaggcctgggaagtactgctgcgtgtacctgcctgatggaacagccagcctggccctggcccggcccggcctgaccatccgggacatgctggccggcatctgtgagaagaggggcctgagcctgcctgacatcaaggtgtacctggtgggcaatgagcagaaggccctggtgctggaccaggactgcaccgtgctggccgaccaggaggtgcggctggagaaccgcatcacctttgagctggagctgacagccctggagcgggtggtgcgcatcagcgccaagcccaccaagaggctgcaggaggccctgcagcccatcctggagaagcacggcctgagccccctggaggtggtgctgcacaggcctggagagaagcagcccctggacctgggcaagctggtgtcctctgtggccgcccagaggctggtgctggacaccctgcccggggtgaagatcagcaaggcccgggacaagagcccctgccgcagccagggctgcccccccaggacccaggacaaggccacccaccccccaccagccagccccagcagcctggtgaaggtgcccagcagcgccaccgggaagaggcagacctgtgacatcgagggcctggtggagctgctgaacagagtgcagagcagcggggcccatgaccagaggggcctgctgaggaaggaggacctggtgctgcctgagttcctgcagctgcctgcccagggccccagcagcgaggagaccccaccccagaccaagtctgctgcccagcccatcggcggcagcctgaacagcaccacagattctgccctgtag

SEQ ID NO: 167460 - DNA, 1701 bp, Artificial Sequence
  Description of Artificial Sequence: Synthetic coding sequence
atgcctgggaagcccaagcacctgggcgtgcccaacggccgcatggtgctggccgtgtctgatggagagctgagcagcaccaccggcccccagggccagggcgagggccggggcagcagcctgagcatccacagcctgcccagcggccccagcagccccttccccacagaggagcagcctgtggcctcctgggccctgagctttgagcggctgctgcaggaccccctgggcctggcctacttcacagagttcctgaagaaggagttcagcgcagaaaatgtgaccttctggaaggcctgtgagcgcttccagcagatcccagccagtgacacccagcagctggcccaggaggccaggaacatctaccaggagttcctgagcagccaggccctgagccctgtgaacatcgaccggcaggcctggctgggggaggaggtgctggccgagcccaggccagacatgttccgggcccagcagctgcagatcttcaacctgatgaagtttgacagctatgccaggtttgtgaagagccccctgtaccgggagtgcctgctggccgaggccgagggccggcccctgcgggagcccggcagcagccggctgggcagcccagatgccaccaggaagaagcccaagctgaagccaggcaagagcctgcccctgggcgtggaggagctgggccagctgccccctgtggagggccctgggggccggcccctgaggaagagcttcagaagagagctgggcggcacagccaatgctgccctgcggcgggagagccagggcagcctgaacagcagcgccagcctggacctgggcttcctggcctttgtgagcagcaagtctgagagccacaggaagagcctgggcagcacagaaggagagagcgagagcaggcctgggaagtactgctgcgtgtacctgcctgatggaacagccagcctggccctggcccggcccggcctgaccatccgggacatgctggccggcatctgtgagaagaggggcctgagcctgcctgacatcaaggtgtacctggtgggcaatgagcaggccctggtgctggaccaggactgcaccgtgctggccgaccaggaggtgcggctggagaaccgcatcacctttgagctggagctgacagccctggagcgggtggtgcgcatcagcgccaagcccaccaagaggctgcaggaggccctgcagcccatcctggagaagcacggcctgagccccctggaggtggtgctgcacaggcctggagagaagcagcccctggacctgggcaagctggtgtcctctgtggccgcccagaggctggtgctggacaccctgcccggggtgaagatcagcaaggcccgggacaagagcccctgccgcagccagggctgcccccccaggacccaggacaaggccacccaccccccaccagccagccccagcagcctggtgaaggtgcccagcagcgccaccgggaagaggcagacctgtgacatcgagggcctggtggagctgctgaacagagtgcagagcagcggggcccatgaccagaggggcctgctgaggaaagaagacctggtgctgcctgagttcctgcagctgcctgcccagggccccagcagcgaggagaccccaccccagaccaagtctgctgcccagcccatcggcggcagcctgaacagcaccacagacagcgccctgtag

SEQ ID NO: 167461 - DNA, 1314 bp, Artificial Sequence
  Description of Artificial Sequence: Synthetic coding sequence
tgaagccctgtgaacatcgaccggcaggcctggctgggggaggaggtgctggccgagcccaggccagacatgttccgggcccagcagctgcagatcttcaacctgatgaagtttgacagctatgccaggtttgtgaagagccccctgtaccgggagtgcctgctggccgaggccgagggccggcccctgcgggagcccggcagcagccggctgggcagcccagatgccaccaggaagaagcccaagctgaagccaggcaagagcctgcccctgggcgtggaggagctgggccagctgccccctgtggagggccctgggggccggcccctgaggaagagcttcagaagagagctgggcggcacagccaatgctgccctgcggcgggagagccagggcagcctgaacagcagcgccagcctggacctgggcttcctggcctttgtgagcagcaagtctgagagccacaggaagagcctgggcagcacagaaggagagagcgagagcaggcctgggaagtactgctgcgtgtacctgcctgatggaacagccagcctggccctggcccggcccggcctgaccatccgggacatgctggccggcatctgtgagaagaggggcctgagcctgcctgacatcaaggtgtacctggtgggcaatgagcagaaggccctggtgctggaccaggactgcaccgtgctggccgaccaggaggtgcggctggagaaccgcatcacctttgagctggagctgacagccctggagcgggtggtgcgcatcagcgccaagcccaccaagaggctgcaggaggccctgcagcccatcctggagaagcacggcctgagccccctggaggtggtgctgcacaggcctggagagaagcagcccctggacctgggcaagctggtgtcctctgtggccgcccagaggctggtgctggacaccctgcccggggtgaagatcagcaaggcccgggacaagagcccctgccgcagccagggctgcccccccaggacccaggacaaggccacccaccccccaccagccagccccagcagcctggtgaaggtgcccagcagcgccaccgggaagaggcagacctgtgacatcgagggcctggtggagctgctgaacagagtgcagagcagcggggcccatgaccagaggggcctgctgaggaaggaggacctggtgctgcctgagttcctgcagctgcctgcccagggccccagcagcgaggagaccccaccccagaccaagtctgctgcccagcccatcggcggcagcctgaacagcaccacagattctgccctgtag

SEQ ID NO: 167462 - DNA, 609 bp, Artificial Sequence
  Description of Artificial Sequence: Synthetic coding sequence
atgtgcaggaccctggccgccttccccaccacctgcctggagcgggccaaggagttcaagacccggctgggcatcttcctgcacaagtctgagctgggctgtgacaccggcagcacaggcaagtttgagtggggcagcaagcacagcaaagaaaatagaaacttctctgaagatgtgctgggctggagggagagctttgacctgctgctgagcagcaagaatggagtggccgccttccacgccttcctgaagacagagttcagcgaggagaacctggagttctggctggcctgtgaggagttcaagaagatccgcagcgccaccaagctggccagccgggcccaccagatctttgaggagttcatctgcagcgaggcccccaaggaggtgaacatcgaccacgagacccatgagctgaccaggatgaacctgcagacagccacagccacctgctttgatgctgcccagggcaagaccaggaccctgatggagaaggacagctacccccgcttcctgaagagccctgcctacagagacctggccgcccaggccagcgctgccagcgccaccctgagcagctgcagcctggatgagcccagccacacctag

SEQ ID NO: 167463 - DNA, 459 bp, Artificial Sequence
  Description of Artificial Sequence: Synthetic coding sequence
atgcctgtgaagtgctgcttctaccgcagccccacagctgagaccatgacctggagcgagaacatggacaccctgctggccaaccaggccggcctggatgccttccgcatcttcctgaagtctgagttcagcgaggagaatgtggagttctggctggcctgtgaggacttcaagaagaccaagaatgctgacaagatcgccagcaaggccaagatgatctacagcgagttcatcgaggctgatgcccccaaggagatcaacatcgactttggcacccgggacctgatcagcaagaacattgctgagcccaccctgaagtgctttgatgaggcccagaagctgatctactgcctgatggccaaggacagcttcccccgcttcctgaagtctgagatctacaagaagctggtgaacagccagcaggtgcccaaccacaagaagtggctgcccttcctgtag

SEQ ID NO: 167464 - DNA, 1809 bp, Artificial Sequence
  Description of Artificial Sequence: Synthetic coding sequence
atggagaggagcctgcaccgggtgtccctgggcagcagaagagcccacccagacctgtccttctacctgaccaccttcggccagctgcggctgagcattgatgcccaggacagagtgctgctgctgcacatcatcgagggcaagggcctcatcagcaagcagcccggcacctgtgacccctacgtgaagatcagcctcatccctgaggacagccggctgcggcaccagaagacccagacagtgcctgactgccgggaccctgccttccacgagcacttcttcttccctgtgcaggaggaggatgaccagaagaggctgctggtgacagtgtggaacagagccagccagagccggcagagcggcctgattggctgcatgagctttggagtgaagagcctgctgaccccagacaaggagatcagcggctggtactacctgctgggggagcacctgggccgcaccaagcacctgaaggtggcccggcggcggctgcggcccctgcgggaccccctgctgaggatgcctgggggcggggacacagaaaatggcaagaagctgaagatcaccatcccccggggcaaggatggcttcggcttcaccatctgctgtgacagccctgtgcgggtgcaggccgtggacagcggcggccctgctgagagagctggcctgcagcagctggacacagtgctgcagctgaatgaaagacctgtggagcactggaagtgtgtggagctggcccacgagatccgcagctgccccagcgagatcatcctgctggtgtggaggatggtgccccaggtgaagccaggcccagatggcggcgtgctgcggcgggccagctgcaagagcacccatgacctgcagagcccccccaacaagcgggagaagaactgcacccacggcgtgcaggcccggcctgagcagaggcacagctgccacctggtgtgtgacagcagtgatggcctgctgctgggcggctgggagcgctacacagaggtggccaagagaggaggccagcacaccctgcctgccctgagccgggccacagcccccacagaccccaactacatcatcctggcccccctgaaccctggcagccagctgctgcggcctgtgtaccaggaggacaccatccctgaggagagcggcagccccagcaagggcaagagctacacaggcctgggcaagaagagccggctgatgaagacagtgcagaccatgaagggccacggcaactaccagaactgccctgtggtgcggccccacgccacccacagcagctatggcacctacgtgaccctggcccccaaggtgctggtgtttcctgtgtttgtgcagcccctggacctgtgcaacccagcccggaccctgctgctgtctgaggagctgctgctgtatgagggcaggaacaaggctgctgaggtgaccctgtttgcctacagcgacctgctgctcttcaccaaggaggatgagcccggccgctgtgatgtgctgaggaaccccctgtacctgcagagcgtgaagctgcaggagggcagcagcgaggacctgaagttctgtgtgctgtacctggccgagaaggcagaatgtctcttcaccctggaggcccacagccaggagcagaagaagagggtgtgctggtgcctgtctgaaaatattgccaagcagcagcagctggccgccagccccccagacagcaagaagctgcaccccttcggcagcctgcagcaggagatgggccctgtgaacagcaccaatgccacccaggacaggagcttcaccagccctggccagaccctgattggatag

SEQ ID NO: 167465 - DNA, 507 bp, Artificial Sequence
  Description of Artificial Sequence: Synthetic coding sequence
atgaagaacaagctgggcatcttcagaagaagaaatgaaagccctggggcccccccagctgggaaggctgacaagatgatgaagagcttcaagcccaccagcgaggaggccctgaagtggggcgagagcctggagaagctgctggtgcacaagtatggcctggccgtgttccaggccttcctgaggacagagttcagcgaggagaacctggagttctggctggcctgtgaggacttcaagaaggtgaagagccagagcaagatggccagcaaggccaagaagatctttgctgagtacatcgccatccaggcctgcaaggaggtgaacctggacagctacacccgggagcacaccaaggacaacctgcagagcgtgacccggggctgctttgacctggcccagaagaggatcttcggcctgatggagaaggacagctacccccgcttcctgcggagtgacctgtacctggacctgatcaaccagaagaagatgagcccccccctgtag

SEQ ID NO: 167466 - DNA, 2754 bp, Artificial Sequence
  Description of Artificial Sequence: Synthetic coding sequence
atgaaccgcttcaacggcctgtgcaaggtgtgcagcgagcggcgctaccggcagatcaccatcccccggggcaaggatggcttcggcttcaccatctgctgtgacagccctgtgcgggtgcaggccgtggacagcggcggccctgctgagcgggccggcctgcagcagctggacacagtgctgcagctgaatgaaagacctgtggagcactggaagtgtgtggagctggcccacgagatccgcagctgccccagcgagatcatcctgctggtgtggaggatggtgccccaggtgaagccaggcccagatggaggagtgctgcggcgggccagctgcaagagcacccatgacctgcagagcccccccaacaagcgggagaagaactgcacccatggagtgcaggcccggcctgagcagaggcacagctgccacctggtgtgtgacagcagtgatggcctgctgctgggcggctgggagcgctacacagaggtggccaagaggggcggccagcacaccctgcctgccctgagccgggccacagcccccacagaccccaactacatcatcctggcccccctgaaccctggcagccagctgctgcggcctgtgtaccaggaggacaccatccctgaggagagcggcagccccagcaagggcaagagctacacaggcctgggcaagaagagccggctgatgaagacagtgcagaccatgaagggccacggcaactaccagaactgccctgtggtgcggccccacgccacccacagcagctatggcacctacgtgaccctggcccccaaggtgctggtgtttcctgtgtttgtgcagcccctggacctgtgcaacccagcccggaccctgctgctgtctgaggagctgctgctgtatgagggcaggaacaaggctgctgaggtgaccctgtttgcctacagcgacctgctgctcttcaccaaggaggatgagcccggccgctgtgatgtgctgaggaaccccctgtacctgcagagcgtgaagctgcaggagggcagcagcgaggacctgaagttctgtgtgctgtacctggccgagaaggccgagtgcctcttcaccctggaggcccacagccaggagcagaagaagagggtgtgctggtgcctgtctgagaacatcgccaagcagcagcagctggccgccagccccccagacagcaagatgtttgaaacagaagcagatgagaagcgggagatggccctggaggagggcaagggccctggagctgaggacagcccccccagcaaggagcccagccctggccaggagctgcccccaggccaggacctgccccccaacaaggacagccccagcggccaggagcccgcccccagccaggagcccctgagcagcaaggacagcgccaccagcgagggcagccccccaggcccagatgccccacccagcaaggatgtgcccccctgccaggagcccccaccagcccaggacctgagcccctgccaggacctgcctgctggccaggagcccctgccccaccaggaccccctgctgaccaaggacctgcctgccatccaggagagccccacccgggacctgcccccctgccaggacctgccccccagccaggtgtccctgcctgccaaggccctgacagaggacaccatgagcagcggggacctgctggccgccaccggggaccccccagctgcccccaggcctgcctttgtgattcctgaggtgcggctggacagcacctacagccagaaggccggggctgagcagggctgcagcggagatgaagaagatgctgaggaggccgaggaggtggaggagggggaggagggggaggaggatgaagatgaggacaccagtgatgacaactacggggagaggtctgaggccaagaggagctccatgattgagaccggccagggcgctgagggcggcctgagcctgcgggtgcagaacagcctgcggcggaggacccacagcgagggcagcctgctgcaggagccccggggcccctgctttgccagtgacaccaccctgcactgcagtgatggagagggcgccgccagcacctggggcatgcccagccccagcaccctgaagaaggagctgggcagaaatggaggctccatgcaccacctgagcctcttcttcaccggccacaggaagatgtctggagctgacacagtgggagatgatgatgaggccagcaggaagaggaagagcaagaacctggccaaggacatgaagaacaagctgggcatcttcagaagaagaaatgaaagccctggggcccctcctgctgggaaggctgacaagatgatgaagagcttcaagcccaccagcgaggaggccctgaagtggggcgagagcctggagaagctgctggtgcacaagtatggcctggccgtgttccaggccttcctgaggacagagttcagcgaggagaacctggagttctggctggcctgtgaggacttcaagaaggtgaagagccagagcaagatggccagcaaggccaagaagatctttgctgagtacatcgccatccaggcctgcaaggaggtgaacctggacagctacacccgggagcacaccaaggacaacctgcagagcgtgacccggggctgctttgacctggcccagaagaggatcttcggcctgatggagaaggacagctacccccgcttcctgcggagtgacctgtacctggacctgatcaaccagaagaagatgagcccccccctgtag

SEQ ID NO: 167467 - DNA, 3597 bp, Artificial Sequence
  Description of Artificial Sequence: Synthetic coding sequence
atgcctgtgatcccagccctgtgggaggtggagatgggccgcagccagggccaggagattgagaccatcctggccaacagaagccacagcgacagcacccccctgcccaacttcctgagcggcagccacaggcctgagtgctgcacctgccgcctgctgacagccagcggggcccaggacagcctgcccttcggccggcggctgtacagcggcccctggaggagctgtgaggaggtgtgccacgtgtctgtgctgtctgtgctgagcaccagctgtggcctgagcctgagcctgcccatcttccctggctggatggagtggctgagcccagacatcgccctgcccaggagagatgagtggacccagaccagccctgccaggaagaggatcacccacgccaaggtgcagggcgccggccagctgcggctgagcattgatgcccaggacagagtgctgctgctgcacatcatcgagggcaagggcctcatcagcaagcagcccggcacctgtgacccctacgtgaagatcagcctcatccctgaggacagccggctgcggcaccagaagacccagacagtgcctgactgccgggaccctgccttccacgagcacttcttcttccctgtgcaggaggaggatgaccagaagaggctgctggtgacagtgtggaacagagccagccagagccggcagagcggcctgattggctgcatgagctttggagtgaagagcctgctgaccccagacaaggagatcagcggctggtactacctgctgggggagcacctgggccgcaccaagcacctgaaggtggcccggcggcggctgcggcccctgcgggaccccctgctgaggatgcctgggggcggggacacagaaaatggcaagaagctgaagatcaccatcccccggggcaaggatggcttcggcttcaccatctgctgtgacagccctgtgcgggtgcaggccgtggacagcggcggccctgctgagagagctggcctgcagcagctggacacagtgctgcagctgaatgaaagacctgtggagcactggaagtgtgtggagctggcccacgagatccgcagctgccccagcgagatcatcctgctggtgtggaggatggtgccccaggtgaagccaggcccagatggcggcgtgctgcggcgggccagctgcaagagcacccatgacctgcagagcccccccaacaagcgggagaagaactgcacccacggcgtgcaggcccggcctgagcagaggcacagctgccacctggtgtgtgacagcagtgatggcctgctgctgggcggctgggagcgctacacagaggtggccaagagaggaggccagcacaccctgcctgccctgagccgggccacagcccccacagaccccaactacatcatcctggcccccctgaaccctggcagccagctgctgcggcctgtgtaccaggaggacaccatccctgaggagagcggcagccccagcaagggcaagagctacacaggcctgggcaagaagagccggctgatgaagacagtgcagaccatgaagggccacggcaactaccagaactgccctgtggtgcggccccacgccacccacagcagctatggcacctacgtgaccctggcccccaaggtgctggtgtttcctgtgtttgtgcagcccctggacctgtgcaacccagcccggaccctgctgctgtctgaggagctgctgctgtatgagggcaggaacaaggctgctgaggtgaccctgtttgcctacagcgacctgctgctcttcaccaaggaggatgagcccggccgctgtgatgtgctgaggaaccccctgtacctgcagagcgtgaagctgcaggagggcagcagcgaggacctgaagttctgtgtgctgtacctggccgagaaggcagaatgtctcttcaccctggaggcccacagccaggagcagaagaagagggtgtgctggtgcctgtctgaaaatattgccaagcagcagcagctggccgccagccccccagacagcaagatgtttgaaacagaagcagatgagaagcgggagatggccctggaggagggcaaaggacctggagctgaggacagcccccccagcaaggagcccagccctggccaggagctgcccccaggccaggacctgccccccaacaaggacagccccagcggccaggagcccgcccccagccaggagcccctgagcagcaaggacagcgccaccagcgagggcagccccccaggcccagatgccccacccagcaaggatgtgcccccctgccaggagcccccaccagcccaggacctgagcccctgccaggacctgcctgctggccaggagcccctgccccaccaggaccccctgctgaccaaggacctgcctgccatccaggagagccccacccgggacctgcccccctgccaggacctgccccccagccaggtgtccctgcctgccaaggccctgacagaggacaccatgagcagcggggacctgctggccgccactggagaccccccagctgcccccaggcctgccttcgtcatccctgaggtgcggctggacagcacctacagccagaaggccggggctgagcagggctgcagcggagatgaggaggatgctgaggaggccgaggaggtggaggagggggaggagggggaggaggatgaagatgaggacaccagtgatgacaactatggagagaggtctgaggccaagaggagctccatgattgaaacaggccagggcgctgagggcggcctgagcctgcgggtgcagaacagcctgcggcggaggacccacagcgagggcagcctgctgcaggagccccggggcccctgctttgccagtgacaccaccctgcactgcagtgatggagagggcgccgccagcacctggggcatgcccagccccagcaccctgaagaaggagctgggcagaaatggaggctccatgcaccacctgagcctcttcttcaccggccacaggaagatgtctggagctgacacagtgggagatgatgatgaggccagcaggaagaggaagagcaagaacctggccaaggacatgaagaacaagctgggcatcttcagaagaagaaatgaaagccctggggcccccccagctgggaaggctgacaagatgatgaagagcttcaagcccaccagcgaggaggccctgaagtggggcgagagcctggagaagctgctggtgcacaagtatggcctggccgtgttccaggccttcctgaggacagagttcagcgaggagaacctggagttctggctggcctgtgaggacttcaagaaggtgaagagccagagcaagatggccagcaaggccaagaagatctttgctgagtacatcgccatccaggcctgcaaggaggtgaacctggacagctacacccgggagcacaccaaggacaacctgcagagcgtgacccggggctgctttgacctggcccagaagaggatcttcggcctgatggagaaggacagctacccccgcttcctgcggagtgacctgtacctggacctgatcaaccagaagaagatgagcccccccctgtag

SEQ ID NO: 167468 - DNA, 1560 bp, Artificial Sequence
  Description of Artificial Sequence: Synthetic coding sequence
atgtttgaaacagaagcagatgagaagcgggagatggccctggaggagggcaagggccctggagctgaggacagcccccccagcaaggagcccagccctggccaggagctgcccccaggccaggacctgccccccaacaaggacagccccagcggccaggagcccgcccccagccaggagcccctgagcagcaaggacagcgccaccagcgagggcagccccccaggcccagatgccccacccagcaaggatgtgcccccctgccaggagcccccaccagcccaggacctgagcccctgccaggacctgcctgctggccaggagcccctgccccaccaggaccccctgctgaccaaggacctgcctgccatccaggagagccccacccgggacctgcccccctgccaggacctgccccccagccaggtgtccctgcctgccaaggccctgacagaggacaccatgagcagcggggacctgctggccgccaccggggaccccccagctgcccccaggcctgcctttgtgattcctgaggtgcggctggacagcacctacagccagaaggccggggctgagcagggctgcagcggagatgaagaagatgctgaggaggccgaggaggtggaggagggggaggagggggaggaggatgaagatgaggacaccagtgatgacaactacggggagaggtctgaggccaagaggagctccatgattgagaccggccagggcgctgagggcggcctgagcctgcgggtgcagaacagcctgcggcggaggacccacagcgagggcagcctgctgcaggagccccggggcccctgctttgccagtgacaccaccctgcactgcagtgatggagagggcgccgccagcacctggggcatgcccagccccagcaccctgaagaaggagctgggcagaaatggaggctccatgcaccacctgagcctcttcttcaccggccacaggaagatgtctggagctgacacagtgggagatgatgatgaggccagcaggaagaggaagagcaagaacctggccaaggacatgaagaacaagctgggcatcttcagaagaagaaatgaaagccctggggcccctcctgctgggaaggctgacaagatgatgaagagcttcaagcccaccagcgaggaggccctgaagtggggcgagagcctggagaagctgctggtgcacaagtatggcctggccgtgttccaggccttcctgaggacagagttcagcgaggagaacctggagttctggctggcctgtgaggacttcaagaaggtgaagagccagagcaagatggccagcaaggccaagaagatctttgctgagtacatcgccatccaggcctgcaaggaggtgaacctggacagctacacccgggagcacaccaaggacaacctgcagagcgtgacccggggctgctttgacctggcccagaagaggatcttcggcctgatggagaaggacagctacccccgcttcctgcggagtgacctgtacctggacctgatcaaccagaagaagatgagcccccccctgtag

SEQ ID NO: 167469 - DNA, 3597 bp, Artificial Sequence; identical to SEQ ID NO: 167467
  Description of Artificial Sequence: Synthetic coding sequence

SEQ ID NO: 167470 - DNA, 1776 bp, Artificial Sequence
  Description of Artificial Sequence: Synthetic coding sequence
atgaaccgcttcaacggcctgtgcaaggtgtgcagcgagcggcgctaccggcagatcaccatcccccggggcaaggatggcttcggcttcaccatctgctgtgacagccctgtgcgggtgcaggccgtggacagcggcggccctgctgagcgggccggcctgcagcagctggacacagtgctgcagctgaatgaaagacctgtggagcactggaagtgtgtggagctggcccacgagatccgcagctgccccagcgagatcatcctgctggtgtggaggatggtgccccaggtgaagccaggcccagatggaggagtgctgcggcgggccagctgcaagagcacccatgacctgcagagcccccccaacaagcgggagaagaactgcacccatggagtgcaggcccggcctgagcagaggcacagctgccacctggtgtgtgacagcagtgatggcctgctgctgggcggctgggagcgctacacagaggtggccaagaggggcggccagcacaccctgcctgccctgagccgggccacagcccccacagaccccaactacatcatcctggcccccctgaaccctggcagccagctgctgcggcctgtgtaccaggaggacaccatccctgaggagagcggcagccccagcaagggcaagagctacacaggcctgggcaagaagagccggctgatgaagacagtgcagaccatgaagggccacggcaactaccagaactgccctgtggtgcggccccacgccacccacagcagctatggcacctacgtgaccctggcccccaaggtgctggtgtttcctgtgtttgtgcagcccctggacctgtgcaacccagcccggaccctgctgctgtctgaggagctgctgctgtatgagggcaggaacaaggctgctgaggtgaccctgtttgcctacagcgacctgctgctcttcaccaaggaggatgagcccggccgctgtgatgtgctgaggaaccccctgtacctgcagagcgtgaagctgcaggagggcagcagcgaggacctgaagttctgtgtgctgtacctggccgagaaggccgagtgcctcttcaccctggaggcccacagccaggagcagaagaagagggtgtgctggtgcctgtctgagaacatcgccaagcagcagcagctggccgccagccccccagacagcaagatgtctggagctgacacagtgggagatgatgatgaggccagcaggaagaggaagagcaagaacctggccaaggacatgaagaacaagctgggcatcttcagaagaagaaatgaaagccctggggcccctcctgctgggaaggctgacaagatgatgaagagcttcaagcccaccagcgaggaggccctgaagtggggcgagagcctggagaagctgctggtgcacaagtatggcctggccgtgttccaggccttcctgaggacagagttcagcgaggagaacctggagttctggctggcctgtgaggacttcaagaaggtgaagagccagagcaagatggccagcaaggccaagaagatctttgctgagtacatcgccatccaggcctgcaaggaggtgaacctggacagctacacccgggagcacaccaaggacaacctgcagagcgtgacccggggctgctttgacctggcccagaagaggatcttcggcctgatggagaaggacagctacccccgcttcctgcggagtgacctgtacctggacctgatcaaccagaagaagatgagcccccccctgtag

SEQ ID NO: 167471 - DNA, 1560 bp, Artificial Sequence; identical to SEQ ID NO: 167468
  Description of Artificial Sequence: Synthetic coding sequence

SEQ ID NO: 167472 - DNA, 936 bp, Artificial Sequence
  Description of Artificial Sequence: Synthetic coding sequence
atggtgacccggcggcctgtgaccaacagctgggactggctgcctgctggggccgcccctgaggccgtgccctgccgccacatgcccctgagccggctgcccctgcgggtgggccagaaggagttcttcttccccctgcccctgctggtgccccccatctcctggctgctgctgtctgagagccagccccggctggtgcccggcagccctgtgatccggcccggcttccagagggcctgtgtggccgccgcctgcaccgtggccgcccgctgccccggccggggcgtgggggacaggagccagagcggggccagctaccggcccatctgtggccccaaggtgggcggccccacagagatgctgcggggcatgtacctgaccagaaatggaaacctgcagaggaggcacaccatgaaggaggccaaggacatgaagaacaagctgggcatcttcagaagaagaaatgaaagccctggggcccctcctgctgggaaggctgacaagatgatgaagagcttcaagcccaccagcgaggaggccctgaagtggggcgagagcctggagaagctgctggtgcacaagtatggcctggccgtgttccaggccttcctgaggacagagttcagcgaggagaacctggagttctggctggcctgtgaggacttcaagaaggtgaagagccagagcaagatggccagcaaggccaagaagatctttgctgagtacatcgccatccaggcctgcaaggaggtgaacctggacagctacacccgggagcacaccaaggacaacctgcagagcgtgacccggggctgctttgacctggcccagaagaggatcttcggcctgatggagaaggacagctacccccgcttcctgcggagtgacctgtacctggacctgatcaaccagaagaagatgagcccccccctgtag

SEQ ID NO: 167473 - DNA, 564 bp, Artificial Sequence
  Description of Artificial Sequence: Synthetic coding sequence
atgaagcaccggctgggcttcctgctgcagaagagtgacagctgtgagcacaacagcagccacaacaagaaggacaaggtggtgatctgccagagggtgtcccaggaggaggtgaagaagtgggccgagagcctggagaacctgatcagccatgaatgtggcctggccgccttcaaggccttcctgaagtctgagtacagtgaagaaaatattgacttctggatcagctgtgaggagtacaagaagatcaagagccccagcaagctgagccccaaggccaagaagatctacaatgagttcatctctgtgcaggccaccaaggaggtgaacctggacagctgcacccgggaggagaccagcaggaacatgctggagcccaccatcacctgctttgatgaggcccagaagaagatcttcaacctgatggagaaggacagctaccgccgcttcctgaagagccgcttctacctggacctggtgaaccccagcagctgtggggctgagaagcagaagggggccaagagcagcgctgactgtgccagcctggtgccccagtgtgcctag

SEQ ID NO: 167474 - DNA, 282 bp, Artificial Sequence
  Description of Artificial Sequence: Synthetic coding sequence
atgtgcaagggcctggccggcctgcctgccagctgcctgcggagcgccaaggacatgaagcaccggctgggcttcctgctgcagaagagtgacagctgtgagcacaacagcagccacaacaagaaggacaaggtggtgatctgccagagggtgtcccaggaggaggtgaagaagtgggccgagagcctggagaacctgatcagccatgaatgtgagcccggcttcctgcaccagggccgggacaagccagagcacgcccgggcctacaacaacctgctgtag

SEQ ID NO: 167475 - DNA, 618 bp, Artificial Sequence
  Description of Artificial Sequence: Synthetic coding sequence
atgtgcaagggcctggccggcctgcctgccagctgcctgcggagcgccaaggacatgaagcaccggctgggcttcctgctgcagaagagtgacagctgtgagcacaacagcagccacaacaagaaggacaaggtggtgatctgccagagggtgtcccaggaggaggtgaagaagtgggccgagagcctggagaacctgatcagccatgaatgtggcctggccgccttcaaggccttcctgaagtctgagtacagtgaagaaaatattgacttctggatcagctgtgaggagtacaagaagatcaagagccccagcaagctgagccccaaggccaagaagatctacaatgagttcatctctgtgcaggccaccaaggaggtgaacctggacagctgcacccgggaggagaccagcaggaacatgctggagcccaccatcacctgctttgatgaggcccagaagaagatcttcaacctgatggagaaggacagctaccgccgcttcctgaagagccgcttctacctggacctggtgaaccccagcagctgtggggctgagaagcagaagggggccaagagcagcgctgactgtgccagcctggtgccccagtgtgcctag

SEQ ID NO: 167476 - DNA, 909 bp, Artificial Sequence
  Description of Artificial Sequence: Synthetic coding sequence
atgtacaacatgatgctgctgatccagaagaggaagggcatcggcagccagctgctgcgggccggggaggccgagggggacagaggagctggaacagctgagaggagcagtgactggctggatggccgctcctgggccatcaaggagacccccaccggcctggccggcagaagaagtgaggacagcgacaacatcttcaccggggaggaggccaagtatgcccagagccgcagccacagcagcagctgccgcatctccttcctgctggccaacagcaagctgctgaacaagatgtgcaagggcctggccggcctgcctgccagctgcctgcggagcgccaaggacatgaagcaccggctgggcttcctgctgcagaagagtgacagctgtgagcacaacagcagccacaacaagaaggacaaggtggtgatctgccagagggtgtcccaggaggaggtgaagaagtgggccgagagcctggagaacctgatcagccatgaatgtggcctggccgccttcaaggccttcctgaagtctgagtacagcgaggagaacatcgacttctggatcagctgtgaggagtacaagaagatcaagagccccagcaagctgagccccaaggccaagaagatctacaatgagttcatctctgtgcaggccaccaaggaggtgaacctggacagctgcacccgggaggagaccagcaggaacatgctggagcccaccatcacctgctttgatgaggcccagaagaagatcttcaacctgatggagaaggacagctaccgccgcttcctgaagagccgcttctacctggacctggtgaaccccagcagctgtggggctgagaagcagaagggggccaagagcagcgctgactgtgccagcctggtgccccagtgtgcctag

SEQ ID NO: 167477 - DNA, 564 bp, Artificial Sequence; identical to SEQ ID NO: 167473
  Description of Artificial Sequence: Synthetic coding sequence

SEQ ID NO: 167478 - DNA, 432 bp, Artificial Sequence
  Description of Artificial Sequence: Synthetic coding sequence
atgaagcaccggctgggcttcctgctgcagaagagtgacagctgtgagcacaacagcagccacaacaagaaggacaaggtggtgatctgccagagggtgtcccaggaggaggtgaagaagtgggccgagagcctggagaacctgatcagccatgaatgtggcctggccgccttcaaggccttcctgaagtctgagtacagtgaagaaaatattgacttctggatcagctgtgaggagtacaagaagatcaagagccccagcaagctgagccccaaggccaagaagatctacaatgagttcatctctgtgcaggccaccaaggaggtgaacctggacagctgcacccgggaggagaccagcaggaacatgctggagcccaccatcacctgctttgatgaggcccagaagaagatcttcaacctgatggagtag

SEQ ID NO: 167479 - DNA, 546 bp, Artificial Sequence
  Description of Artificial Sequence: Synthetic coding sequence
atgtgcaagggcctggccgccctgccccacagctgcctggagcgggccaaggagatcaagatcaagctgggcatcctgctgcagaagccagacagcgtgggggacctggtgatcccctacaatgagaagccagagaagccagccaagacccagaagaccagcctggatgaggccctgcagtggagggacagcctggacaagctgctgcagaacaactacggcctggccagcttcaagagcttcctgaagtctgagttcagcgaggagaacctggagttctggatcgcctgtgaggactacaagaagatcaagagccctgccaagatggccgagaaggccaagcagatctatgaggagttcatccagacagaggcccccaaggaggtgaacatcgaccacttcaccaaggacatcaccatgaagaacctggtggagcccagcctgagcagctttgacatggcccagaagagaattcatgccctgatggagaaggacagcctgcccaggtttgtgcgctctgagttctaccaggagctgatcaagtag

SEQ ID NO: 167480 - DNA, 606 bp, Artificial Sequence
  Description of Artificial Sequence: Synthetic coding sequence
atgtgtgccaggaacatcagccaggacatcctgatcctgcagatgcacagcgcccactggcacatcaatggcaagtatgaggagaagagcaacctgatgttctgggccaaggagatcaagatcaagctgggcatcctgctgcagaagccagacagcgtgggggacctggtgatcccctacaatgagaagccagagaagccagccaagacccagaagaccagcctggatgaggccctgcagtggagggacagcctggacaagctgctgcagaacaactacggcctggccagcttcaagagcttcctgaagtctgagttcagcgaggagaacctggagttctggatcgcctgtgaggactacaagaagatcaagagccctgccaagatggccgagaaggccaagcagatctatgaggagttcatccagacagaggcccccaaggaggtgaacatcgaccacttcaccaaggacatcaccatgaagaacctggtggagcccagcctgagcagctttgacatggcccagaagagaattcatgccctgatggagaaggacagcctgcccaggtttgtgcgctctgagttctaccaggagctgatcaagtag

SEQ ID NO: 167481 - DNA, 222 bp, Artificial Sequence
  Description of Artificial Sequence: Synthetic coding sequence
atggccgagaaggccaagcagatctatgaggagttcatccagacagaggcccccaaggaggtgaacatcgaccacttcaccaaggacatcaccatgaagaacctggtggagcccagcctgagcagctttgacatggcccagaagagaattcatgccctgatggagaaggacagcctgcccaggtttgtgcgctctgagttctaccaggagctgatcaagtag

SEQ ID NO: 167482 - DNA, 1362 bp, Artificial Sequence
  Description of Artificial Sequence: Synthetic coding sequence
atggcccagggcagcggggaccagagagctgtgggcgtggccgaccctgaggagagcagccccaacatgattgtgtactgcaagattgaggacatcatcaccaagatgcaggatgacaagacaggaggagtgcccatcagaacagtgaagagcttcctgagcaagatccccagcgtggtgactggaacagacatcgtgcagtggctgatgaagaacctgagcattgaggaccctgtggaggccatccacctgggcagcctgattgctgcccagggctacatcttccccatcagtgaccacgtgctgaccatgaaggatgatggcaccttctaccgcttccaggccccctacttctggcccagcaactgctgggagccagaaaatacagattatgccatctacctgtgcaagaggaccatgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcagaaaatgtagaaggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaagccagagagcgagcagggccgccgcaccagcctggagaagttcaccaggtctgtgggcaagagcctggccggcaagaggctgaccggcctgatgcagagcagctag

SEQ ID NO: 167483 - DNA, 1383 bp, Artificial Sequence
  Description of Artificial Sequence: Synthetic coding sequence
atggcccagggcagcggggaccagagagctgtgggcgtggccgaccctgaggagagcagccccaacatgattgtgtactgcaagattgaggacatcatcaccaagatgcaggatgacaagacaggaggagtgcccatcagaacagtgaagagcttcctgagcaagatccccagcgtggtgactggaacagacatcgtgcagtggctgatgaagaacctgagcattgaggaccctgtggaggccatccacctgggcagcctgattgctgcccagggctacatcttccccatcagtgaccacgtgctgaccatgaaggatgatggcaccttctaccgcttccaggccccctacttctggcccagcaactgctgggagccagaaaatacagattatgccatctacctgtgcaagaggaccatgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcagaaaatgtagaaggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcctgattgcctacacagagcagtatgtggagtatgaccccctcatcaccccagctgagcccagcaacccctggatcagtgatgatgtggccctgtgggacatcgagatgagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaaggtgtggctgctgtag

SEQ ID NO: 167484 - DNA, 1419 bp, Artificial Sequence
  Description of Artificial Sequence: Synthetic coding sequence
atggcccagggcagcggggaccagagagctgtgggcgtggccgaccctgaggagagcagccccaacatgattgtgtactgcaagattgaggacatcatcaccaagatgcaggatgacaagacaggaggagtgcccatcagaacagtgaagagcttcctgagcaagatccccagcgtggtgactggaacagacatcgtgcagtggctgatgaagaacctgagcattgaggaccctgtggaggccatccacctgggcagcctgattgctgcccagggctacatcttccccatcagtgaccacgtgctgaccatgaaggatgatggcaccttctaccgcttccaggccccctacttctggcccagcaactgctgggagccagaaaatacagattatgccatctacctgtgcaagaggaccatgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcagaaaatgtagaaggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcctgattgcctacacagagcagtatgtggagtatgaccccctcatcaccccagctgagcccagcaacccctggatcagtgatgatgtggccctgtgggacatcgagatgagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaagggcaagagcctggccggcaagaggctgaccggcctgatgcagagcagctag

SEQ ID NO: 167485 - DNA, 1443 bp, Artificial Sequence
  Description of Artificial Sequence: Synthetic coding sequence
atggcccagggcagcggggaccagagagctgtgggcgtggccgaccctgaggagagcagccccaacatgattgtgtactgcaagattgaggacatcatcaccaagatgcaggatgacaagacaggaggagtgcccatcagaacagtgaagagcttcctgagcaagatccccagcgtggtgactggaacagacatcgtgcagtggctgatgaagaacctgagcattgaggaccctgtggaggccatccacctgggcagcctgattgctgcccagggctacatcttccccatcagtgaccacgtgctgaccatgaaggatgatggcaccttctaccgcttccaggccccctacttctggcccagcaactgctgggagccagaaaatacagattatgccatctacctgtgcaagaggaccatgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcagaaaatgtagaaggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcctgattgcctacacagagcagtatgtggagtatgaccccctcatcaccccagctgagcccagcaacccctggatcagtgatgatgtggccctgtgggacatcgagatgagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaagccagagagcgagcagggccgccgcaccagcctggagaagttcaccaggtctgtgtgcctgcagctgctcttctag

SEQ ID NO: 167486 - DNA, 1428 bp, Artificial Sequence
  Description of Artificial Sequence: Synthetic coding sequence
atggcccagggcagcggggaccagagagctgtgggcgtggccgaccctgaggagagcagccccaacatgattgtgtactgcaagattgaggacatcatcaccaagatgcaggatgacaagacaggaggagtgcccatcagaacagtgaagagcttcctgagcaagatccccagcgtggtgactggaacagacatcgtgcagtggctgatgaagaacctgagcattgaggaccctgtggaggccatccacctgggcagcctgattgctgcccagggctacatcttccccatcagtgaccacgtgctgaccatgaaggatgatggcaccttctaccgcttccaggccccctacttctggcccagcaactgctgggagccagaaaatacagattatgccatctacctgtgcaagaggaccatgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcagaaaatgtagaaggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcctgattgcctacacagagcagtatgtggagtatgaccccctcatcaccccagctgagcccagcaacccctggatcagtgatgatgtggccctgtgggacatcgagatgagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaagccagagagcgagcagggccgccgcaccagcctggagaagttcaccaggtctgtgggctag

SEQ ID NO: 167487 - DNA, 1434 bp, Artificial Sequence
  Description of Artificial Sequence: Synthetic coding sequence
atggcccagggcagcggggaccagagagctgtgggcgtggccgaccctgaggagagcagccccaacatgattgtgtactgcaagattgaggacatcatcaccaagatgcaggatgacaagacaggaggagtgcccatcagaacagtgaagagcttcctgagcaagatccccagcgtggtgactggaacagacatcgtgcagtggctgatgaagaacctgagcattgaggaccctgtggaggccatccacctgggcagcctgattgctgcccagggctacatcttccccatcagtgaccacgtgctgaccatgaaggatgatggcaccttctaccgcttccaggccccctacttctggcccagcaactgctgggagccagaaaatacagattatgccatctacctgtgcaagaggaccatgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcagaaaatgtagaaggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcctgattgcctacacagagcagtatgtggagtatgaccccctcatcaccccagctgagcccagcaacccctggatcagtgatgatgtggccctgtgggacatcgagatgagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaagccagagagcgagcagggccgccgcaccagcctggagaagttcaccaggtctgtgctgctcttctag

SEQ ID NO: 167488 - DNA, 1620 bp, Artificial Sequence
  Description of Artificial Sequence: Synthetic coding sequence
atgaagaacctgagcattgaagatcctgtggaggccatccacctgggcagcctgattgctgcccagggctacatcttccccatcagtgaccacgtgctgaccatgaaggatgatggcaccttctaccgcttccaggccccctacttctggcccagcaactgctgggagcctgagaacacagattatgccatctacctgtgcaagaggaccatgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcaggaagtgccggcggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcctcatcgcctacacagagcagtatgtggagtatgaccccctcatcaccccagctgagcccagcaacccctggatcagtgatgatgtggccctgtgggacatcgagatgagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaagccagagagcgagcagggccgccgcaccagcctggagaagttcaccaggtctgtgaatgtgcagaacaccaggcctgctggggcctggagcatcttcatggccgccctgcccatggctgtgtggctgcggacccccaggagctgccacggcctgtctgagagccggctgctgggcctgcccagcctgcatgatggcctgcgggagggccagagcctgccccagagctgccccggcagcagcagcacagctgctgagggcgcccgggagcgggccagcaatggccgcagcctggcccggcggcagcactgccagtgccacggccagggcgaggagacccagctgtgcctgtggagccggctggagagcagcaagaggagccagagggccagcagcctgcggaccagcaaggccaagaagaagaggcagacagtgaagcagggccccaaggcctggccctag

SEQ ID NO: 167489 - DNA, 1299 bp, Artificial Sequence
  Description of Artificial Sequence: Synthetic coding sequence
attgaggacatcatcaccaagatgcaggatgacaagacaggaggagtgcccatcagaacagtgaagagcttcctgagcaagatccccagcgtggtgactggaacagacatcgtgcagtggctgatgaagaacctgagcattgaggaccctgtggaggccatccacctgggcagcctgattgctgcccagggctacatcttccccatcagtgaccacgtgctgaccatgaaggatgatggcaccttctaccgcttccaggccccctacttctggcccagcaactgctgggagccagaaaatacagattatgccatctacctgtgcaagaggaccatgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcagaaaatgtagaaggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcctgattgcctacacagagcagtatgtggagtatgaccccctcatcaccccagctgagcccagcaacccctggatcagtgatgatgtggccctgtgggacatcgagatgagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaaggtgtggctgctgtag

SEQ ID NO: 167490 - DNA, 1041 bp, Artificial Sequence
  Description of Artificial Sequence: Synthetic coding sequence
atgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcaggaagtgccggcggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcctcatcgcctacacagagcagtatgtggagtatgaccccctcatcaccccagctgagcccagcaacccctggatcagtgatgatgtggccctgtgggacatcgagatgagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaagccagagagcgagcagggccgccgcaccagcctggagaagttcaccaggtctgtgctgtggctgctcttccccctgggcaagaggccctag

SEQ ID NO: 167491 - DNA, 1473 bp, Artificial Sequence
  Description of Artificial Sequence: Synthetic coding sequence
atggcccagggcagcggggaccagagagctgtgggcgtggccgaccctgaggagagcagccccaacatgattgtgtactgcaagattgaggacatcatcaccaagatgcaggatgacaagacaggaggagtgcccatcagaacagtgaagagcttcctgagcaagatccccagcgtggtgactggaacagacatcgtgcagtggctgatgaagaacctgagcattgaggaccctgtggaggccatccacctgggcagcctgattgctgcccagggctacatcttccccatcagtgaccacgtgctgaccatgaaggatgatggcaccttctaccgcttccaggccccctacttctggcccagcaactgctgggagccagaaaatacagattatgccatctacctgtgcaagaggaccatgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcagaaaatgtagaaggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcctgattgcctacacagagcagtatgtggagtatgaccccctcatcaccccagctgagcccagcaacccctggatcagtgatgatgtggccctgtgggacatcgagatgagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaagccagagagcgagcagggccgccgcaccagcctggagaagttcaccaggtctgtgggcaagagcctggccggcaagaggctgaccggcctgatgcagagcagctag

SEQ ID NO: 167492 - DNA, 1419 bp, Artificial Sequence; identical to SEQ ID NO: 167484
  Description of Artificial Sequence: Synthetic coding sequence

SEQ ID NO: 167493 - DNA, 1041 bp, Artificial Sequence
  Description of Artificial Sequence: Synthetic coding sequence
atgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcaggaagtgccggcggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcctcatcgcctacacagagcagtatgtggagtatgaccccctcatcaccccagctgagcccagcaacccctggatcagtgatgatgtggccctgtgggacatcgagatgagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaagccagagagcgagcagggccgccgcaccagcctggagaagttcaccaggtctgtgctgtacagcaacacccccctggccaagaggccctag

SEQ ID NO: 167494 - DNA, 1419 bp, Artificial Sequence; identical to SEQ ID NO: 167484
  Description of Artificial Sequence: Synthetic coding sequence

SEQ ID NO: 167495 - DNA, 1473 bp, Artificial Sequence; identical to SEQ ID NO: 167491
  Description of Artificial Sequence: Synthetic coding sequence

SEQ ID NO: 167496 - DNA, 1398 bp, Artificial Sequence
  Description of Artificial Sequence: Synthetic coding sequence
atggcccagggcagcggggaccagagagctgtgggcgtggccgaccctgaggagagcagccccaacatgattgtgtactgcaagattgaggacatcatcaccaagatgcaggatgacaagacaggaggagtgcccatcagaacagtgaagagcttcctgagcaagatccccagcgtggtgactggaacagacatcgtgcagtggctgatgaagaacctgagcattgaggaccctgtggaggccatccacctgggcagcctgattgctgcccagggctacatcttccccatcagtgaccacgtgctgaccatgaaggatgatggcaccttctaccgcttccaggccccctacttctggcccagcaactgctgggagccagaaaatacagattatgccatctacctgtgcaagaggaccatgcagaacaaggcccggctggagctggccgactatgaagctgagaacctggcccggctgcagagggcctttgccaggaagtgggagttcatcttcatgcaggccgaggcccaggtgaagattgacaggaagaaggacaagacagagaggaagatcctggacagccaggagcgggccttctgggatgtgcacaggcctgtgcccggctgtgtgaacaccacagagatggacatcagaaaatgtagaaggctgaagaacccccagaaggtgaagaagtctgtgtatggagtgacagaggagagccaggcccagagccctgtgcacgtgctgagccagcccatcaggaagaccaccaaggaggacatcaggaagcagatcaccttcctgaatgcccagattgacagacactgcctgaagatgagcaaggtggccgagagcctgattgcctacacagagcagtatgtggagtatgaccccctcatcaccccagctgagcccagcaacccctggatcagtgatgatgtggccctgtgggacatcgagatgagcaaggagcccagccagcagagggtgaagcgctggggcttctcctttgatgagatcctgaaggaccaggtgggccgggaccagttcctgcgcttcctggagagcgagttcagcagcgagaacctgcgcttctggctggccgtgcaggacctgaagaagcagcccctgcaggatgtggccaagagggtggaggagatctggcaggagttcctggcccctggggcccccagcgccatcaacctggacagccacagctatgagatcaccagccagaatgtgaaggatggcggccgctacacctttgaagatgcccaggagcacatctacaagctgatgaagagtgacagctatgcccgcttcctgcggagcaatgcctaccaggacctgctgctggccaagaagaagaaggtgtccaaggtggtggagctgccctag

SEQ ID NO: 167497 - DNA, 1356 bp, Artificial Sequence
  Description of Artificial Sequence: Synthetic coding sequence
atggaggatgtgattgccaggatgcaggatgagaagaatggcatccccatcagaacagtgaagagcttcctgagcaagatccccagcgtcttcagcggcagtgacatcgtgcagtggctgatcaagaacctgaccattgaagatcctgtggaggccctgcacctgggcaccctgatggccgcccacggctacttcttccccatcagtgaccacgtgctgaccctgaaggatgatggcaccttctaccgcttccagaccccctacttctggcccagcaactgctgggagcctgagaacacagattatgctgtgtacctgtgcaagaggaccatgcagaacaaggcccggctggagctggccgactatgaggccgagagcctggcccggctgcagagggcctttgccaggaagtgggagttcatcttcatgcaggccgaggcccaggccaaggtggacaagaagagggacaagattgaaaggaagatcctggacagccaggagcgggccttctgggatgtgcacaggcctgtgcccggctgtgtgaacaccacagaggtggacatcaagaagagcagcaggatgaggaacccccacaagaccaggaagtctgtgtatggcctgcagaatgacatccgcagccacagccccacccacacccccaccccagagaccaagccacccacagaagatgagctgcagcagcagatcaagtactggcagatccagctggacagacaccggctgaagatgagcaaggtggccgacagcctgctgagctacacagagcagtacctggagtatgaccccttcctgctgcccccagaccccagcaacccctggctgagtgatgacaccaccttctgggagctggaggccagcaaggagcccagccagcagagggtgaagcgctggggcttcggcatggatgaggccctgaaggaccctgtgggccgggagcagttcctgaagttcctggagagcgagttcagcagcgagaacctgcgcttctggctggccgtggaggacctgaagaagaggcccatcaaggaggtgcccagccgggtgcaggagatctggcaggagttcctggcccctggggcccccagcgccatcaacctggacagcaagagctatgacaagaccacccagaatgtgaaggagcccggccgctacacctttgaagatgcccaggagcacatctacaagctgatgaagagtgacagctacccccgcttcatccgcagcagcgcctaccaggagctgctgcaggccaagaagaagggcaggaacatccccatcttcccctgccacaagaactgcacccccaccctgcgggccagcaccaacctgctgtag

SEQ ID NO: 167498 - DNA, 1275 bp, Artificial Sequence
  Description of Artificial Sequence: Synthetic coding sequence
atggcccagggcaacaactacggccagaccagcaatggagtggctgatgagagccccaacatgctggtgtacaggaagatggaggatgtgattgccaggatgcaggatgagaagaatggcatccccatcagaacagtgaagagcttcctgagcaagatccccagcgtcttcagcggcagtgacatcgtgcagtggctgatcaagaacctgaccattgaagatcctgctgtgtacctgtgcaagaggaccatgcagaacaaggcccggctggagctggccgactatgaagctgagagcctggcccggctgcagagggcctttgccaggaagtgggagttcatcttcatgcaggccgaggcccaggccaaggtggacaagaagagggacaagattgaaaggaagatcctggacagccaggagcgggccttctgggatgtgcacaggcctgtgcccggctgtgtgaacaccacagaggtggacatcaagaagagcagcaggatgaggaacccccacaagaccaggaagtctgtgtatggcctgcagaatgacatccgcagccacagccccacccacacccccaccccagagaccaagcccccaacagaagatgagctgcagcagcagatcaagtactggcagatccagctggacagacaccggctgaagatgagcaaggtggccgacagcctgctgagctacacagagcagtacctggagtatgaccccttcctgctgcccccagaccccagcaacccctggctgagtgatgacaccaccttctgggagctggaggccagcaaggagcccagccagcagagggtgaagcgctggggcttcggcatggatgaggccctgaaggaccctgtgggccgggagcagttcctgaagttcctggagagcgagttcagcagcgagaacctgcgcttctggctggccgtggaggacctgaagaagaggcccatcaaggaggtgcccagccgggtgcaggagatctggcaggagttcctggcccctggggcccccagcgccatcaacctggacagcaagagctatgacaagaccacccagaatgtgaaggagcccggccgctacacctttgaagatgcccaggagcacatctacaagctgatgaagagtgacagctacccccgcttcatccgcagcagcgcctaccaggagctgctgcaggccaagaagaagggcaggaacatccccatcttcccctgccacaagaactgcacccccaccctgcgggccagcaccaacctgctgtag

SEQ ID NO: 167499 - DNA, 1410 bp, Artificial Sequence
  Description of Artificial Sequence: Synthetic coding sequence
atggcccagggcaacaactacggccagaccagcaatggagtggctgatgagagccccaacatgctggtgtacaggaagatggaggatgtgattgccaggatgcaggatgagaagaatggcatccccatcagaacagtgaagagcttcctgagcaagatccccagcgtcttcagcggcagtgacatcgtgcagtggctgatcaagaacctgaccattgaagatcctgtggaggccctgcacctgggcaccctgatggccgcccacggctacttcttccccatcagtgaccacgtgctgaccctgaaggatgatggcaccttctaccgcttccagaccccctacttctggcccagcaactgctgggagcctgagaacacagattatgctgtgtacctgtgcaagaggaccatgcagaacaaggcccggctggagctggccgactatgaggccgagagcctggcccggctgcagagggcctttgccaggaagtgggagttcatcttcatgcaggccgaggcccaggccaaggtggacaagaagagggacaagattgaaaggaagatcctggacagccaggagcgggccttctgggatgtgcacaggcctgtgcccggctgtgtgaacaccacagaggtggacatcaagaagagcagcaggatgaggaacccccacaagaccaggaagtctgtgtatggcctgcagaatgacatccgcagccacagccccacccacacccccaccccagagaccaagccacccacagaagatgagctgcagcagcagatcaagtactggcagatccagctggacagacaccggctgaagatgagcaaggtggccgacagcctgctgagctacacagagcagtacctggagtatgaccccttcctgctgcccccagaccccagcaacccctggctgagtgatgacaccaccttctgggagctggaggccagcaaggagcccagccagcagagggtgaagcgctggggcttcggcatggatgaggccctgaaggaccctgtgggccgggagcagttcctgaagttcctggagagcgagttcagcagcgagaacctgcgcttctggctggccgtggaggacctgaagaagaggcccatcaaggaggtgcccagccgggtgcaggagatctggcaggagttcctggcccctggggcccccagcgccatcaacctggacagcaagagctatgacaagaccacccagaatgtgaaggagcccggccgctacacctttgaagatgcccaggagcacatctacaagctgatgaagagtgacagctacccccgcttcatccgcagcagcgcctaccaggagctgctgcaggccaagaagaagggcaagagcctgaccagcaagaggctgaccagcctggcccagagctactag

SEQ ID NO: 167500 - DNA, 1434 bp, Artificial Sequence
  Description of Artificial Sequence: Synthetic coding sequence
atggcccagggcaacaactacggccagaccagcaatggagtggctgatgagagccccaacatgctggtgtacaggaagatggaggatgtgattgccaggatgcaggatgagaagaatggcatccccatcagaacagtgaagagcttcctgagcaagatccccagcgtcttcagcggcagtgacatcgtgcagtggctgatcaagaacctgaccattgaagatcctgtggaggccctgcacctgggcaccctgatggccgcccacggctacttcttccccatcagtgaccacgtgctgaccctgaaggatgatggcaccttctaccgcttccagaccccctacttctggcccagcaactgctgggagcctgagaacacagattatgctgtgtacctgtgcaagaggaccatgcagaacaaggcccggctggagctggccgactatgaggccgagagcctggcccggctgcagagggcctttgccaggaagtgggagttcatcttcatgcaggccgaggcccaggccaaggtggacaagaagagggacaagattgaaaggaagatcctggacagccaggagcgggccttctgggatgtgcacaggcctgtgcccggctgtgtgaacaccacagaggtggacatcaagaagagcagcaggatgaggaacccccacaagaccaggaagtctgtgtatggcctgcagaatgacatccgcagccacagccccacccacacccccaccccagagaccaagccacccacagaagatgagctgcagcagcagatcaagtactggcagatccagctggacagacaccggctgaagatgagcaaggtggccgacagcctgctgagctacacagagcagtacctggagtatgaccccttcctgctgcccccagaccccagcaacccctggctgagtgatgacaccaccttctgggagctggaggccagcaaggagcccagccagcagagggtgaagcgctggggcttcggcatggatgaggccctgaaggaccctgtgggccgggagcagttcctgaagttcctggagagcgagttcagcagcgagaacctgcgcttctggctggccgtggaggacctgaagaagaggcccatcaaggaggtgcccagccgggtgcaggagatctggcaggagttcctggcccctggggcccccagcgccatcaacctggacagcaagagctatgacaagaccacccagaatgtgaaggagcccggccgctacacctttgaagatgcccaggagcacatctacaagctgatgaagagtgacagctacccccgcttcatccgcagcagcgcctaccaggagctgctgcaggccaagaagaagggcaggaacatccccatcttcccctgccacaagaactgcacccccaccctgcgggccagcaccaacctgctgtag

SEQ ID NO: 167501 - DNA, 1410 bp, Artificial Sequence; identical to SEQ ID NO: 167499
  Description of Artificial Sequence: Synthetic coding sequence

SEQ ID NO: 167502 - DNA, 1464 bp, Artificial Sequence
  Description of Artificial Sequence: Synthetic coding sequence
atggcccagggcaacaactacggccagaccagcaatggagtggctgatgagagccccaacatgctggtgtacaggaagatggaggatgtgattgccaggatgcaggatgagaagaatggcatccccatcagaacagtgaagagcttcctgagcaagatccccagcgtcttcagcggcagtgacatcgtgcagtggctgatcaagaacctgaccattgaagatcctgtggaggccctgcacctgggcaccctgatggccgcccacggctacttcttccccatcagtgaccacgtgctgaccctgaaggatgatggcaccttctaccgcttccagaccccctacttctggcccagcaactgctgggagcctgagaacacagattatgctgtgtacctgtgcaagaggaccatgcagaacaaggcccggctggagctggccgactatgaggccgagagcctggcccggctgcagagggcctttgccaggaagtgggagttcatcttcatgcaggccgaggcccaggccaaggtggacaagaagagggacaagattgaaaggaagatcctggacagccaggagcgggccttctgggatgtgcacaggcctgtgcccggctgtgtgaacaccacagaggtggacatcaagaagagcagcaggatgaggaacccccacaagaccaggaagtctgtgtatggcctgcagaatgacatccgcagccacagccccacccacacccccaccccagagaccaagccacccacagaagatgagctgcagcagcagatcaagtactggcagatccagctggacagacaccggctgaagatgagcaaggtggccgacagcctgctgagctacacagagcagtacctggagtatgaccccttcctgctgcccccagaccccagcaacccctggctgagtgatgacaccaccttctgggagctggaggccagcaaggagcccagccagcagagggtgaagcgctggggcttcggcatggatgaggccctgaaggaccctgtgggccgggagcagttcctgaagttcctggagagcgagttcagcagcgagaacctgcgcttctggctggccgtggaggacctgaagaagaggcccatcaaggaggtgcccagccgggtgcaggagatctggcaggagttcctggcccctggggcccccagcgccatcaacctggacagcaagagctatgacaagaccacccagaatgtgaaggagcccggccgctacacctttgaagatgcccaggagcacatctacaagctgatgaagagtgacagctacccccgcttcatccgcagcagcgcctaccaggagctgctgcaggccaagaagaagagcggcaacagcatggacaggaggaccagctttgagaagtttgcccagaatgtgggcaagagcctgaccagcaagaggctgaccagcctggcccagagctactag

SEQ ID NO: 167503 - DNA, 1275 bp, Artificial Sequence; identical to SEQ ID NO: 167498
  Description of Artificial Sequence: Synthetic coding sequence

SEQ ID NO: 167504 - DNA, 1488 bp, Artificial Sequence
  Description of Artificial Sequence: Synthetic coding sequence
atggcccagggcaacaactacggccagaccagcaatggagtggctgatgagagccccaacatgctggtgtacaggaagatggaggatgtgattgccaggatgcaggatgagaagaatggcatccccatcagaacagtgaagagcttcctgagcaagatccccagcgtcttcagcggcagtgacatcgtgcagtggctgatcaagaacctgaccattgaagatcctgtggaggccctgcacctgggcaccctgatggccgcccacggctacttcttccccatcagtgaccacgtgctgaccctgaaggatgatggcaccttctaccgcttccagaccccctacttctggcccagcaactgctgggagcctgagaacacagattatgctgtgtacctgtgcaagaggaccatgcagaacaaggcccggctggagctggccgactatgaggccgagagcctggcccggctgcagagggcctttgccaggaagtgggagttcatcttcatgcaggccgaggcccaggccaaggtggacaagaagagggacaagattgaaaggaagatcctggacagccaggagcgggccttctgggatgtgcacaggcctgtgcccggctgtgtgaacaccacagaggtggacatcaagaagagcagcaggatgaggaacccccacaagaccaggaagtctgtgtatggcctgcagaatgacatccgcagccacagccccacccacacccccaccccagagaccaagccacccacagaagatgagctgcagcagcagatcaagtactggcagatccagctggacagacaccggctgaagatgagcaaggtggccgacagcctgctgagctacacagagcagtacctggagtatgaccccttcctgctgcccccagaccccagcaacccctggctgagtgatgacaccaccttctgggagctggaggccagcaaggagcccagccagcagagggtgaagcgctggggcttcggcatggatgaggccctgaaggaccctgtgggccgggagcagttcctgaagttcctggagagcgagttcagcagcgagaacctgcgcttctggctggccgtggaggacctgaagaagaggcccatcaaggaggtgcccagccgggtgcaggagatctggcaggagttcctggcccctggggcccccagcgccatcaacctggacagcaagagctatgacaagaccacccagaatgtgaaggagcccggccgctacacctttgaagatgcccaggagcacatctacaagctgatgaagagtgacagctacccccgcttcatccgcagcagcgcctaccaggagctgctgcaggccaagaagaagagcggcaacagcatggacaggaggaccagctttgagaagtttgcccagaatgtgggcaggaacatccccatcttcccctgccacaagaactgcacccccaccctgcgggccagcaccaacctgctgtag

SEQ ID NO: 167505 - DNA, 981 bp, Artificial Sequence
  Description of Artificial Sequence: Synthetic coding sequence
caggccgaggcccaggccaaggtggacaagaagagggacaagattgaaaggaagatcctggacagccaggagcgggccttctgggatgtgcacaggcctgtgcccggctgtgtgaacaccacagaggtggacatcaagaagagcagcaggatgaggaacccccacaagaccaggaagtctgtgtatggcctgcagaatgacatccgcagccacagccccacccacacccccaccccagagaccaagcccccaacagaagatgagctgcagcagcagatcaagtactggcagatccagctggacagacaccggctgaagatgagcaaggtggccgacagcctgctgagctacacagagcagtacctggagtatgaccccttcctgctgcccccagaccccagcaacccctggctgagtgatgacaccaccttctgggagctggaggccagcaaggagcccagccagcagagggtgaagcgctggggcttcggcatggatgaggccctgaaggaccctgtgggccgggagcagttcctgaagttcctggagagcgagttcagcagcgagaacctgcgcttctggctggccgtggaggacctgaagaagaggcccatcaaggaggtgcccagccgggtgcaggagatctggcaggagttcctggcccctggggcccccagcgccatcaacctggacagcaagagctatgacaagaccacccagaatgtgaaggagcccggccgctacacctttgaagatgcccaggagcacatctacaagctgatgaagagtgacagctacccccgcttcatccgcagcagcgcctaccaggagctgctgcaggccaagaagaagagcggcaacagcatggacaggaggaccagctttgagaagtttgcccagaatgtgggcaggaacatccccatcttcccctgccacaagaactgcacccccaccctgcgggccagcaccaacctgctgtag

SEQ ID NO: 167506 - DNA, 1182 bp, Artificial Sequence
  Description of Artificial Sequence: Synthetic coding sequence
atggccgcccacggctacttcttccccatcagtgaccacgtgctgaccctgaaggatgatggcaccttctaccgcttccagaccccctacttctggcccagcaactgctgggagcctgagaacacagattatgctgtgtacctgtgcaagaggaccatgcagaacaaggcccggctggagctggccgactatgaggccgagagcctggcccggctgcagagggcctttgccaggaagtgggagttcatcttcatgcaggccgaggcccaggccaaggtggacaagaagagggacaagattgaaaggaagatcctggacagccaggagcgggccttctgggatgtgcacaggcctgtgcccggctgtgtgaacaccacagaggtggacatcaagaagagcagcaggatgaggaacccccacaagaccaggaagtctgtgtatggcctgcagaatgacatccgcagccacagccccacccacacccccaccccagagaccaagccacccacagaagatgagctgcagcagcagatcaagtactggcagatccagctggacagacaccggctgaagatgagcaaggtggccgacagcctgctgagctacacagagcagtacctggagtatgaccccttcctgctgcccccagaccccagcaacccctggctgagtgatgacaccaccttctgggagctggaggccagcaaggagcccagccagcagagggtgaagcgctggggcttcggcatggatgaggccctgaaggaccctgtgggccgggagcagttcctgaagttcctggagagcgagttcagcagcgagaacctgcgcttctggctggccgtggaggacctgaagaagaggcccatcaaggaggtgcccagccgggtgcaggagatctggcaggagttcctggcccctggggcccccagcgccatcaacctggacagcaagagctatgacaagaccacccagaatgtgaaggagcccggccgctacacctttgaagatgcccaggagcacatctacaagctgatgaagagtgacagctacccccgcttcatccgcagcagcgcctaccaggagctgctgcaggccaagaagaagggcaggaacatccccatcttcccctgccacaagaactgcacccccaccctgcgggccagcaccaacctgctgtag

SEQ ID NO: 167507 - DNA, 774 bp, Artificial Sequence
  Description of Artificial Sequence: Synthetic coding sequence
atgagcagcgcccccaacggcaggaagaagaggcccagccgcagcaccaggagcagcatcttccagatcagcaagccacccctgcagagcggggactgggagcggcggggcagcggcagcgagagcgcccacaagacccagagggccctggatgactgcaagatgctggtgcaggagttcaacacccaggtggccctgtaccgggagctggtgatcagcattggagatgtgtctgtgtcctgccccagcctgcgggcagagatgcacaagaccaggaccaagggctgtgagatggcccggcaggcccaccagaagctggccgccatcagcggcccagaagatggagagatccaccctgagatctgccgcctgtacatccagctgcagtgctgcctggagatgtacaccacagagatgctgaagagcatctgcctgctgggcagcctgcagttccacaggaagggcaaggagcccggcggcggcaccaagagcctggactgcaagattgaggagagcgctgagaccccagccctggaggacagcagcagcagccctgtggacagccagcagcacagctggcaggtgtccacagacatcgagaacacagagcgggacatgagggagatgaagaacctgctgagcaagctgcgggagaccatgcccctgcccctgaagaaccaggatgacagcagcctgctgaacctgaccccctaccccctggtgagaagaaggaagaggcgcttcttcggcctgtgctgcctgatcagcagctag

SEQ ID NO: 167508 - DNA, 2025 bp, Artificial Sequence
  Description of Artificial Sequence: Synthetic coding sequence
atgaccatccgccaccagggccagcagtaccggcccaggatggccttcctgcagaagattgaggccctggtgaaggacatgcagaaccctgagaccggggtgaggatgcagaaccagagggtgctggtgacctctgtgccccacgccatgactggaagtgatgtgctgcagtggatcgtgcagaggctgtggatcagcagcctggaggcccagaacctgggcaacttcatcgtgcgctatggctacatctaccccctgcaggaccccaagaacctgatcctgaagccagatggcagcctgtaccgcttccagaccccctacttctggcccacccagcagtggccagctgaggacacagattatgccatctacctggccaagaggaacatcaagaagaagggcatcctggaggagtatgagaaggagaactacaacttcctgaaccagaagatgaactacaagtgggactttgtgatcatgcaggccaaggagcagtaccgggccggcaaggagaggaacaaggctgacagatatgccctggactgccaggagaaggcctactggctggtgcaccgctgccccccaggcatggacaacgtgctggactatggcctggacagagtgaccaaccccaatgaggtgaaggtgaaccagaagcagacagtggtggccgtgaagaaggagatcatgtactaccagcaggccctgatgaggagcacagtgaagagctctgtgtccctgggcggcatcgtgaagtacagcgagcagttcagcagcaatgatgccatcatgagcggctgcctgcccagcaacccctggatcacagatgacacccagttctgggacctgaatgccaagctggtggagatccccaccaagatgagggtggagcgctgggccttcaacttcagcgagctgatccgggaccccaagggccggcagagcttccagtacttcctgaagaaggagttctctggagagaacctgggcttctgggaggcctgtgaggacctgaagtacggggaccagagcaaggtgaaggagaaggccgaggagatctacaagctgttcctggcccctggggcccggcgctggatcaacattgatggcaagaccatggacatcaccgtgaagggcctgaagcacccccaccgctacgtgctggatgctgcccagacccacatctacatgctgatgaagaaggacagctatgcccgctacctgaagagccccatctacaaggacatgctggccaaggccatcgagccccaggagaccaccaagaagagcagcaccctgcccttcatgagaagacacctgcggagcagccccagccctgtgatcctgcggcagctggaggaggaggccaaggcccgggaggccgccaacacagtggacatcacccagcccggccagcacatggcccccagcccccacctgactgtgtacacaggcacctgcatgccacccagccccagcagccccttcagcagcagctgccgcagccccaggaagccctttgccagccccagccgcttcatcagaagacccagcaccaccatctgccccagccccatccgggtggccctggagagcagcagcggcctggagcagaagggagaatgttctggctccatggccccccggggccccagcgtgacagagagcagcgaggccagcctggacacctcctggcccaggagccggccccgggccccacccaaggccaggatggccctgtccttcagccgcttcctgcggcggggctgcctggccagccctgtgtttgcccggctgagccccaagtgcccagctgtgagccacggccgggtgcagcccctgggagatgtgggccagcagctgccccggctgaagagcaagagggtggccaacttcttccagatcaagatggatgtgcccactggaagtggcacctgcctgatggacagtgaagatgctggcactggagagagcggggaccgggccacagagaaggaggtgatctgcccctgggagagcctgtag

SEQ ID NO: 167509 - DNA, 2016 bp, Artificial Sequence
  Description of Artificial Sequence: Synthetic coding sequence
atgaccatccgccaccagggccagcagtaccggcccaggatggccttcctgcagaagattgaggccctggtgaaggacatgcagaaccctgagaccggggtgaggatgcagaaccagagggtgctggtgacctctgtgccccacgccatgactggaagtgatgtgctgcagtggatcgtgcagaggctgtggatcagcagcctggaggcccagaacctgggcaacttcatcgtgcgctatggctacatctaccccctgcaggaccccaagaacctgatcctgaagccagatggcagcctgtaccgcttccagaccccctacttctggcccacccagcagtggccagctgaggacacagattatgccatctacctggccaagaggaacatcaagaagaagggcatcctggaggagtatgagaaggagaactacaacttcctgaaccagaagatgaactacaagtgggactttgtgatcatgcaggccaaggagcagtaccgggccggcaaggagaggaacaaggctgacagatatgccctggactgccaggagaaggcctactggctggtgcaccgctgccccccaggcatggacaacgtgctggactatggcctggacagagtgaccaaccccaatgaggtgaagaagcagacagtggtggccgtgaagaaggagatcatgtactaccagcaggccctgatgaggagcacagtgaagagctctgtgtccctgggcggcatcgtgaagtacagcgagcagttcagcagcaatgatgccatcatgagcggctgcctgcccagcaacccctggatcacagatgacacccagttctgggacctgaatgccaagctggtggagatccccaccaagatgagggtggagcgctgggccttcaacttcagcgagctgatccgggaccccaagggccggcagagcttccagtacttcctgaagaaggagttcagcggggagaacctgggcttctgggaggcctgtgaggacctgaagtatggagaccagagcaaggtgaaggagaaggccgaggagatctacaagctgttcctggcccctggggcccggcgctggatcaacattgatggcaagaccatggacatcaccgtgaagggcctgaagcacccccacagatatgtgctggatgctgcccagacccacatctacatgctgatgaagaaggacagctatgcccgctacctgaagagccccatctacaaggacatgctggccaaggccatcgagccccaggagaccaccaagaagagcagcaccctgcccttcatgaggaggcacctgcggagcagccccagccctgtgatcctgcggcagctggaggaggaggccaaggcccgggaggccgccaacacagtggacatcacccagcccggccagcacatggcccccagcccccacctgactgtgtacacaggcacctgcatgccacccagccccagcagccccttcagcagcagctgccgcagccccaggaagccctttgccagccccagccgcttcatccggcggcccagcaccaccatctgccccagccccatccgggtggccctggagagcagcagcggcctggagcagaagggggagtgcagcggctccatggccccccggggccccagcgtgacagagagcagcgaggccagcctggacacctcctggcccaggagccggccccgggccccacccaaggccaggatggccctgtccttcagccgcttcctgcggcggggctgcctggccagccctgtgtttgcccggctgagccccaagtgcccagctgtgagccacggccgggtgcagcccctgggagatgtgggccagcagctgccccggctgaagagcaagagggtggccaacttcttccagatcaagatggatgtgcccaccggcagcggcacctgcctgatggattctgaagatgctggcaccggggagagcggggaccgggccacagagaaggaggtgatctgcccctgggagagcctgtag

SEQ ID NO: 167510 - DNA, 4008 bp, Artificial Sequence
  Description of Artificial Sequence: Synthetic coding sequence
atggagagcgagatgctgcagagccccctgctgggcctgggggaggaggatgaagctgacctgacagactggaacctgcccctggccttcatgaagaagaggcactgtgagaagattgagggcagcaagagcctggcccagagctggaggatgaaggacaggatgaagacagtgtctgtggccctggtgctgtgcctgaatgtgggcgtggaccccccagatgtggtgaagaccaccccctgtgcccggctggagtgctggattgaccccctgtccatgggcccccagaaggccctggagaccatcggggccaacctgcagaagcagtatgagaactggcagccccgggcccgctacaagcagagcctggaccccaccgtggatgaggtgaagaagctgtgcaccagcctgcggagaaatgccaaggaggagcgggtgctcttccactacaatggacatggagtgccccggcccaccgtgaatggagaggtgtgggtgttcaacaagaactacacccagtacatccccctgagcatctatgacctgcagacctggatgggcagccccagcatctttgtgtatgactgcagcaatgccggcctcatcgtgaagagcttcaagcagtttgccctgcagcgggagcaggagctggaggtggccgccatcaaccccaaccaccccctggcccagatgcccctgccccccagcatgaagaactgcatccagctggccgcctgtgaggccacagagctgctgcccatgatcccagacctgcctgctgacctcttcaccagctgcctgaccacccccatcaagatcgccctgcgctggttctgcatgcagaagtgtgtgtccctggtgcctggggtgaccctggacctgattgagaagatccctggccgcctgaatgacaggaggacccccctgggggagctgaactggatcttcaccgccatcacagacaccatcgcctggaatgtgctgccccgggacctcttccagaagctgttccggcaggacctgctggtggccagcctcttcaggaacttcctgctggccgagcgcatcatgaggagctacaactgcacccctgtgagcagcccccggctgccccccacctacatgcacgccatgtggcaggcctgggacctggccgtggacatctgcctgagccagctgcccaccatcatcgaggagggcacagccttccgccacagccccttctttgctgagcagctgacagccttccaggtgtggctgaccatgggcgtggagaacagaaatcctcctgagcagctgcccatcgtgctgcaggtgctgctgagccaggtgcaccggctgcgggccctggacctgctgggccgcttcctggacctgggcccctgggccgtgtccctggccctgtctgtgggcatcttcccctacgtgctgaagctgctgcagagcagcgcccgggagctgcggcccctgctggtgttcatctgggccaagatcctggccgtggacagcagctgccaggccgacctggtgaaggacaatggccacaagtacttcctgtctgtgctggccgacccctacatgcctgctgagcacaggaccatgacagccttcatcctggccgtcatcgtgaacagctaccacacaggccaggaggcctgcctgcagggcaacctgattgccatctgcctggagcagctgaatgacccccaccccctgctgcggcagtgggtggccatctgcctgggccgcatctggcagaactttgacagcgcccgctggtgtggggtgcgggacagcgcccacgagaagctgtacagcctgctgagtgaccccatccctgaggtgcgctgtgccgctgtgtttgccctgggcacctttgtgggcaacagcgctgagaggacagaccacagcaccaccatcgaccacaacgtggccatgatgctggcccagctggtgtctgatggcagccccatggtgaggaaggagctggtggtggccctgagccacctggtggtgcagtatgagagcaacttctgcaccgtggccctgcagttcatcgaggaggagaagaactatgccctgcccagccctgccaccacagagggcggcagcctgacccctgtgcgggacagcccctgcaccccccggctgcggtctgtgagcagctatggcaacatccgggctgtggccacagcccggagcctgaacaagagcctgcagaacctgagcctgacagaggagagcggcggcgctgtggccttcagccctggcaacctgagcaccagcagcagcgccagcagcaccctgggcagcccagaaaatgaggagcacatcctgagctttgagaccatcgacaagatgaggcgggccagcagctacagcagcctgaacagcctcatcggcgtgtccttcaacagcgtgtacacccagatctggagggtgctgctgcacctggccgctgacccctacccagaggtgtctgatgtggccatgaaggtgctgaacagcatcgcctacaaggccaccgtgaatgcccggccccagagggtgctggacaccagcagcctgacccagagcgccccagccagccccaccaacaagggcgtgcacatccaccaggccggcggcagccccccagccagcagcaccagcagcagcagcctgaccaatgatgtggccaagcagcctgtgtcccgggacctgcccagcggccggcccggcaccactggacctgctggggcccagtacaccccccacagccaccagttccccaggaccaggaagatgtttgacaagggccctgagcagacagcagatgatgctgatgatgctgctggccacaagagcttcatcagcgccaccgtgcagacaggcttctgtgactggagcgcccgctactttgcccagcctgtgatgaagatccctgaggagcatgacctggagagccagatcaggaaggagcgggagtggaggttcctgaggaacagccgggtgcggcggcaggcccagcaggtgatccagaagggcatcacccggctggatgaccagatcttcctgaacagaaatcctggggtgcccagcgtggtgaagttccaccccttcaccccctgcatcgctgtggccgacaaggacagcatctgcttctgggactgggagaagggggagaagctggactacttccacaacggcaacccccgctacaccagggtgacagccatggagtacctgaatggccaggactgcagcctgctgctgacagccacagatgatggagccatccgggtgtggaagaactttgctgacctggagaagaaccctgagatggtgacagcctggcagggcctgagtgacatgctgcccaccaccagaggagctggcatggtggtggactgggagcaggagaccggcctgctgatgagcagtggagatgtgcgcatcgtgcgcatctgggacacagaccgggagatgaaggtgcaggacatccccactggagctgacagctgtgtgaccagcctgagctgtgacagccacaggagcctgattgtggccggcctgggagatggcagcatccgggtgtatgacaggaggatggccctgtctgaatgtcgggtgatgacctaccgggagcacacagcctgggtggtgaaggccagcctgcagaagaggccagatggccacatcgtgtctgtgtctgtgaatggagatgtgcgcatctttgaccccaggatgcctgagagcgtgaatgtgctgcagatcgtgaagggcctgacagccctggacatccacccccaggccgacctgattgcctgtggctctgtgaaccagttcaccgccatctacaacagcagtggagagctgatcaacaacatcaagtactatgatggcttcatgggccagagggtgggcgccatcagctgcctggccttccacccccactggccccacctggccgtgggcagcaatgactactacatctctgtgtacagcgtggagaagagggtgaggtag

SEQ ID NO: 167511 - DNA, 990 bp, Artificial Sequence
  Description of Artificial Sequence: Synthetic coding sequence
atgggcagccccagcatctttgtgtatgactgcagcaatgccggcctgattgtgaagagcttcaagcagtttgccctgcagcgggagcaggagctggaggtggccgccatcaaccccaaccaccccctggcccagatgcccctgcccccatccatgaagaactgcatccagctggccgcctgtgaggccacagagctgctgcccatgatcccagacctgcctgctgacctcttcaccagctgcctgaccacccccatcaagatcgccctgcgctggttctgcatgcagaagtgtgtgtccctggtgcctggggtgaccctggacctgattgagaagatccctggccgcctgaatgacaggaggacccccctgggggagctgaactggatcttcaccgccatcacagacaccatcgcctggaatgtgctgccccgggacctcttccagaagctgttccggcaggacctgctggtggccagcctcttcaggaacttcctgctggccgagcgcatcatgaggagctacaactgcacccctgtgagcagcccccggctgccccccacctacatgcacgccatgtggcaggcctgggacctggccgtggacatctgcctgagccagctgcccaccatcatcgaggagggcacagccttccgccacagccccttctttgctgagcagctgacagccttccaggtgtggctgaccatgggcgtggagaacagaaaccccccagagcagctgcccatcgtgctgcaggtgctgctgagccaggtgcaccggctgcgggccctggacctgctgggccgcttcctggacctgggcccctgggccgtgtccctggccctgtctgtgggcatcttcccctacgtgctgaagctgctgcagagcagcgcccgggagctgcggcccctgctggtgttcatctgggccaagatcctggccgtggacagcgtgtccatcccagccctgctgccccgggtgatgtag

SEQ ID NO: 167512 - DNA, 3534 bp, Artificial Sequence
  Description of Artificial Sequence: Synthetic coding sequence
atggagagcgagatgctgcagagccccctgctgggcctgggggaggaggatgaagctgacctgacagactggaacctgcccctggccttcatgaagaagaggcactgtgagaagattgagggcagcaagagcctggcccagagctggaggatgaaggacaggatgaagacagtgtctgtggccctggtgctgtgcctgaatgtgggcgtggaccccccagatgtggtgaagaccaccccctgtgcccggctggagtgctggattgaccccctgtccatgggcccccagaaggccctggagaccatcggggccaacctgcagaagcagtatgagaactggcagccccgggcccgctacaagcagagcctggaccccaccgtggatgaggtgaagaagctgtgcaccagcctgcggagaaatgccaaggaggagcgggtgctcttccactacaatggacatggagtgccccggcccaccgtgaatggagaggtgtgggtgttcaacaagaactacacccagtacatccccctgagcatctatgacctgcagacctggatgggcagccccagcatctttgtgtatgactgcagcaatgccggcctcatcgtgaagagcttcaagcagtttgccctgcagcgggagcaggagctggaggtggccgccatcaaccccaaccaccccctggcccagatgcccctgccccccagcatgaagaactgcatccagctggccgcctgtgaggccacagagctgctgcccatgatcccagacctgcctgctgacctcttcaccagctgcctgaccacccccatcaagatcgccctgcgctggttctgcatgcagaagtgtgtgtccctggtgcctggggtgaccctggacctgattgagaagatccctggccgcctgaatgacaggaggacccccctgggggagctgaactggatcttcaccgccatcacagacaccatcgcctggaatgtgctgccccgggacctcttccagaagctgttccggcaggacctgctggtggccagcctcttcaggaacttcctgctggccgagcgcatcatgaggagctacaactgcacccctgtgagcagcccccggctgccccccacctacatgcacgccatgtggcaggcctgggacctggccgtggacatctgcctgagccagctgcccaccatcatcgaggagggcacagccttccgccacagccccttctttgctgagcagctgacagccttccaggtgtggctgaccatgggcgtggagaacagaaatcctcctgagcagctgcccatcgtgctgcaggtgctgctgagccaggtgcaccggctgcgggccctggacctgctgggccgcttcctggacctgggcccctgggccgtgtccctggccctgtctgtgggcatcttcccctacgtgctgaagctgctgcagagcagcgcccgggagctgcggcccctgctggtgttcatctgggccaagatcctggccgtggacagcgagctggtggtggccctgagccacctggtggtgcagtatgagagcaacttctgcaccgtggccctgcagttcatcgaggaggagaagaactatgccctgcccagccctgccaccacagagggcggcagcctgacccctgtgcgggacagcccctgcaccccccggctgcggtctgtgagcagctatggcaacatccgggctgtggccacagcccggagcctgaacaagagcctgcagaacctgagcctgacagaggagagcggcggcgctgtggccttcagccctggcaacctgagcaccagcagcagcgccagcagcaccctgggcagcccagaaaatgaggagcacatcctgagctttgagaccatcgacaagatgaggcgggccagcagctacagcagcctgaacagcctcatcggcgtgtccttcaacagcgtgtacacccagatctggagggtgctgctgcacctggccgctgacccctacccagaggtgtctgatgtggccatgaaggtgctgaacagcatcgcctacaaggccaccgtgaatgcccggccccagagggtgctggacaccagcagcctgacccagagcgccccagccagccccaccaacaagggcgtgcacatccaccaggccggcggcagccccccagccagcagcaccagcagcagcagcctgaccaatgatgtggccaagcagcctgtgtcccgggacctgcccagcggccggcccggcaccactggacctgctggggcccagtacaccccccacagccaccagttccccaggaccaggaagatgtttgacaagggccctgagcagacagcagatgatgctgatgatgctgctggccacaagagcttcatcagcgccaccgtgcagacaggcttctgtgactggagcgcccgctactttgcccagcctgtgatgaagatccctgaggagcatgacctggagagccagatcaggaaggagcgggagtggaggttcctgaggaacagccgggtgcggcggcaggcccagcaggtgatccagaagggcatcacccggctggatgaccagatcttcctgaacagaaatcctggggtgcccagcgtggtgaagttccaccccttcaccccctgcatcgctgtggccgacaaggacagcatctgcttctgggactgggagaagggggagaagctggactacttccacaacggcaacccccgctacaccagggtgacagccatggagtacctgaatggccaggactgcagcctgctgctgacagccacagatgatggagccatccgggtgtggaagaactttgctgacctggagaagaaccctgagatggtgacagcctggcagggcctgagtgacatgctgcccaccaccagaggagctggcatggtggtggactgggagcaggagaccggcctgctgatgagcagtggagatgtgcgcatcgtgcgcatctgggacacagaccgggagatgaaggtgcaggacatccccactggagctgacagctgtgtgaccagcctgagctgtgacagccacaggagcctgattgtggccggcctgggagatggcagcatccgggtgtatgacaggaggatggccctgtctgaatgtcgggtgatgacctaccgggagcacacagcctgggtggtgaaggccagcctgcagaagaggccagatggccacatcgtgtctgtgtctgtgaatggagatgtgcgcatctttgaccccaggatgcctgagagcgtgaatgtgctgcagatcgtgaagggcctgacagccctggacatccacccccaggccgacctgattgcctgtggctctgtgaaccagttcaccgccatctacaacagcagtggagagctgatcaacaacatcaagtactatgatggcttcatgggccagagggtgggcgccatcagctgcctggccttccacccccactggccccacctggccgtgggcagcaatgactactacatctctgtgtacagcgtggagaagagggtgaggtag

SEQ ID NO: 167513 - DNA, 2097 bp, Artificial Sequence
  Description of Artificial Sequence: Synthetic coding sequence
atgcagaacagcgagggcggcgctgacagccctgcctctgtggccctgcggcccagcgctgctgcccctcctgtgcctgccagcccccagagggtgctggtgcaggccgccagcagcaaccccaagggggcccagatgcagcccatcagcctgccccgggtgcagcaggtgccccagcaggtgcagcctgtgcagcacgtgtacccagcccaggtgcagtatgtggagggcggagatgctgtgtacaccaacggggccatcagaacagcctacacctacaaccctgagccccagatgtatgcccccagcagcacagccagctactttgaggcccctgggggcgcccaggtgacagtggccgccagcagccccccagctgtgcccagccacagcatggtgggcatcaccatggatgtgggcggcagccccatcgtgtcctctgctggggcctacctgatccacggcggcatggacagcaccaggcacagcctggcccacaccagccgcagcagccctgccaccctgcagtggctgctggacaactatgaaacagctgagggcgtgtccctgcccaggagcagcctgtacaaccactacctgcggcactgccaggagcacaagctggaccctgtgaatgctgccagctttgggaagctgatccgcagcgtcttcatgggcctgcggacccggcggctgggcacccggggcaacagcaagtaccactactacggcatccggctgaagccagacagccccctgaaccggctgcaggaggacacccagtacatggccatgaggcagcagcccatgcaccagaagccccgctacagacctgcccagaagacagacagcctgggggacagcggcagccacagcggcctgcacagcaccccagagcagaccatggctgtgcagagccagcaccaccagcagtacattgatgtgagccacgtgtttcctgagttccctgccccagacctgggcagcttcctgctgcaggatggagtgaccctgcatgatgtgaaggccctgcagctggtgtacagaagacactgtgaggccaccgtggatgtggtgatgaacctgcagttccactacatcgagaagctgtggctgtccttctggaacagcaaggccagcagcagtgatggccccaccagcctgcctgccagtgatgaagatcctgagggcgctgtgctgcccaaggacaagctgatcagcctgtgccagtgtgaccccatcctgcgctggatgaggagctgtgaccacatcctgtaccaggccctggtggagatcctgatcccagatgtgctgcggcctgtgcccagcaccctgacccaggccatccggaactttgccaagagcctggagggctggctgaccaatgccatgtctgacttcccccagcaggtgatccagaccaaggtgggcgtggtgtctgcctttgcccagaccctgcggcgctacaccagcctgaaccacctggcccaggccgcccgggctgtgctgcagaacaccagccagatcaaccagatgctgagtgacctgaacagagtggactttgccaacgtgcaggagcaggcctcctgggtgtgccagtgtgaggagagcgtggtgcagaggctggagcaggacttcaagctgaccctgcagcagcagagcagcctggaccagtgggcctcctggctggacagcgtggtgacccaggtgctgaagcagcacgccggcagccccagcttccccaaggccgcccggcagttcctgctgaagtggagcttctacagctccatggtgatccgggacctgaccctgcggtctgctgccagctttggcagcttccacctgatccggctgctgtatgatgagtacatgttctacctggtggagcaccgggtggccgaggccaccggggagacccccatcgctgtgatgggagagttcaatgacctggccagcctgagcctgaccctgctggacaaggatgacatgggagatgagcagaggggcagcgaggccggcccagatgcccggagcctgggggagcccctggtgaagcgggagaggagtgaccccaaccacagcctgcagggcatctag

SEQ ID NO: 167514 - DNA, 2940 bp, Artificial Sequence
  Description of Artificial Sequence: Synthetic coding sequence
atggccacccaggcctacacagagctgcaggccgcccccccacccagccagcccccccaggccccaccccaggcccagccccagcccccacctcctcctcctcctgctgccccccagcccccccagcccccaacagctgctgccaccccccagccccagtatgtgacagagctgcagagcccccagccccaggcccagcccccaggcggccagaagcagtatgtgacagagctgcctgctgtgcctgcccccagccagcccaccggggcccccacccccagccctgccccccagcagtacatcgtggtgacagtgtctgagggcgccatgagggccagcgagaccgtgtctgaggccagccctggcagcacagccagccagacaggagtgcccacccaggtggtgcagcaggtgcagggcacccagcagaggctgctggtgcagacctctgtgcaggccaagccaggccacgtgagccccctgcagctgaccaacatccaggtgccccagcaggccctgcccacccagaggctggtggtgcagagcgctgcccctggcagcaagggcggccaggtgtccctgactgtgcacggcacccagcaggtgcacagccccccagagcagagccctgtgcaggccaacagcagcagcagcaagacagctggggcccccactggaacagtgccccagcagctgcaggtgcatggagtgcagcagagcgtgcctgtgacccaggagaggtctgtggtgcaggccaccccccaggcccccaagccaggccctgtgcagcccctgactgtgcagggcctgcagcctgtgcacgtggcccaggaggtgcagcagctgcagcaggtgcctgtgccccacgtgtacagcagccaggtgcagtatgtggagggcggagatgccagctacacagccagcgccatccgcagcagcacctacagctacccagagacccccctgtacacccagacagccagcaccagctactatgaggccgccggcacagccacccaggtgtccaccccagccaccagccaggccgtggccagcagcggctccatgcccatgtatgtgtctggcagccaggtggtggccagcagcaccagcactggagctggggccagcaacagcagcggcggcggcggcagcggcggcggcggcggcggcggcggcggcggcggcggcggcggcagcggcagcactggaggcggcggcagcggggccggcacctacgtgatccagggcggctacatgctgggcagcgccagccagagctacagccacaccacccgggccagccctgccaccgtgcagtggctgctggacaactatgaaacagctgagggcgtgtccctgcccaggagcaccctgtactgccactacctgctgcactgccaggagcagaagctggagcctgtgaatgctgccagctttgggaagctgatccgcagcgtcttcatgggcctgcggacccggcggctgggcacccggggcaacagcaagtaccactactacggcctgcgcatcaaggccagcagccccctgctgcggctgatggaggaccagcagcacatggccatgaggggccagcccttcagccagaagcagaggctgaagcccatccagaagatggagggcatgaccaatggagtggccgtgggccagcagcccagcacaggcctgagtgacatcagcgcccaggtgcagcagtaccagcagttcctggatgccagccgcagcctgcctgacttcacagagctggacctgcagggcaaggtgctgcctgagggcgtgggccctggggacatcaaggccttccaggtgctgtaccgggagcactgtgaggccatcgtggatgtgatggtgaacctgcagttcaccctggtggagaccctgtggaagaccttctggagatacaacctgagccagcccagcgaggccccacccctggccgtgcatgatgaggccgagaagaggctgcccaaggccatcctggtgctgctgagcaagtttgagcctgtgctgcagtggaccaagcactgtgacaacgtgctgtaccagggcctggtggagatcctgatcccagatgtgctgcggcccatccccagcgccctgacccaggccatccggaactttgccaagagcctggagagctggctgacccacgccatggtgaacatccctgaggagatgctgcgggtgaaggtggccgctgctggggcctttgcccagaccctgcggcgctacaccagcctgaaccacctggcccaggccgcccgggctgtgctgcagaacacagcccagatcaaccagatgctgagtgacctgaacagagtggactttgccaacgtgcaggagcaggcctcctgggtgtgccgctgtgaagatagagtggtgcagaggctggagcaggacttcaaggtgaccctgcagcagcagaacagcctggagcagtgggccgcctggctggatggagtggtgtcccaggtgctgaagccctaccagggcagcgctggcttccccaaggccgccaagctgttcctgctgaagtggagcttctacagctccatggtgatccgggacctgaccctgcggtctgctgccagctttggcagcttccacctgatccggctgctgtatgatgagtacatgtactacctgattgagcaccgggtggcccaggccaagggggagacccccatcgctgtgatgggagaatttgccaacctggccaccagcctgaaccccctggaccctgacaaggatgaggaggaggaggaggaggaggagagtgaagatgagctgccccaggacatcagcctggccgccggcggggagagccctgccctgggccctgagaccctggagcccccagccaagctggccaggacagatgcccggggcctgtttgtgcaggccctgcccagcagctag

SEQ ID NO: 167515 - DNA, 2172 bp, Artificial Sequence
  Description of Artificial Sequence: Synthetic coding sequence
atgcagaacagcgagggcggcgctgacagccctgcctctgtggccctgcggcccagcgctgctgcccctcctgtgcctgccagcccccagagggtgctggtgcaggccgccagcagcaaccccaagggggcccagatgcagcccatcagcctgccccgggtgcagcaggtgccccagcaggtgcagcctgtgcagcacgtgtacccagcccaggtgcagtatgtggagggcggagatgctgtgtacaccaacggggccatcagaacagcctacacctacaaccctgagccccagatgtatgcccccagcagcacagccagctactttgaggcccctgggggcgcccaggtgacagtggccgccagcagccccccagctgtgcccagccacagcatggtgggcatcaccatggatgtgggcggcagccccatcgtgtcctctgctggggcctacctgatccacggcggcatggacagcaccaggcacagcctggcccacaccagccgcagcagccctgccaccctggagatggccatcgagaacctgcagaagtctgagggcatcaccagccacaagagcggcctgctgaacagccacctgcagtggctgctggacaactatgaaacagctgagggcgtgtccctgcccaggagcagcctgtacaaccactacctgcggcactgccaggagcacaagctggaccctgtgaatgctgccagctttgggaagctgatccgctctgtgttcatgggcctgcggacccggcggctgggcacccggggcaacagcaagtaccactactacggcatccggctgaagccagacagccccctgaaccggctgcaggaggacacccagtacatggccatgaggcagcagcccatgcaccagaagccccgctacagacctgcccagaagacagacagcctgggggacagcggcagccacagcggcctgcacagcaccccagagcagaccatggctgtgcagagccagcaccaccagcagtacattgatgtgagccacgtgtttcctgagttccctgccccagacctgggcagcttcctgctgcaggatggagtgaccctgcatgatgtgaaggccctgcagctggtgtaccgccgccactgtgaggccaccgtggatgtggtgatgaacctgcagttccactacatcgagaagctgtggctgtccttctggaacagcaaggccagcagcagtgatggccccaccagcctgcctgccagtgatgaggaccctgagggcgctgtgctgcccaaggacaagctgatcagcctgtgccagtgtgaccccatcctgcgctggatgaggagctgtgaccacatcctgtaccaggccctggtggagatcctgatcccagatgtgctgcggcctgtgcccagcaccctgacccaggccatccggaactttgccaagagcctggagggctggctgaccaatgccatgtctgacttcccccagcaggtgatccagaccaaggtgggcgtggtgtctgcctttgcccagaccctgcggcgctacaccagcctgaaccacctggcccaggccgcccgggctgtgctgcagaacaccagccagatcaaccagatgctgagtgacctgaacagagtggactttgccaacgtgcaggagcaggcctcctgggtgtgccagtgtgaggagagcgtggtgcagaggctggagcaggacttcaagctgaccctgcagcagcagagcagcctggaccagtgggcctcctggctggacagcgtggtgacccaggtgctgaagcagcacgccggcagccccagcttccccaaggccgcccggcagttcctgctgaagtggagcttctacagctccatggtgatccgggacctgaccctgcggtctgctgccagctttggcagcttccacctgatccggctgctgtatgatgagtacatgttctacctggtggagcaccgggtggccgaggccactggagagacccccatcgctgtgatgggagagttcaatgacctggccagcctgagcctgaccctgctggacaaggatgacatgggagatgagcagaggggcagcgaggccggcccagatgcccggagcctgggggagcccctggtgaagcgggagaggagtgaccccaaccacagcctgcagggcatctag

SEQ ID NO: 167516 - DNA, 2097 bp, Artificial Sequence; identical to SEQ ID NO: 167513
  Description of Artificial Sequence: Synthetic coding sequence

SEQ ID NO: 167517 - DNA, 1851 bp, Artificial Sequence
  Description of Artificial Sequence: Synthetic coding sequence
atggctgaagatgagccagatgccaagagccccaagacaggaggccgggcccctcctggaggagctgaggccggggagcccaccaccctgctgcagaggctgcggggcaccatcagcaaggctgtgcagaacaaggtggagggcatcctgcaggatgtgcagaagttcagtgacaatgacaagctgtacctgtacctgcagctgcccagcggccccaccaccggggacaagagcagcgagcccagcaccctgagcaatgaggagtacatgtatgcctaccgctggatccggaaccacctggaggagcacacagacacctgcctgcccaagcagagcgtgtatgatgcctacaggaagtactgtgagagcctggcctgctgccggcccctgagcacagccaactttgggaagatcatccgggagatcttcccagacatcaaggcccggcggctgggcggccggggccagagcaagtactgctacagcggcatccggaggaagaccctggtgtccatgccacccctgcccggcctggacctgaagggcagcgagagccctgagatgggccctgaggtgaccccagcccccagagatgagctggtggaggccgcctgtgccctgacctgtgactgggccgagcgcatcctgaagaggagcttcagcagcatcgtggaggtggcccgcttcctgctgcagcagcacctgatcagcgcccggagcgcccacgcccacgtgctgaaggccatgggcctggccgaggaggatgaacatgccccccgggagaggagcagcaagcccaagaatggcctggagaaccctgagggcggggcccacaagaagccagagcggctggcccagccccccaaggacctggaggccaggactggagctggccccctggcccggggggagaggaagaagtctgtggtggagagcagcgcccctggggccaacaacctgcaggtgaatgccctggtggcccggctgcccctgctgctgccccgggcccccaggagcctcatcccccccatccctgtgagcccccccatcctggccccccggctgagcagcggggccctgaaggtggccaccctgcccctgagcagcagagctggggcccccccagctgctgtgcccatcatcaacatgatcctgcccaccgtgcctgccctgcccggccctggccctggccctggccgggcccctcctgggggcctgacccagccccggggcacagaaaatcgggaggtgggcattggaggagaccagggcccccatgacaagggcgtgaagaggacagctgaggtgcctgtgtctgaggccagcggccaggcccccccagccaaggccgccaagcaggacatcgaggacacagccagtgatgccaagaggaagaggggccggcccaggaagaagagcggcggcagcggggagaggaacagcacccccctgaagtctgctgctgccatggagagcgcccagagcagccggctgccctgggagacctggggcagcggcggggagggcaacagcgctgggggcgctgagcggcccggccccatgggagaggccgagaagggagctgtgctggcccagggccagggagatggcaccgtgtccaaaggaggccggggccctggcagccagcacaccaaggaggccgaggacaagatccccctggtgcccagcaaggtgtctgtcatcaagggcagccgcagccagaaggaggccttccccctggccaagggggaggtggacacagccccccagggcaacaaggacctgaaggagcacgtgctgcagagcagcctgagccaggagcacaaggaccccaaggccaccccaccctag

SEQ ID NO: 167518 - DNA, 1851 bp, Artificial Sequence; identical to SEQ ID NO: 167517
  Description of Artificial Sequence: Synthetic coding sequence

SEQ ID NO: 167519 - DNA, 1791 bp, Artificial Sequence
  Description of Artificial Sequence: Synthetic coding sequence
atggctgaagatgagccagatgccaagagccccaagacaggaggccgggcccctcctggaggagctgaggccggggagcccaccaccctgctgcagaggctgcggggcaccatcagcaaggctgtgcagaacaaggtggagggcatcctgcaggatgtgcagaagttcagtgacaatgacaagctgtacctgtacctgcagctgcccagcggccccaccaccggggacaagagcagcgagcccagcaccctgagcaatgaggagtacatgtatgcctaccgctggatccggaaccacctggaggagcacacagacacctgcctgcccaagcagagcgtgtatgatgcctacaggaagtactgtgagagcctggcctgctgccggcccctgagcacagccaactttgggaagatcatccgggagatcttcccagacatcaaggcccggcggctgggcggccggggccagagcaagtactgctacagcggcatccggaggaagaccctggtgtccatgccacccctgcccggcctggacctgaagggcagcgagagccctgagatgggccctgaggtgaccccagcccccagagatgagctggtggaggccgcctgtgccctgacctgtgactgggccgagcgcatcctgaagaggagcttcagcagcatcgtggaggtggcccgcttcctgctgcagcagcacctgatcagcgcccggagcgcccacgcccacgtgctgaaggccatgggcctggccgaggaggatgaacatgccccccgggagaggagcagcaagcccaagaatggcctggagaaccctgagggcggggcccacaagaagccagagcggctggcccagccccccaaggacctggaggccaggactggagctggccccctggcccggggggagaggaagaagtctgtggtggagagcagcgcccctggggccaacaacctgcaggtgaatgccctggtggcccggctgcccctgctgctgccccgggcccccaggagcctcatcccccccatccctgtgagcccccccatcctggccccccggctgagcagcggggccctgaaggtggccaccctgcccctgagcagcagagctggggcccccccagctgctgtgcccatcatcaacatgatcctgcccaccgtgcctgccctgcccggccctggccctggccctggccgggcccctcctgggggcctgacccagccccggggcacagaaaatcgggaggtgggcattggaggagaccagggcccccatgacaagggcgtgaagaggacagctgaggtgcctgtgtctgaggccagcggccaggcccccccagccaaggccgccaagcaggacatcgaggacacagccagtgatgccaagaggaagaggggccggcccaggaagaagagcggcggcagcggggagaggaacagcacccccctgaagtctgctgctgccatggagagcgcccagagcagccggctgccctgggagacctggggcagcggcggggagggcaacagcgctgggggcgctgagcggcccggccccatgggagaggccgagaagggagctgtgctggcccagggccagggagatggcaccgtgtccaaaggaggccggggccctggcagccagcacaccaaggaggccgaggacaagatccccctggtgcccagcaaggtgtctgtcatcaagggcagccgcagccagaaggaggccttccccctggccaagggggaggtggacacagccccccagggcaacaaggacctgaagtag

SEQ ID NO: 167520 - DNA, 357 bp, Artificial Sequence
  Description of Artificial Sequence: Synthetic coding sequence
atggctgaagatgagccagatgccaagagccccaagacaggaggccgggcccctcctggaggagctgaggccggggagcccaccaccctgctgcagaggctgcggggcaccatcagcaaggctgtgcagaacaaggtggagggcatcctgcaggatgtgcagaagttcagtgacaatgacaagctgtacctgtacctgcagctgcccagcggccccaccaccggggacaagagcagcgagcccagcaccctgagcaatgaggagtacatgtatgcctaccgctggatccggaaccacctggaggagcacacagacacctgcctgcccaagcagagcgtgtatgatgcctacagatag

SEQ ID NO: 167521 - DNA, 693 bp, Artificial Sequence
  Description of Artificial Sequence: Synthetic coding sequence
atggctgaagatgagccagatgccaagagccccaagacaggaggccgggcccctcctggaggagctgaggccggggagcccaccaccctgctgcagaggctgcggggcaccatcagcaaggctgtgcagaacaaggtggagggcatcctgcaggatgtgcagaagttcagtgacaatgacaagctgtacctgtacctgcagctgcccagcggccccaccaccggggacaagagcagcgagcccagcaccctgagcaatgaggagtacatgtatgcctaccgctggatccggaaccacctggaggagcacacagacacctgcctgcccaagcagagcgtgtatgatgcctacaggaagtactgtgagagcctggcctgctgccggcccctgagcacagccaactttgggaagatcatccgggagatcttcccagacatcaaggcccggcggctgggcggccggggccagagcaagtactgctacagcggcatccggaggaagaccctggtgtccatgccacccctgcccggcctggacctgaagggcagcgagagccctgagatgggccctgaggtgaccccagcccccagagatgagctggtggaggccgcctgtgccctgacctgtgactgggccgagcgcatcctgaagaggagcttcagcagcatcgtggaggtggcccgcttcctgtag

SEQ ID NO: 167522 - DNA, 372 bp, Artificial Sequence
  Description of Artificial Sequence: Synthetic coding sequence
atggctgaagatgagccagatgccaagagccccaagacaggaggccgggcccctcctggaggagctgaggccggggagcccaccaccctgctgcagaggctgcggggcaccatcagcaaggctgtgcagaacaaggtggagggcatcctgcaggatgtgcagaagttcagtgacaatgacaagctgtacctgtacctgcagctgcccagcggccccaccaccggggacaagagcagcgagcccagcaccctgagcaatgaggagtacatgtatgcctaccgctggatccggaaccacctggaggagcacacagacacctgcctgcccaagcagagcgtgtatgatgcctacaggaagtactgtgagagctag

SEQ ID NO: 167523 - DNA, 291 bp, Artificial Sequence
  Description of Artificial Sequence: Synthetic coding sequence
atggctgaagatgagccagatgccaagagccccaagacaggaggccgggcccctcctggaggagctgaggccggggagcccaccaccctgctgcagaggctgcggggcaccatcagcaaggctgtgcagaacaaggtggagggcatcctgcaggatgtgcagaagttcagtgacaatgacaagctgtacctgtacctgcagctgcccagcggccccaccaccggggacaagagcagcgagcccagcaccctgagcaatgaggagtacatgtatgcctaccgctggatctag

SEQ ID NO: 167524 - DNA, 321 bp, Artificial Sequence
  Description of Artificial Sequence: Synthetic coding sequence
atggctgaagatgagccagatgccaagagccccaagacaggaggccgggcccctcctggaggagctgaggccggggagcccaccaccctgctgcagaggctgcggggcaccatcagcaaggctgtgcagaacaaggtggagggcatcctgcaggatgtgcagaagttcagtgacaatgacaagctgtacctgtacctgcagctgcccagcggccccaccaccggggacaagagcagcgagcccagcaccctgagcaatgaggagtacatgtatgcctaccgctggatccggaaccacctggaggagcacacagacacctag

SEQ ID NO: 167525 - DNA, 555 bp, Artificial Sequence
  Description of Artificial Sequence: Synthetic coding sequence
atggctgaagatgagccagatgccaagagccccaagacaggaggccgggcccctcctggaggagctgaggccggggagcccaccaccctgctgcagaggctgcggggcaccatcagcaaggctgtgcagaacaaggtggagggcatcctgcaggatgtgcagaagttcagtgacaatgacaagctgtacctgtacctgcagctgcccagcggccccaccaccggggacaagagcagcgagcccagcaccctgagcaatgaggagtacatgtatgcctaccgctggatccggaaccacctggaggagcacacagacacctgcctgcccaagcagagcgtgtatgatgcctacaggaagtactgtgagagcctggcctgctgccggcccctgagcacagccaactttgggaagatcatccgggagatcttcccagacatcaaggcccggcggctgggcggccggggccagagcaagtactgctacagcggcatccggaggaagaccctggtgtccatgccacccctgcccggcctggacctgaagggcagcgagtag

SEQ ID NO: 167526 - DNA, 1731 bp, Artificial Sequence
  Description of Artificial Sequence: Synthetic coding sequence
atggctgaagatgagccagatgccaagagccccaagacaggaggccgggcccctcctggaggagctgaggccggggagcccaccaccctgctgcagaggctgcggggcaccatcagcaaggctgtgcagaacaaggtggagggcatcctgcaggatgtgcagaagttcagtgacaatgacaagctgtacctgtacctgcagctgcccagcggccccaccaccggggacaagaggaagtactgtgagagcctggcctgctgccggcccctgagcacagccaactttgggaagatcatccgggagatcttcccagacatcaaggcccggcggctgggcggccggggccagagcaagtactgctacagcggcatccggaggaagaccctggtgtccatgccacccctgcccggcctggacctgaagggcagcgagagccctgagatgggccctgaggtgaccccagcccccagagatgagctggtggaggccgcctgtgccctgacctgtgactgggccgagcgcatcctgaagaggagcttcagcagcatcgtggaggtggcccgcttcctgctgcagcagcacctgatcagcgcccggagcgcccacgcccacgtgctgaaggccatgggcctggccgaggaggatgaacatgccccccgggagaggagcagcaagcccaagaatggcctggagaaccctgagggcggggcccacaagaagccagagcggctggcccagccccccaaggacctggaggccaggactggagctggccccctggcccggggggagaggaagaagtctgtggtggagagcagcgcccctggggccaacaacctgcaggtgaatgccctggtggcccggctgcccctgctgctgccccgggcccccaggagcctcatcccccccatccctgtgagcccccccatcctggccccccggctgagcagcggggccctgaaggtggccaccctgcccctgagcagcagagctggggcccccccagctgctgtgcccatcatcaacatgatcctgcccaccgtgcctgccctgcccggccctggccctggccctggccgggcccctcctgggggcctgacccagccccggggcacagaaaatcgggaggtgggcattggaggagaccagggcccccatgacaagggcgtgaagaggacagctgaggtgcctgtgtctgaggccagcggccaggcccccccagccaaggccgccaagcaggacatcgaggacacagccagtgatgccaagaggaagaggggccggcccaggaagaagagcggcggcagcggggagaggaacagcacccccctgaagtctgctgctgccatggagagcgcccagagcagccggctgccctgggagacctggggcagcggcggggagggcaacagcgctgggggcgctgagcggcccggccccatgggagaggccgagaagggagctgtgctggcccagggccagggagatggcaccgtgtccaaaggaggccggggccctggcagccagcacaccaaggaggccgaggacaagatccccctggtgcccagcaaggtgtctgtcatcaagggcagccgcagccagaaggaggccttccccctggccaagggggaggtggacacagccccccagggcaacaaggacctgaaggagcacgtgctgcagagcagcctgagccaggagcacaaggaccccaaggccaccccaccctag

SEQ ID NO: 167527 - DNA, 1851 bp, Artificial Sequence; identical to SEQ ID NO: 167517
  Description of Artificial Sequence: Synthetic coding sequence

SEQ ID NO: 167528 - DNA, 498 bp, Artificial Sequence
  Description of Artificial Sequence: Synthetic coding sequence
atggctgaagatgagccagatgccaagagccccaagacaggaggccgggcccctcctggaggagctgaggccggggagcccaccaccctgctgcagaggctgcggggcaccatcagcaaggctgtgcagaacaaggtggagggcatcctgcaggatgtgcagaagttcagtgacaatgacaagctgtacctgtacctgcagctgcccagcggccccaccaccggggacaagagcagcgagcccagcaccctgagcaatgaggagtacatgtatgcctaccgctggatccggaaccacctggaggagcacacagacacctgcctgcccaagcagagcgtgtatgatgcctacaggaagtactgtgagagcctggcctgctgccggcccctgagcacagccaactttgggaagatcatccgggagatcttcccagacatcaaggcccggcggctgggcggccggggccagagcaagtactgctacagcggcatcagatag

SEQ ID NO: 167529 - DNA, 2787 bp, Artificial Sequence
  Description of Artificial Sequence: Synthetic coding sequence
atggccaaggtgcctgagctggaggacaccttcctgcaggcccagcctgccccccagctgagccctggcatccaggaggactgctgcgtgcagctgctgggcaagggcctgctggtgtacccagaggagaccgtgtacctggccgctgagggccagcctggaggagagcagggcggcggggagaagggggaggaccctgagctgcctggagctgtgaagtctgagatgcacctgaacaacggcaacttcagcagcgaggaggaggatgctgacaaccacgacagcaagaccaaggctgctgaccagtacctgagccagaagaagaccatcacccagatcgtgaaggacaagaagaagcagacccagctgaccctgcagtggctggaggagaactacatcgtgtgtgaaggagtgtgcctgccccgctgcatcctgtatgcccactacctggacttctgcaggaaggagaagctggagcccgcctgtgccgccaccttcggcaagaccatccggcagaagttccccctgctgaccacccggcggctgggcacccggggccacagcaagtaccactactatggaattggcatcaaggagagcagcgcctactaccacagcgtgtacagcggcaagggcctgacccgcttcagcggcagcaagctgaagaatgaaggaggcttcaccaggaagtacagcctgagcagcaagacaggcaccctgctgcctgagttccccagcgcccagcacctggtgtaccagggctgcatcagcaaggacaaggtggacaccctcatcatgatgtacaagacccactgccagtgcatcctggacaatgccatcaatggaaactttgaggagatccagcacttcctgctgcacttctggcagggcatgccagaccacctgctgcccctgctggagaaccctgtgatcatcgacatcttctgtgtgtgtgacagcatcctgtacaaggtgctgacagatgtgctgatcccagccaccatgcaggagatgcctgagagcctgctggccgacatccggaactttgccaagaactgggagcagtgggtggtgagcagcctggagaacctgcctgaggccctgacagacaagaagatccccatcgtgagaagatttgtgagcagcctgaagaggcagaccagcttcctgcacctggcccagatcgcccggcctgccctgtttgaccagcacgtggtgaacagcatggtgtctgacatcgagcgggtggacctgaacagcatcggcagccaggccctgctgaccatcagcggcagcacagacacagaaagtggcatctacacagaacatgacagcatcaccgtcttccaggagctgaaggacctgctgaagaagaatgccaccgtggaggccttcatcgagtggctggacacagtggtggagcagagggtcatcaagaccagcaagcagaatggccgcagcctgaagaagagggcccaggacttcctgctgaagtggagcttcttcggggcccgggtgatgcacaacctgaccctgaacaatgccagcagctttggcagcttccacctgatccgcatgctgctggatgagtacatcctgctggccatggagacccagttcaacaatgacaaggagcaggagctgcagaacctgctggacaagtacatgaagaacagtgatgccagcaaggccgccttcaccgccagccccagcagctgcttcctggccaacagaaacaagggctccatggtgtccagtgatgctgtgaagaatgaaagccacgtggagaccacctacctgcccctgcccagcagccagcccggcggcctgggccctgccctgcaccagtttcctgctggcaacacagacaacatgcccctgaccggccagatggagctgagccagattgctggccacctgatgaccccacccatcagccctgccatggccagccggggcagcgtcatcaaccagggccccatggccggccggcccccatctgtgggccctgtgctgagcgcccccagccactgcagcacctacccagagcccatctaccccaccctgccccaggccaaccacgacttctacagcaccagcagcaactaccagacagtgttccgggcccagccccacagcaccagcggcctgtacccccaccacacagagcacggccgctgcatggcctggacagagcagcagctgagccgggacttcttcagcggcagctgtgccggcagcccctacaacagcaggcctcccagcagctatggccccagcctgcaggcccaggacagccacaacatgcagttcctgaacacaggcagcttcaacttcctgagcaacacaggagctgccagctgccagggcgccaccctgccccccaacagccccaacggctactacggcagcaacatcaactacccagagagccaccggctgggctccatggtgaaccagcacgtgtctgtcatcagcagcatccgcagcctgcccccctacagcgacatccatgaccccctgaacatcctggatgattctggcaggaagcagaccagcagcttctacacagacaccagcagccctgtggcctgcaggacccctgtgctggccagcagcctgcagacccccatccccagcagcagcagccagtgcatgtatggcaccagcaaccagtacccagcccaggagaccctggacagccacggcaccagcagccgggagatggtgagcagcctgccccccatcaacacagtgttcatgggcacagctgctgggggcacctag

SEQ ID NO: 167530 - DNA, 4122 bp, Artificial Sequence
  Description of Artificial Sequence: Synthetic coding sequence
atggccgaggagcagcagcagcccccaccccagcagccagatgcccaccagcagctgccccccagcgcccccaacagcggcgtggccctgcctgccctggtgcccggcctgcccggcacagaggccagcgccctgcagcacaagatcaagaacagcatctgcaagacagtgcagagcaaggtggactgcatcctgcaggaggtggagaagttcacagacctggagaagctgtacctgtacctgcagctgcccagcggcctgagcaatggagagaagagtgaccagaatgccatgagcagcagccgggcccagcagatgcacgccttctcctggatccggaacaccctggaggagcaccctgagaccagcctgcccaagcaggaggtgtatgatgagtacaagagctactgtgacaacctgggctaccaccccctgtctgctgctgactttgggaagatcatgaagaatgtgttccccaacatgaaggcccggcggctgggcacccggggcaagagcaagtactgctacagcggcctgaggaagaaggcctttgtgcacatgcccaccctgcccaacctggacttccacaagacaggagatggcctggagggcgctgagcccagcggccagctgcagaacattgatgaggaggtgatcagcagcgcctgccgcctggtgtgtgagtgggcccagaaggtgctgagccagccctttgacacagtgctggagctggcccgcttcctggtgaagagccactacatcggcaccaagtccatggccgccctgactgtgatggctgctgccccagctggcatgaagggcatcacccagcccagcgccttcatccccacagctgagagcaacagcttccagccccaggtgaagaccctgcccagccccattgatgccaagcagcagctgcagaggaagatccagaagaagcagcaggagcagaagctgcagagccccctgcctggagagagcgctgccaagaagtctgagagcgccaccagcaatggagtgaccaacctgcccaacggcaaccccagcatcctgagcccccagcccatcggcatcgtggtggccgctgtgcccagccccatccctgtgcagaggacccggcagctggtgaccagccccagccccatgagcagcagtgatggcaaggtgctgcccctgaatgtgcaggtggtgacccagcacatgcagagcgtgaagcaggcccccaagaccccccagaatgtgcctgccagccctggaggagacagaagtgcccggcaccgctacccccagatcctgcccaagccagccaacaccagcgccctgaccatccgcagccccaccaccgtgctcttcaccagcagccccatcaagacagctgtggtgcctgccagccacatgagcagcctgaatgtggtgaagatgaccaccatcagcctgacccccagcaacagcaacacccccctgaagcacagcgcctctgtgtcctctgccaccggcaccacagaggagagccgctctgtgccccagatcaagaatggatctgtggtgtccctgcagagccctggcagccgcagcagcagcgctgggggcaccagcgctgtggaggtgaaggtggagcctgagaccagcagtgatgagcaccctgtgcagtgccaggagaacagtgatgaggccaaggccccccagacccccagcgccctgctgggccagaagagcaacacagatggagccctgcagaagcccagcaatgaaggagtcatcgagatcaaggccaccaaggtgtgtgaccagaggaccaagtgcaagagccgctgcaatgagatgctgcccggcaccagcactggaaacaaccagagcaccatcaccctgtctgtggccagccagaacctgaccttcaccagcagcagcagccccccaaatggagacagcatcaacaaggaccccaagctgtgcaccaagagccccaggaagaggctgagcagcaccctgcaggagacccaggtgccccctgtgaagaagcccatcgtggagcagctgtctgctgccaccatcgagggccagaagcagggctctgtgaagaaggaccagaaggtgccccacagcggcaagacagagggcagcacagctggggcccagatccccagcaaggtgtctgtgaatgtgagcagccacatcggggccaaccagcccctgaacagcagcgccctggtgatcagtgacagcgccctggagcagcagaccacccccagcagcagcccagacatcaaggtgaagctggagggctctgtgttcctgctggacagcgacagcaagtctgtgggcagcttcaaccccaacggctggcagcagatcaccaaggacagcgagttcatcagcgccagctgtgagcagcagcaggacatctctgtgatgaccatccctgagcacagcgacatcaatgacctggagaagtctgtgtgggagctggagggcatgccccaggacacctacagccagcagctgcacagccagatccaggagagcagcctgaaccagatccaggcccacagcagtgaccagctgcccctgcagagcgagctgaaggagtttgagcccagcgtgtcccagaccaatgaaagctacttcccctttgatgatgagctgacccaggacagcatcgtggaggagctggtgctgatggagcagcagatgtccatgaacaacagccacagctatggcaactgcctgggcatgaccctgcagagccagagcgtgacccctggggcccccatgagcagccacaccagcagcacccacttctaccaccccatccacagcaatggcacccccatccacacccccacccccacccccacccccacccccacccccacccccacccccacccccaccagcgagatgattgctggcagccagagcctgagccgggagagcccctgcagccggctggcccagaccacccctgtggacagcgccctgggcagcagccgccacacccccatcggcaccccccacagcaactgcagcagctctgtgccccccagccctgtggagtgcaggaacccctttgccttcacccccatcagcagctccatggcctaccatgatgccagcatcgtgagcagcagccctgtgaagcccatgcagaggcccatggccacccacccagacaagaccaagctggagtggatgaacaacggctacagcggcgtgggcaacagctctgtgtctggccacggcatcctgcccagctaccaggagctggtggaggaccgcttcaggaagccccacgcctttgctgtgcccggccagagctaccagagccagagccgccaccacgacaccaactttggccgcctgacccctgtgtcccctgtgcagcaccagggcgccaccgtgaacaacaccaacaagcaggagggctttgctgtgcctgcccccctggacaacaagggcaccaacagcagcgccagcagcaacttccgctgccgctctgtgtccccagctgtgcaccggcagaggaacctgagcggcagcaccctgtaccctgtgagcaacatccccaggagcaatgtgacccccttcggcagccctgtgaccccagaggtgcacgtgttcaccaacgtgcacacagatgcctgtgccaacaacatcgcccagaggagccagagcgtgcccctgactgtgatgatgcagacagccttccccaatgccctgcagaagcaggccaacagcaagaagatcaccaacgtgctgctgagcaagctggacagcgacaatgatgatgctgtgcggggcctgggcatgaacaacctgcccagcaactacacagccaggatgaacctgacccagatcctggagcccagcacagtgttccccagcgccaacccccagaacatgattgacagcagcacctctgtgtatgagttccagacccccagctacctgaccaagagcaacagcacaggccagatcaacttcagccctggggacaaccaggcccagagcgagattggagagcagcagctggacttcaacagcacagtgaaggacctgctgagcggggacagcctgcagaccaaccagcagctgaagtacccagatgtgctgggggagtag

SEQ ID NO: 167531 - DNA, 3846 bp, Artificial Sequence
  Description of Artificial Sequence: Synthetic coding sequence
atgagcagcagccgggcccagcagatgcacgccttctcctggatccggaacaccctggaggagcaccctgagaccagcctgcccaagcaggaggtgtatgatgagtacaagagctactgtgacaacctgggctaccaccccctgtctgctgctgactttgggaagatcatgaagaatgtgttccccaacatgaaggcccggcggctgggcacccggggcaagagcaagtactgctacagcggcctgaggaagaaggcctttgtgcacatgcccaccctgcccaacctggacttccacaagacaggagatggcctggagggcgctgagcccagcggccagctgcagaacattgatgaggaggtgatcagcagcgcctgccgcctggtgtgtgagtgggcccagaaggtgctgagccagccctttgacacagtgctggagctggcccgcttcctggtgaagagccactacatcggcaccaagtccatggccgccctgactgtgatggccgccgccccagctggcatgaagggcatcacccagcccagcgccttcatccccacagctgagagcaacagcttccagccccaggtgaagaccctgcccagccccattgatgccaagcagcagctgcagaggaagatccagaagaagcagcaggagcagaagctgcagagccccctgcccggggagagcgctgccaagaagtctgagagcgccaccagcaatggagtgaccaacctgcccaatggaaaccccagcatcctgagcccccagcccatcggcatcgtggtggccgctgtgcccagccccatccctgtgcagaggacccggcagctggtgaccagccccagccccatgagcagcagtgatggcaaggtgctgcccctgaatgtgcaggtggtgacccagcacatgcagagcgtgaagcaggcccccaagaccccccagaatgtgcctgccagccctggaggagacagaagtgcccggcaccgctacccccagatcctgcccaagccagccaacaccagcgccctgaccatccgcagccccaccaccgtgctcttcaccagcagccccatcaagacagctgtggtgcctgccagccacatgagcagcctgaatgtggtgaagatgaccaccatcagcctgacccccagcaacagcaacacccccctgaagcacagcgcctctgtgagcagcgccaccggcaccacagaggagagccgctctgtgccccagatcaagaatggatctgtggtgtccctgcagagccctggcagccgcagcagcagcgctgggggcaccagcgctgtggaggtgaaggtggagcctgagaccagcagtgatgagcaccctgtgcagtgccaggagaacagtgatgaggccaaggccccccagaccccatctgccctgctgggccagaagagcaacacagatggagccctgcagaagcccagcaatgaaggagtgattgagatcaaggccaccaaggtgtgtgaccagaggaccaagtgcaagagccgctgcaatgagatgctgcccggcaccagcacaggcaacaaccagagcaccatcaccctgtctgtggccagccagaacctgaccttcaccagcagcagcagcccccccaacggggacagcatcaacaaggaccccaagctgtgcaccaagagccccaggaagaggctgagcagcaccctgcaggagacccaggtgccccctgtgaagaagcccatcgtggagcagctgtctgctgccaccatcgagggccagaagcagggctctgtgaagaaggaccagaaggtgccccacagcggcaagacagagggcagcacagctggggcccagatccccagcaaggtgtctgtgaatgtgagcagccacatcggggccaaccagcccctgaacagcagcgccctggtgatcagtgacagcgccctggagcagcagaccacccccagcagcagcccagacatcaaggtgaagctggagggcagcgtcttcctgctggacagcgacagcaagtctgtgggcagcttcaaccccaacggctggcagcagatcaccaaggacagcgagttcatcagcgccagctgtgagcagcagcaggacatctctgtgatgaccatccctgagcacagcgacatcaatgacctggagaagtctgtgtgggagctggagggcatgccccaggacacctacagccagcagctgcacagccagatccaggagagcagcctgaaccagatccaggcccacagcagtgaccagctgcccctgcagagcgagctgaaggagtttgagcccagcgtgtcccagaccaatgaaagctacttcccctttgatgatgagctgacccaggacagcatcgtggaggagctggtgctgatggagcagcagatgtccatgaacaacagccacagctatggcaactgcctgggcatgaccctgcagagccagagcgtgacccctggggcccccatgagcagccacaccagcagcacccacttctaccaccccatccacagcaatggcacccccatccacacccccacccccacccccacccccacccccacccccacccccacccccacccccaccagcgagatgattgctggcagccagagcctgagccgggagagcccctgcagccggctggcccagaccacccctgtggacagcgccctgggcagcagccgccacacccccatcggcaccccccacagcaactgcagcagctctgtgccccccagccctgtggagtgcaggaacccctttgccttcacccccatcagcagctccatggcctaccatgatgccagcatcgtgagcagcagccctgtgaagcccatgcagaggcccatggccacccacccagacaagaccaagctggagtggatgaacaacggctacagcggcgtgggcaacagctctgtgtctggccacggcatcctgcccagctaccaggagctggtggaggaccgcttcaggaagccccacgcctttgctgtgcccggccagagctaccagagccagagccgccaccacgacaccaactttggccgcctgacccctgtgtcccctgtgcagcaccagggcgccaccgtgaacaacaccaacaagcaggagggctttgctgtgcctgcccccctggacaacaagggcaccaacagcagcgccagcagcaacttccgctgccgctctgtgtccccagctgtgcaccggcagaggaacctgagcggcagcaccctgtaccctgtgagcaacatccccaggagcaatgtgaccccatttggcagccctgtgaccccagaggtgcacgtgttcaccaacgtgcacacagatgcctgtgccaacaacatcgcccagaggagccagagcgtgcccctgactgtgatgatgcagacagccttccccaatgccctgcagaagcaggccaacagcaagaagatcaccaacgtgctgctgagcaagctggacagcgacaatgatgatgctgtgcggggcctgggcatgaacaacctgcccagcaactacacagccaggatgaacctgacccagatcctggagcccagcaccgtcttccccagcgccaacccccagaacatgattgacagcagcacctctgtgtatgagttccagacccccagctacctgaccaagagcaacagcacaggccagatcaacttcagccctggggacaaccaggcccagagcgagatcggggagcagcagctggacttcaacagcacagtgaaggacctgctgagcggggacagcctgcagaccaaccagcagctgtgcagctgccccagcagcctgctggccggcatgcagatgtag

SEQ ID NO: 167532 - DNA, 4383 bp, Artificial Sequence
  Description of Artificial Sequence: Synthetic coding sequence
atggccgaggagcagcagcagcccccaccccagcagccagatgcccaccagcagctgccccccagcgcccccaacagcggcgtggccctgcctgccctggtgcccggcctgcccggcacagaggccagcgccctgcagcacaagatcaagaacagcatctgcaagacagtgcagagcaaggtggactgcatcctgcaggaggtggagaagttcacagacctggagaagctgtacctgtacctgcagctgcccagcggcctgagcaatggagagaagagtgaccagaatgccatgagcagcagccgggcccagcagatgcacgccttctcctggatccggaacaccctggaggagcaccctgagaccagcctgcccaagcaggaggtgtatgatgagtacaagagctactgtgacaacctgggctaccaccccctgtctgctgctgactttgggaagatcatgaagaatgtgttccccaacatgaaggcccggcggctgggcacccggggcaagagcaagtactgctacagcggcctgaggaagaaggcctttgtgcacatgcccaccctgcccaacctggacttccacaagacaggagatggcctggagggcgctgagcccagcggccagctgcagaacattgatgaggaggtgatcagcagcgcctgccgcctggtgtgtgagtgggcccagaaggtgctgagccagccctttgacacagtgctggagctggcccgcttcctggtgaagagccactacatcggcaccaagtccatggccgccctgactgtgatggctgctgccccagctggcatgaagggcatcacccagcccagcgccttcatccccacagctgagagcaacagcttccagccccaggtgaagaccctgcccagccccattgatgccaagcagcagctgcagaggaagatccagaagaagcagcaggagcagaagctgcagagccccctgcctggagagagcgctgccaagaagtctgagagcgccaccagcaatggagtgaccaacctgcccaacggcaaccccagcatcctgagcccccagcccatcggcatcgtggtggccgctgtgcccagccccatccctgtgcagaggacccggcagctggtgaccagccccagccccatgagcagcagtgatggcaaggtgctgcccctgaatgtgcaggtggtgacccagcacatgcagagcgtgaagcaggcccccaagaccccccagaatgtgcctgccagccctggaggagacagaagtgcccggcaccgctacccccagatcctgcccaagccagccaacaccagcgccctgaccatccgcagccccaccaccgtgctcttcaccagcagccccatcaagacagctgtggtgcctgccagccacatgagcagcctgaatgtggtgaagatgaccaccatcagcctgacccccagcaacagcaacacccccctgaagcacagcgcctctgtgtcctctgccaccggcaccacagaggagagccgctctgtgccccagatcaagaatggatctgtggtgtccctgcagagccctggcagccgcagcagcagcgctgggggcaccagcgctgtggaggtgaaggtggagcctgagaccagcagtgatgagcaccctgtgcagtgccaggagaacagtgatgaggccaaggccccccagacccccagcgccctgctgggccagaagagcaacacagatggagccctgcagaagcccagcaatgaaggagtcatcgagatcaaggccaccaaggtgtgtgaccagaggaccaagtgcaagagccgctgcaatgagatgctgcccggcaccagcactggaaacaaccagagcaccatcaccctgtctgtggccagccagaacctgaccttcaccagcagcagcagccccccaaatggagacagcatcaacaaggaccccaagctgtgcaccaagagccccaggaagaggctgagcagcaccctgcaggagacccaggtgccccctgtgaagaagcccatcgtggagcagctgtctgctgccaccatcgagggccagaagcagggctctgtgaagaaggaccagaaggtgccccacagcggcaagacagagggcagcacagctggggcccagatccccagcaaggtgtctgtgaatgtgagcagccacatcggggccaaccagcccctgaacagcagcgccctggtgatcagtgacagcgccctggagcagcagaccacccccagcagcagcccagacatcaaggtgaagctggagggctctgtgttcctgctggacagcgacagcaagtctgtgggcagcttcaaccccaacggctggcagcagatcaccaaggacagcgagttcatcagcgccagctgtgagcagcagcaggacatctctgtgatgaccatccctgagcacagcgacatcaatgacctggagaagtctgtgtgggagctggagggcatgccccaggacacctacagccagcagctgcacagccagatccaggagagcagcctgaaccagatccaggcccacagcagtgaccagctgcccctgcagagcgagctgaaggagtttgagcccagcgtgtcccagaccaatgaaagctacttcccctttgatgatgagctgacccaggacagcatcgtggaggagctggtgctgatggagcagcagatgtccatgaacaacagccacagctatggcaactgcctgggcatgaccctgcagagccagagcgtgacccctggggcccccatgagcagccacaccagcagcacccacttctaccaccccatccacagcaatggcacccccatccacacccccacccccacccccacccccacccccacccccacccccacccccacccccaccagcgagatgattgctggcagccagagcctgagccgggagagcccctgcagccggctggcccagaccacccctgtggacagcgccctgggcagcagccgccacacccccatcggcaccccccacagcaactgcagcagctctgtgccccccagccctgtggagtgcaggaacccctttgccttcacccccatcagcagctccatggcctaccatgatgccagcatcgtgagcagcagccctgtgaagcccatgcagaggcccatggccacccacccagacaagaccaagctggagtggatgaacaacggctacagcggcgtgggcaacagctctgtgtctggccacggcatcctgcccagctaccaggagctggtggaggaccgcttcaggaagccccacgcctttgctgtgcccggccagagctaccagagccagagccgccaccacgacaccaactttggccgcctgacccctgtgtcccctgtgcagcaccagggcgccaccgtgaacaacaccaacaagcaggagggctttgctgtgcctgcccccctggacaacaagggcaccaacagcagcgccagcagcaacttccgctgccgctctgtgtccccagctgtgcaccggcagaggaacctgagcggcagcaccctgtaccctgtgagcaacatccccaggagcaatgtgacccccttcggcagccctgtgaccccagaggtgcacgtgttcaccaacgtgcacacagatgcctgtgccaacaacatcgcccagaggagccagagcgtgcccctgactgtgatgatgcagacagccttccccaatgccctgcagaagcaggccaacagcaagaagatcaccaacgtgctgctgagcaagctggacagcgacaatgatgatgctgtgcggggcctgggcatgaacaacctgcccagcaactacacagccaggatgaacctgacccagatcctggagcccagcacagtgttccccagcgccaacccccagaacatgattgacagcagcacctctgtgtatgagttccagacccccagctacctgaccaagagcaacagcacaggccagatcaacttcagccctggggacaaccaggcccagagcgagattggagagcagcagctggacttcaacagcacagtgaaggacctgctgagcggggacagcctgcagaccaaccagcagctggtgggccagggcgccagtgacctgaccaacacagccagtgacttcagcagtgacatccggctgagcagcgagctgagcggcagcatcaatgacctgaacaccctggaccccaacctgctgtttgaccccggccggcagcagggccaggatgatgaggccaccctggaggagctgaagaatgaccccctcttccagcagatctgcagcgagagcatgaacagcatgaccagcagcggctttgagtggattgagagcaaggaccaccccaccgtggagatgctgggctag

SEQ ID NO: 167533 - DNA, 4092 bp, Artificial Sequence
  Description of Artificial Sequence: Synthetic coding sequence
atgagcagcagccgggcccagcagatgcacgccttctcctggatccggaacaccctggaggagcaccctgagaccagcctgcccaagcaggaggtgtatgatgagtacaagagctactgtgacaacctgggctaccaccccctgtctgctgctgactttgggaagatcatgaagaatgtgttccccaacatgaaggcccggcggctgggcacccggggcaagagcaagtactgctacagcggcctgaggaagaaggcctttgtgcacatgcccaccctgcccaacctggacttccacaagacaggagatggcctggagggcgctgagcccagcggccagctgcagaacattgatgaggaggtgatcagcagcgcctgccgcctggtgtgtgagtgggcccagaaggtgctgagccagccctttgacacagtgctggagctggcccgcttcctggtgaagagccactacatcggcaccaagtccatggccgccctgactgtgatggccgccgccccagctggcatgaagggcatcacccagcccagcgccttcatccccacagctgagagcaacagcttccagccccaggtgaagaccctgcccagccccattgatgccaagcagcagctgcagaggaagatccagaagaagcagcaggagcagaagctgcagagccccctgcccggggagagcgctgccaagaagtctgagagcgccaccagcaatggagtgaccaacctgcccaatggaaaccccagcatcctgagcccccagcccatcggcatcgtggtggccgctgtgcccagccccatccctgtgcagaggacccggcagctggtgaccagccccagccccatgagcagcagtgatggcaaggtgctgcccctgaatgtgcaggtggtgacccagcacatgcagagcgtgaagcaggcccccaagaccccccagaatgtgcctgccagccctggaggagacagaagtgcccggcaccgctacccccagatcctgcccaagccagccaacaccagcgccctgaccatccgcagccccaccaccgtgctcttcaccagcagccccatcaagacagctgtggtgcctgccagccacatgagcagcctgaatgtggtgaagatgaccaccatcagcctgacccccagcaacagcaacacccccctgaagcacagcgcctctgtgagcagcgccaccggcaccacagaggagagccgctctgtgccccagatcaagaatggatctgtggtgtccctgcagagccctggcagccgcagcagcagcgctgggggcaccagcgctgtggaggtgaaggtggagcctgagaccagcagtgatgagcaccctgtgcagtgccaggagaacagtgatgaggccaaggccccccagaccccatctgccctgctgggccagaagagcaacacagatggagccctgcagaagcccagcaatgaaggagtgattgagatcaaggccaccaaggtgtgtgaccagaggaccaagtgcaagagccgctgcaatgagatgctgcccggcaccagcacaggcaacaaccagagcaccatcaccctgtctgtggccagccagaacctgaccttcaccagcagcagcagcccccccaacggggacagcatcaacaaggaccccaagctgtgcaccaagagccccaggaagaggctgagcagcaccctgcaggagacccaggtgccccctgtgaagaagcccatcgtggagcagctgtctgctgccaccatcgagggccagaagcagggctctgtgaagaaggaccagaaggtgccccacagcggcaagacagagggcagcacagctggggcccagatccccagcaaggtgtctgtgaatgtgagcagccacatcggggccaaccagcccctgaacagcagcgccctggtgatcagtgacagcgccctggagcagcagaccacccccagcagcagcccagacatcaaggtgaagctggagggcagcgtcttcctgctggacagcgacagcaagtctgtgggcagcttcaaccccaacggctggcagcagatcaccaaggacagcgagttcatcagcgccagctgtgagcagcagcaggacatctctgtgatgaccatccctgagcacagcgacatcaatgacctggagaagtctgtgtgggagctggagggcatgccccaggacacctacagccagcagctgcacagccagatccaggagagcagcctgaaccagatccaggcccacagcagtgaccagctgcccctgcagagcgagctgaaggagtttgagcccagcgtgtcccagaccaatgaaagctacttcccctttgatgatgagctgacccaggacagcatcgtggaggagctggtgctgatggagcagcagatgtccatgaacaacagccacagctatggcaactgcctgggcatgaccctgcagagccagagcgtgacccctggggcccccatgagcagccacaccagcagcacccacttctaccaccccatccacagcaatggcacccccatccacacccccacccccacccccacccccacccccacccccacccccacccccacccccaccagcgagatgattgctggcagccagagcctgagccgggagagcccctgcagccggctggcccagaccacccctgtggacagcgccctgggcagcagccgccacacccccatcggcaccccccacagcaactgcagcagctctgtgccccccagccctgtggagtgcaggaacccctttgccttcacccccatcagcagctccatggcctaccatgatgccagcatcgtgagcagcagccctgtgaagcccatgcagaggcccatggccacccacccagacaagaccaagctggagtggatgaacaacggctacagcggcgtgggcaacagctctgtgtctggccacggcatcctgcccagctaccaggagctggtggaggaccgcttcaggaagccccacgcctttgctgtgcccggccagagctaccagagccagagccgccaccacgacaccaactttggccgcctgacccctgtgtcccctgtgcagcaccagggcgccaccgtgaacaacaccaacaagcaggagggctttgctgtgcctgcccccctggacaacaagggcaccaacagcagcgccagcagcaacttccgctgccgctctgtgtccccagctgtgcaccggcagaggaacctgagcggcagcaccctgtaccctgtgagcaacatccccaggagcaatgtgaccccatttggcagccctgtgaccccagaggtgcacgtgttcaccaacgtgcacacagatgcctgtgccaacaacatcgcccagaggagccagagcgtgcccctgactgtgatgatgcagacagccttccccaatgccctgcagaagcaggccaacagcaagaagatcaccaacgtgctgctgagcaagctggacagcgacaatgatgatgctgtgcggggcctgggcatgaacaacctgcccagcaactacacagccaggatgaacctgacccagatcctggagcccagcaccgtcttccccagcgccaacccccagaacatgattgacagcagcacctctgtgtatgagttccagacccccagctacctgaccaagagcaacagcacaggccagatcaacttcagccctggggacaaccaggcccagagcgagatcggggagcagcagctggacttcaacagcacagtgaaggacctgctgagcggggacagcctgcagaccaaccagcagctggtgggccagggcgccagtgacctgaccaacacagccagtgacttcagcagtgacatccggctgagcagcgagctgagcggcagcatcaatgacctgaacaccctggaccccaacctgctgtttgatcctggccggcagcagggccaggatgatgaggccaccctggaggagctgaagaatgaccccctcttccagcagatctgcagcgagagcatgaacagcatgaccagcagcggctttgagtggattgagagcaaggaccaccccaccgtggagatgctgggctag

SEQ ID NO: 167534 - DNA, 783 bp, Artificial Sequence
  Description of Artificial Sequence: Synthetic coding sequence
atggagctgacccagcctgctgaggacctgatccagacccagcagaccccagccagcgagctgggggaccctgaagatcctggagaggaggccgcagatggcagtgacacagtggtgctgagcctcttcccctgcaccccagagcctgtgaaccctgagccagatgcctctgtgagcagcccccaggccggcagcagcctgaagcacagcaccaccctgaccaaccggcagagaggaaatgaggtgtctgccctgcctgccaccctggacagcctgagcatccaccagctggccgcccagggcgagctggaccagctgaaggagcacctgaggaagggggacaacctggtgaacaagccagatgagcggggcttcacccccctcatctgggccagcgccttcggggagattgaaacagtgcgcttcctgctggagtggggcgctgacccccacatcctggccaaggagcgggagagcgccctgagcctggccagcactggaggctacacagacatcgtgggcctgctgctggagagagatgtggacatcaacatctatgactggaatggaggcacccccctgctgtatgctgtgcggggcaaccacgtgaagtgtgtggaggccctgctggcccggggagctgacctgaccacagaggccgacagcggctacacccccatggacctggccgtggccctgggctacaggaaggtgcagcaggtgattgagaaccacatcctgaagctgttccagagcaacctggtgcctgctgaccctgagtag

SEQ ID NO: 167535 - DNA, 714 bp, Artificial Sequence
  Description of Artificial Sequence: Synthetic coding sequence
atggagctgacccagcctgctgaggacctgatccagacccagcagaccccagccagcgagctgggggaccctgaagatcctggagaggaggccgcagatggcagtgacacagtggtgctgagcctcttcccctgcaccccagagcctgtgaaccctgagccagatgcctctgtgagcagcccccagggcagcagcctgaagcacagcaccaccctgaccaaccggcagagaggaaatgaggtgtctgccctgcctgccaccctggactgtgacaacctggtgaacaagccagatgagcggggcttcacccccctcatctgggccagcgcctttggagaaattgagaccgtgcgcttcctgctggagtggggcgctgacccccacatcctggccaaggagcgggagagcgccctgagcctggccagcactggaggctacacagacatcgtgggcctgctgctggagagagatgtggacatcaacatctatgactggaatggaggcacccccctgctgtatgctgtgcggggcaaccacgtgaagtgtgtggaggccctgctggcccggggagctgacctgaccacagaagctgacagcggctacacccccatggacctggccgtggccctgggctacaggaaggtgcagcaggtgattgagaaccacatcctgaagctgttccagagcaacctggtgcctgctgaccctgagtag

SEQ ID NO: 167536 - DNA, 192 bp, Artificial Sequence
  Description of Artificial Sequence: Synthetic coding sequence
atggagctgacccagcctgctgaggacctgatccagacccagcagaccccagccagcgagctgggggaccctgaagatcctggagaggaggccgcagatggcagtgacacagtggtgctgagcctcttcccctgcaccccagagcctgtgaaccctgagccagatgcctctgtgagcagcccccaggcctag

SEQ ID NO: 167537 - DNA, 717 bp, Artificial Sequence
  Description of Artificial Sequence: Synthetic coding sequence
atggagctgacccagcctgctgaggacctgatccagacccagcagaccccagccagcgagctgggggaccctgaagatcctggagaggaggccgcagatggcagtgacacagtggtgctgagcctcttcccctgcaccccagagcctgtgaaccctgagccagatgcctctgtgagcagcccccaggccggcagcagcctgaagcacagcaccaccctgaccaaccggcagagaggaaatgaggtgtctgccctgcctgccaccctggactgtgacaacctggtgaacaagccagatgagcggggcttcacccccctcatctgggccagcgccttcggggagattgaaacagtgcgcttcctgctggagtggggcgctgacccccacatcctggccaaggagcgggagagcgccctgagcctggccagcactggaggctacacagacatcgtgggcctgctgctggagagagatgtggacatcaacatctatgactggaatggaggcacccccctgctgtatgctgtgcggggcaaccacgtgaagtgtgtggaggccctgctggcccggggagctgacctgaccacagaggccgacagcggctacacccccatggacctggccgtggccctgggctacaggaaggtgcagcaggtgattgagaaccacatcctgaagctgttccagagcaacctggtgcctgctgaccctgagtag

SEQ ID NO: 167538 - DNA, 819 bp, Artificial Sequence
  Description of Artificial Sequence: Synthetic coding sequence
atggaggcccagggcgtggccgagggcgccggccctggggccgccagcggcgtgccccaccctgctgccctggccccagctgctgcccccaccctggccccagcctctgtggccgccgccgccagccagttcaccctgctggtgatgcagccctgtgccggccaggatgaggccgccgcccctgggggctctgtgggcgccggcaagcctgtgcgctacctgtgtgagggcgctggagatggagaggaggaggccggagaagatgaggccgacctgctggacaccagtgaccccccaggcggcggggagagcgctgccagcctggaggacctggaggatgaggagacccacagcggcggggagggcagcagcggcggggccaggagaagaggcagcggcggcggctccatgagcaagacctgcacctatgagggctgcagcgagaccaccagccaggtggccaagcagaggaagccctggatgtgcaagaagcacaggaacaagatgtacaaggacaagtacaagaagaagaagagtgaccaggccctgaactgtggcggcacagccagcactggatctgctggaaatgtgaagctggaggagagcgctgacaacatcctgagcatcgtgaagcagaggacaggcagctttggagacaggcctgcccggcccaccctgctggagcaggtgctgaaccagaagaggctgagcctgctgcggagccctgaggtggtgcagttcctgcagaagcagcagcagctgctgaaccagcaggtgctggagcagaggcagcagcagtttcctggcacctccatgtag

SEQ ID NO: 167539 - DNA, 1854 bp, Artificial Sequence
  Description of Artificial Sequence: Synthetic coding sequence
atgagcagcctgcccaccagtgatggcttcaaccacccagcccggagcagcggccagagcccagatgtgggcaaccccatgagcctggcccggtctgtgtctgcctctgtgtgccccatcaagcccagcgacagcgaccgcatcgagcccaaggctgtgaaggccctgaaggccagcgctgagttccagctgaacagcgagaagaaggagcacctgagcctgcaggacctgagtgaccacgccagcagcgctgaccacgcccccacagaccagagccctgccatgcccatgcagaacagcagcgaggagatcaccgtggccggcaacctggagaagtctgctgagaggagcacccagggcctgaagttccacctgcacacccggcaggaggccagcctgtctgtgaccagcaccaggatgcatgagccccagatgttcctgggggagaaggactggcaccctgagaaccagaacctgagccaggtgtctgacccccagcagcacgaggagcctggaaatgagcagtatgaggtggcccagcagaaggccagccatgaccaggagtacctgtgcaacattggagacctggagctgcctgaggagcggcagcagaaccagcacaagatcgtggacctggaggccaccatgaagggaaatggcctgccccagaatgtggaccccccatctgccaagaagagcatccccagcagcgagtgcagcggctgcagcaacagcgagaccttcatggagattgacacagcccagcagagcctggtgaccctgctgaacagcacaggccggcagaatgccaacgtgaagaacattggagccctggacctgaccctggacaaccccctgatggaggtggagaccagcaagtgcaaccccagcagcgagatcctgaatgacagcatcagcacccaggacctgcagcccccagagaccaacgtggagatccctggcaccaacaaggagtatggccactacagcagccccagcctgtgtggcagctgccagcccagcgtggagagcgctgaggagagctgccccagcatcacagctgccctgaaggagctgcacgagctgctggtggtgagcagcaagccagccagcgagaacaccagcgaggaggtgatctgccagagcgagaccatcgccgagggccagaccagcatcaaggacctgtctgagcgctggacccagaatgagcacctgacccagaatgagcagtgcccccaggtgtccttccaccaggccatctctgtgtctgtggagacagagaagctgaccggcaccagcagtgacaccggccgggaggccgtggagaatgtgaacttccgcagcctgggagatggcctgagcacagacaaggagggcgtgcccaagagccgggagagcatcaacaagaacagatctgtgacagtgaccagcgccaagaccagcaaccagctgcactgcaccctgggcgtggagatcagccccaagctgctggccggggaggaggatgccctgaaccagaccagcgagcagaccaagagcctgagcagcaacttcatcctggtgaaggacctgggccagggcatccagaacagcgtgacagacaggcctgagacccgggagaatgtgtgcccagatgccagccggcccctgctggagtatgagccccccaccagccaccccagcagcagccctgccatcctgcccccactcatcttccctgccacagacatcgaccgcatcctgcgggccggcttcaccctgcaggaggccctgggcgccctgcaccgggtgggcggcaatgctgacctggccctgctggtgctgctggccaagaacatcgtggtgcccacctag

SEQ ID NO: 167540 - DNA, 657 bp, Artificial Sequence
  Description of Artificial Sequence: Synthetic coding sequence
atgagcagtggagctgccagcggcaccggccggggccggccccggggcggcggccctggccctggggaccccccaccttctgagacccacaagctggtggtggtgggcggcggcggcgtgggcaagagcgccctgaccatccagttcatccagagctactttgtgtctgactatgaccccaccattgaagattcctacaccaagatctgcagcgtggatggcatcccagcccggctggacatcctggacacagctggccaggaggagtttggagccatgagggagcagtacatgagagctggccacggcttcctgctggtgtttgccatcaatgaccggcagagcttcaatgaggtgggcaagctgttcacccagatcctgcgggtgaaggacagagatgacttccctgtggtgctggtgggcaacaaggctgacctggagagccagaggcaggtgcccaggtctgaggccagcgccttcggggccagccaccacgtggcctactttgaggccagcgccaagctgcggctgaatgtggatgaggcctttgagcagctggtgcgggctgtgaggaagtaccaggagcaggagctgccccccagcccccccagcgcccccaggaagaagggcggcggctgcccctgtgtgctgctgtag

SEQ ID NO: 167541 - DNA, 615 bp, Artificial Sequence
  Description of Artificial Sequence: Synthetic coding sequence
atggctgctgctggctggagagatggcagcggccaggagaagtaccgcctggtggtggtgggcggcggcggcgtgggcaagagcgccctgaccatccagttcatccagagctactttgtgacagattatgaccccaccatcgaggacagctacaccaagcagtgtgtgattgatgacagagctgcccggctggacatcctggacacagctggccaggaggagtttggagccatgagggagcagtacatgaggactggagagggcttcctgctggtgttttctgtgacagaccggggcagctttgaggagatctacaagttccagaggcagatcctgcgggtgaaggacagagatgagttccccatgatcctgattggcaacaaggctgacctggaccaccagaggcaggtgacccaggaggagggccagcagctggcccggcagctgaaggtgacctacatggaggccagcgccaagatccgcatgaatgtggaccaggccttccacgagctggtgcgggtcatcaggaagttccaggagcaggagtgcccccccagccctgagcccaccaggaaggagaaggacaagaagggctgccactgtgtgatcttctag

SEQ ID NO: 167542 - DNA, 384 bp, Artificial Sequence
  Description of Artificial Sequence: Synthetic coding sequence
atgagggagcagtacatgaggactggagagggcttcctgctggtgttttctgtgacagaccggggcagctttgaggagatctacaagttccagaggcagatcctgcgggtgaaggacagagatgagttccccatgatcctgattggcaacaaggctgacctggaccaccagaggcaggtgacccaggaggagggccagcagctggcccggcagctgaaggtgacctacatggaggccagcgccaagatccgcatgaatgtggaccaggccttccacgagctggtgcgggtcatcaggaagttccaggagcaggagtgcccccccagccctgagcccaccaggaaggagaaggacaagaagggctgccactgcgtcatcttctag

SEQ ID NO: 167543 - DNA, 384 bp, Artificial Sequence; identical to SEQ ID NO: 167542
  Description of Artificial Sequence: Synthetic coding sequence

SEQ ID NO: 167544 - DNA, 384 bp, Artificial Sequence; identical to SEQ ID NO: 167542
  Description of Artificial Sequence: Synthetic coding sequence

SEQ ID NO: 167545 - DNA, 210 bp, Artificial Sequence
  Description of Artificial Sequence: Synthetic coding sequence
atgagggagcagtacatgaggactggagagggcttcctgctggtgttttctgtgacagaccggggcagctttgaggagatctacaagttccagaggcagatcctgcgggtgaaggacagagatgagttccccatgatcctgattggcaacaaggctgacctggaccaccagaggcaggtgacccaggaggagggccagcagctggcctag

SEQ ID NO: 167546 - DNA, 384 bp, Artificial Sequence; identical to SEQ ID NO: 167542
  Description of Artificial Sequence: Synthetic coding sequence

SEQ ID NO: 167547 - DNA, 384 bp, Artificial Sequence; identical to SEQ ID NO: 167542
  Description of Artificial Sequence: Synthetic coding sequence

SEQ ID NO: 167548 - DNA, 510 bp, Artificial Sequence
  Description of Artificial Sequence: Synthetic coding sequence
atgagctactttgtgacagattatgaccccaccattgaagattcctacaccaagcagtgtgtgattgatgaccgggccgcccggctggacatcctggacacagctggccaggaggagtttggagccatgagggagcagtacatgaggactggagagggcttcctgctggtgttttctgtgacagaccggggcagctttgaggagatctacaagttccagaggcagatcctgcgggtgaaggacagagatgagttccccatgatcctgattggcaacaaggctgacctggaccaccagaggcaggtgacccaggaggagggccagcagctggcccggcagctgaaggtgacctacatggaggccagcgccaagatccgcatgaatgtggaccaggccttccacgagctggtgcgggtcatcaggaagttccaggagcaggagtgcccccccagccctgagcccaccaggaaggagaaggacaagaagggctgccactgcgtcatcttctag

SEQ ID NO: 167549 - DNA, 633 bp, Artificial Sequence
  Description of Artificial Sequence: Synthetic coding sequence
atggctgctgctggctggagagatggcagcggccaggagaagtaccgcctggtggtggtgggcggcggcggcgtgggcaagagcgccctgaccatccagttcatccagttcttcctgttcctgcagagctactttgtgacagattatgaccccaccatcgaggacagctacaccaagcagtgtgtgattgatgacagagctgcccggctggacatcctggacacagctggccaggaggagtttggagccatgagggagcagtacatgaggactggagagggcttcctgctggtgttttctgtgacagaccggggcagctttgaggagatctacaagttccagaggcagatcctgcgggtgaaggacagagatgagttccccatgatcctgattggcaacaaggctgacctggaccaccagaggcaggtgacccaggaggagggccagcagctggcccggcagctgaaggtgacctacatggaggccagcgccaagatccgcatgaatgtggaccaggccttccacgagctggtgcgggtcatcaggaagttccaggagcaggagtgcccccccagccctgagcccaccaggaaggagaaggacaagaagggctgccactgtgtgatcttctag

SEQ ID NO: 167550 - DNA, 633 bp, Artificial Sequence
  Description of Artificial Sequence: Synthetic coding sequence
atgggctgctgcagcagcagtgacccccggcgggaggatgacctgcgggcccgggagaagctgaagaagaccaagatcatctttgtggtgggcggccctggcagcggcaagggcacccagtgtgagaagatcgtgcagaagtatggctacacccacctgagcactggagacctgctgcggtctgaggtgagcagcggcagcgcccggggcaagaagctgtctgagatcatggagaagggccagctggtgcccctggagaccgtgctggacatgctgagagatgccatggtggccaaggtgaacaccagcaagggcttcctgattgatggctacccccgggaggtgcagcagggcgaggagtttgaaagaagaattggccagcccaccctgctgctgtatgtggatgctggccctgagaccatgacccagaggctgctgaagagaggagagaccagcggccgggtggatgacaatgaggagaccatcaagaagaggctggagacctactacaaggccacagagcctgtgattgccttctatgagaagaggggcatcgtgaggaaggtgaatgctgagggctctgtggacagcgtcttcagccaggtgtgcacccacctggatgccctgaagtag

SEQ ID NO: 167551 - DNA, 354 bp, Artificial Sequence
  Description of Artificial Sequence: Synthetic coding sequence
atgcccaggctcttcctgttccacctgctggagttctgcctgctgctgaaccagttcagcagagctgtggccgccaagtggaaggatgatgtgatcaagctgtgtggccgggagctggtgcgggcccagatcgccatctgtggcatgagcacctggagcaagaggagcctgagccaggaggatgccccccagacccccaggcctgtggccggggacttcatccagacagtgtccctgggcatcagcccagatggcggcaaggccctgaggacaggcagctgcttcacccgggagttcctgggcgccctgagcaagctgtaccaccccagcagcaccaagatccagaagctgtag

SEQ ID NO: 167552 - DNA, 429 bp, Artificial Sequence
  Description of Artificial Sequence: Synthetic coding sequence
atggcccgctacatgctgctgctgctgctggccgtgtgggtgctgaccggggagctgtggccaggagctgaggcccgggccgccccctacggcgtgcggctgtgtggccgggagttcatccgggccgtcatcttcacctgtggcggcagccgctggaggagaagtgacatcctggcccacgaggccatgggagacaccttcccagatgctgatgctgatgaggacagcctggccggggagctggatgaggccatgggcagcagcgagtggctggccctgaccaagagcccccaggccttctaccggggccggcccagctggcagggcaccccaggagtgctgcggggcagcagagatgtgctggccggcctgagcagcagctgctgcaagtggggctgcagcaagtctgagatcagcagcctgtgctag

SEQ ID NO: 167553 - DNA, 1293 bp, Artificial Sequence
  Description of Artificial Sequence: Synthetic coding sequence
atgaagcccagcctgctgtgccggcccctgagctgcttcctgatgctgctgccctggcccctggccaccctgaccagcaccaccctgtggcagtgccccccaggagaggagccagacctggaccccggccagggcaccctgtgccggccctgccccccaggcaccttctctgctgcctggggcagcagcccctgccagccccacgcccgctgcagcctgtggaggcggctggaggcccaggtgggcatggccacccgggacaccctgtgtggggactgctggccaggctggtttggcccctggggcgtgccccgggtgccctgccagccctgctcctgggcccccctgggcacccacggctgtgatgagtggggccggcgggccaggagaggagtggaggtggccgccggggccagcagcggcggggagacccggcagcctggaaatggcaccagggctgggggccctgaggagacagctgcccagtatgctgtgattgccatcgtgcctgtgttctgcctgatgggcctgctgggcatcctggtgtgcaacctgctgaagaggaagggctaccactgcacagcccacaaggaggtgggccctggccctgggggcggcggcagcggcatcaacccagcctacagaacagaagatgccaatgaagacaccatcggcgtgctggtgcggctcatcacagagaagaaggaaaatgctgctgccctggaggagctgctgaaggagtaccacagcaagcagctggtgcagaccagccacaggcctgtgtccaagctgcccccagccccacccaacgtgccccacatctgcccccaccgccaccacctgcacacagtgcagggcctggccagcctgagcggcccctgctgcagccgctgcagccagaagaagtggccagaggtgctgctgagccctgaggccgtggccgccaccacccctgtgcccagcctgctgcccaaccccaccagggtgcccaaggccggggccaaggccggccggcagggcgagatcaccatcctgtctgtgggccgcttccgggtggcccgcatccctgagcagaggaccagctccatggtgtctgaggtgaagaccatcacagaagctggccccagctggggagacctgcctgacagcccccagcccggcctgcccccagagcagcaggccctgctgggcagcggcggcagcaggaccaagtggctgaagcccccagctgagaacaaggccgaggagaacagatatgtggtgcggctgtctgagagcaacctggtgatctag

SEQ ID NO: 167554 - DNA, 1293 bp, Artificial Sequence; identical to SEQ ID NO: 167553
  Description of Artificial Sequence: Synthetic coding sequence

SEQ ID NO: 167555 - DNA, 897 bp, Artificial Sequence
  Description of Artificial Sequence: Synthetic coding sequence
atgcaccctggctgctgggtgcaggaggccctggtgctgaaccatgaaggagacatgggcttcagcgagcccggcagccacatctgccgggccctgggcggcctgagccccaagtgcacctgcagcggccccctgcggcggcccggcctgcccagcgctggccgctcctggttcagcagcggcgtgcggctgccccccagccctggcagcggccccttcagcagccctggcatcaacccagcctacagaacagaagatgccaatgaagacaccatcggcgtgctggtgcggctcatcacagagaagaaggaaaatgctgctgccctggaggagctgctgaaggagtaccacagcaagcagctggtgcagaccagccacaggcctgtgtccaagctgcccccagccccacccaacgtgccccacatctgcccccaccgccaccacctgcacacagtgcagggcctggccagcctgagcggcccctgctgcagccgctgcagccagaagaagtggccagaggtgctgctgagccctgaggccgtggccgccaccacccctgtgcccagcctgctgcccaaccccaccagggtgcccaaggccggggccaaggccggccggcagggcgagatcaccatcctgtctgtgggccgcttccgggtggcccgcatccctgagcagaggaccagctccatggtgtctgaggtgaagaccatcacagaagctggccccagctggggagacctgcctgacagcccccagcccggcctgcccccagagcagcaggccctgctgggcagcggcggcagcaggaccaagtggctgaagcccccagctgagaacaaggccgaggagaacagatatgtggtgcggctgtctgagagcaacctggtgatctag

SEQ ID NO: 167556 - DNA, 306 bp, Artificial Sequence
  Description of Artificial Sequence: Synthetic coding sequence
atgaagcccagcctgctgtgccggcccctgagctgcttcctgatgctgctgccctggcccctggccaccctgaccagcaccaccctgtggcagtgccccccaggagaggagccagacctggaccccggccagggcaccctgtgccggccctgccccccaggcaccttctctgctgcctggggcagcagcccctgccagccccacgcccgctgcagcctgtggaggcggctggaggcccaggtgggcatggccacccgggacaccctgtgtggggactgctggccaggctggtttggcccctggtag

SEQ ID NO: 167557 - DNA, 4326 bp, Artificial Sequence
  Description of Artificial Sequence: Synthetic coding sequence
atggccacagctgctgctgctgctgctgtgatggcccctcctggctgccccggcagctgccccaactttgctgtggtgtgcagcttcctggagagatatggccccctgctggacctgcctgagctgcccttccctgagctggagcgggtgctgcaggcccctcctccagatgtgggcaatggagaggtgcccaaggagctggtggagctgcacctgaagctgatgaggaagattggcaagtctgtgacagctgaccgctgggagaagtacctgatcaagatctgccaggagttcaacagcacctgggcctgggagatggagaagaagggctacctggagatgtctgtggagtgcaagctggccctgctgaagtacctgtgtgagtgccagtttgatgacaacctgaagttcaagaacatcatcaatgaggaggatgctgacaccatgaggctgcagcccatcggccgggacaaggatggcctgatgtactggtaccagctggaccaggaccacaacgtgaggatgtacatcgaggagcaggatgaccaggacggcagctcctggaagtgcatcgtgaggaacagaaatgagctggccgagaccctggccctgctgaaggcccagattgatcctgtgctgctgaagaacagcagccagcaggacaacagcagccgggagagccccagcctggaggatgaggagaccaagaaggaggaggagacccccaagcaggaggagcagaaggagagcgagaagatgaagtctgaggagcagcccatggacctggagaacagaagcacagccaacgtgctggaggagaccaccgtgaagaaggagaaggaggatgagaaggagctggtgaagctgcccgtcatcgtgaagctggagaagcccctgcctgaaaatgaggagaagaagatcatcaaggaggagagtgacagcttcaaggaaaatgtgaagcccatcaaggtggaggtgaaggagtgcagagctgaccccaaggacaccaagagctccatggagaagcctgtggcccaggagcctgagagaattgaatttggaggcaacatcaagagcagccatgagatcacagagaagagcacagaggagacagagaagctgaagaatgaccagcaggccaagatccccctgaagaagcgggagatcaagctgagtgatgactttgacagccctgtgaagggccccctgtgcaagtctgtgacccccaccaaggagttcctgaaggatgagatcaagcaggaggaggagacctgcaagaggatcagcaccatcacagccctgggccacgagggcaagcagctggtgaatggagaggtgtctgatgagcgggtggcccccaacttcaagacagagcccatcgagaccaagttctatgagaccaaggaggagagctacagccccagcaaggacaggaacatcatcacagagggcaatggaacagagagcctgaacagcgtcatcacctccatgaagacaggagagctggagaaggagacagcccccctgaggaaggatgctgacagcagcatctctgtgctggagatccacagccagaaggcccagatcgaggagccagaccccccagagatggagaccagcctggacagcagcgagatggccaaggacctgagcagcaagacagccctgagcagcacagagagctgcaccatgaagggggaggagaagagccccaagaccaagaaggacaagaggcctcccatcctggagtgcctggagaagctggagaagagcaagaagaccttcctggacaaggatgcccagaggctgagccccatccctgaggaggtgcccaagagcaccctggagagcgagaagccaggcagccctgaggccgctgagaccagcccccccagcaacatcatcgaccactgtgagaagctggccagcgagaaggaggtggtggagtgccagagcaccagcacagtgggcggccagagcgtgaagaaggtggacctggagaccctgaaggaggacagcgagttcaccaaggtggagatggacaacctggacaatgcccagaccagcggcatcgaggagcccagcgagaccaagggctccatgcagaagagcaagttcaagtacaagctggtgcctgaggaggagaccacagccagcgagaacacagagatcaccagcgagcggcagaaggagggcatcaagctgaccatccgcatcagcagcaggaagaagaagccagacagcccccccaaggtgctggagcctgagaacaagcaggagaagacagagaaggaggaggagaagaccaacgtgggccgcaccctgcggcgcagcccccgcatcagccggcccacagccaaggtggccgagatccgggaccagaaggctgacaagaagagaggagagggggaggatgaggtggaggaggagagcacagccctgcagaagacagacaagaaggagatcctgaagaagtctgagaaggacaccaacagcaaggtgtccaaggtgaagcccaagggcaaggtgcgctggacaggcagcaggacccggggccgctggaagtacagcagcaatgatgagagcgagggcagcggcagcgagaagagcagcgctgccagcgaggaggaggaggagaaggagagcgaggaggccatcctggctgatgatgatgagccctgcaagaagtgtggcctgcccaaccaccctgagctgatcctgctgtgtgacagctgtgacagcggctaccacacagcctgcctgcggccccccctgatgatcatcccagatggagagtggttctgccccccctgccagcacaagctgctgtgtgagaagctggaggagcagctgcaggacctggatgtggccctgaagaagaaggagcgggcagagaggaggaaggagcggctggtgtatgtgggcatcagcattgagaacatcatccccccccaggagccagacttcagcgaggaccaggaggagaagaagaaggacagcaagaagagcaaggccaacctgctggagcggcgcagcaccaggaccaggaagtgcatctcctacagatttgatgaatttgatgaggccattgatgaggccattgaagatgacatcaaggaggctgatggcggcggcgtgggccggggcaaggacatcagcaccatcaccggccaccggggcaaggacatcagcaccatcctggatgaggagaggaaagaaaacaagaggccccagagagctgctgctgcccggaggaagaagagaagaaggctgaatgacctggacagcgacagcaacctggatgaggaggagagtgaagatgagttcaagatcagtgatggcagccaggatgaatttgtggtgtctgatgagaacccagatgaaagtgaagaagatcctcccagcaatgatgacagcgacacagacttctgcagccggcggctgcggcggcaccccagccggcccatgaggcagagccggcggctgcggaggaagacccccaagaagaagtacagtgatgatgatgaggaggaggagagcgaggagaacagccgggacagcgagagtgacttcagtgatgacttcagtgatgactttgtggagaccaggagaagaagaagcagaagaaaccagaagaggcagatcaactacaaggaggacagcgagagtgatggcagccagaagagcctgcggcggggcaaggagatcagaagagtgcacaagaggcggctgagcagcagcgagagcgaggagagctacctgagcaagaacagtgaagatgatgagctggccaaggagagcaagaggtctgtgaggaagaggggccgcagcacagatgagtacagcgaggctgatgaggaggaggaggaggaggagggcaagcccagcaggaagaggctgcacagaattgaaacagatgaggaggagagctgtgacaatgcccatggagatgccaaccagcctgcccgggacagccagccccgggtgctgcccagcgagcaggagagcaccaagaagccctacagaattgaaagtgatgaggaggaggactttgaaaatgtgggcaaggtgggcagccccctggactacagcctggtggacctgcccagcaccaacggccagagccctgggaaggccattgaaaatctcatcggcaagcccacagagaagagccagacccccaaggacaacagcacagccagcgccagcctggccagcaatggcaccagcggcggccaggaggccggggcccctgaggaggaggaggatgagctgctgcgggtgacagacctggtggactatgtgtgcaacagcgagcagctgtag

SEQ ID NO: 167558 - DNA, 4233 bp, Artificial Sequence
  Description of Artificial Sequence: Synthetic coding sequence
atggccacagctgctgctgctgctgctgtgatggcccctcctggctgccccggcagctgccccaactttgctgtggtgtgcagcttcctggagagatatggccccctgctggacctgcctgagctgcccttccctgagctggagcgggtgctgcaggcccctcctccagatgtgggcaatggagaggtgcccaaggagctggtggagctgcacctgaagctgatgaggaagattggcaagtctgtgacagctgaccgctgggagaagtacctgatcaagtacctgtgtgagtgccagtttgatgacaacctgaagttcaagaacatcatcaatgaagaagatgctgacaccatgaggctgcagcccatcggccgggacaaggatggcctgatgtactggtaccagctggaccaggaccacaacgtgaggatgtacatcgaggagcaggatgaccaggacggcagctcctggaagtgcatcgtgaggaacagaaatgagctggccgagaccctggccctgctgaaggcccagattgatcctgtgctgctgaagaacagcagccagcaggacaacagcagccgggagagccccagcctggaggatgaggagaccaagaaggaggaggagacccccaagcaggaggagcagaaggagagcgagaagatgaagtctgaggagcagcccatggacctggagaacagaagcacagccaacgtgctggaggagaccaccgtgaagaaggagaaggaggatgagaaggagctggtgaagctgcctgtgattgtgaagctggagaagcccctgcctgaaaatgaggagaagaagatcatcaaggaggagagtgacagcttcaaggaaaatgtgaagcccatcaaggtggaggtgaaggaatgtagagctgaccccaaggacaccaagagctccatggagaagcctgtggcccaggagcctgagcgcatcgagtttggaggcaacatcaagagcagccatgagatcacagagaagagcacagaggagacagagaagctgaagaatgaccagcaggccaagatccccctgaagaagcgggagatcaagctgagtgatgactttgacagccctgtgaagggccccctgtgcaagtctgtgacccccaccaaggagttcctgaaggatgagatcaagcaggaggaggagacctgcaagaggatcagcaccatcacagccctgggccacgagggcaagcagctggtgaatggagaggtgtctgatgagcgggtggcccccaacttcaagacagagcccatcgagaccaagttctatgagaccaaggaggagagctacagccccagcaaggacaggaacatcatcacagagggcaatggaacagagagcctgaacagcgtcatcacctccatgaagacaggagagctggagaaggagacagcccccctgaggaaggatgctgacagcagcatctctgtgctggagatccacagccagaaggcccagatcgaggagccagaccccccagagatggagaccagcctggacagcagcgagatggccaaggacctgagcagcaagacagccctgagcagcacagagagctgcaccatgaagggggaggagaagagccccaagaccaagaaggacaagaggcctcccatcctggagtgcctggagaagctggagaagagcaagaagaccttcctggacaaggatgcccagaggctgagccccatccctgaggaggtgcccaagagcaccctggagagcgagaagccaggcagccctgaggccgctgagaccagcccccccagcaacatcatcgaccactgtgagaagctggccagcgagaaggaggtggtggagtgccagagcaccagcacagtgggcggccagagcgtgaagaaggtggacctggagaccctgaaggaggacagcgagttcaccaaggtggagatggacaacctggacaatgcccagaccagcggcatcgaggagcccagcgagaccaagggctccatgcagaagagcaagttcaagtacaagctggtgcctgaggaggagaccacagcctctgaaaatacagagatcaccagcgagcggcagaaggagggcatcaagctgaccatccgcatcagcagcaggaagaagaagccagacagcccccccaaggtgctggagcctgagaacaagcaggagaagacagagaaggaggaggagaagaccaacgtgggccgcaccctgcggcgcagcccccgcatcagccggcccacagccaaggtggccgagatccgggaccagaaggctgacaagaagagaggagaaggagaagatgaggtggaggaggagagcacagccctgcagaagacagacaagaaggagatcctgaagaagtctgagaaggacaccaacagcaaggtgtccaaggtgaagcccaagggcaaggtgcgctggacaggcagcaggacccggggccgctggaagtacagcagcaatgatgaaagtgagggcagcggcagcgagaagagcagcgctgccagcgaggaggaggaggagaaggagagcgaggaggccatcctggctgatgatgatgagccctgcaagaagtgtggcctgcccaaccaccctgagctgatcctgctgtgtgacagctgtgacagcggctaccacacagcctgcctgcggccccccctgatgatcatcccagatggagagtggttctgccccccctgccagcacaagctgctgtgtgagaagctggaggagcagctgcaggacctggatgtggccctgaagaagaaggagagagctgagaggaggaaggagcggctggtgtatgtgggcatcagcattgagaacatcatccccccccaggagccagacttcagcgaggaccaggaggagaagaagaaggacagcaagaagagcaaggccaacctgctggagaggaggagcaccaggaccaggaagtgcatctcctacagatttgatgaatttgatgaggccattgatgaggccattgaagatgacatcaaggaggctgatggcggcggcgtgggccggggcaaggacatcagcaccatcaccggccaccggggcaaggacatcagcaccatcctggatgaggagaggaaggagaacaagaggccccagagagctgctgctgcccggaggaagaagagaagaaggctgaatgacctggacagcgacagcaacctggatgaggaggagagtgaagatgagttcaagatcagtgatggcagccaggatgaatttgtggtgtctgatgaaaatccagatgagagcgaggaggacccccccagcaatgatgacagcgacacagacttctgcagccggcggctgcggcggcaccccagccggcccatgaggcagagccggcggctgcggaggaagacccccaagaagaagtacagtgatgatgatgaggaggaggagagcgaggagaacagccgggacagcgagagtgacttcagtgatgacttcagtgatgactttgtggagaccaggagaagaagaagcagaagaaaccagaagaggcagatcaactacaaggaggacagcgagagtgatggcagccagaagagcctgcggcggggcaaggagatccggcgggtgcacaagaggcggctgagcagcagcgagagcgaggagagctacctgagcaagaacagtgaagatgatgagctggccaaggagagcaagaggtctgtgaggaagaggggccgcagcacagatgagtacagcgaggctgatgaggaggaggaggaggaggagggcaagcccagcaggaagaggctgcaccgcatcgagacagatgaggaggagagctgtgacaatgcccatggagatgccaaccagcctgcccgggacagccagccccgggtgctgcccagcgagcaggagagcaccaagaagccctaccgcatcgagagtgatgaggaggaggactttgaaaatgtgggcaaggtgggcagccccctggactacagcctggtggacctgcccagcaccaacggccagagccctgggaaggccatcgagaacctgattggcaagcccacagagaagagccagacccccaaggacaacagcacagccagcgccagcctggccagcaatggcaccagcggcggccaggaggccggggcccctgaggaggaggaggatgagctgctgcgggtgacagacctggtggactatgtgtgcaacagcgagcagctgtag

SEQ ID NO: 167559 - DNA, 3570 bp, Artificial Sequence
  Description of Artificial Sequence: Synthetic coding sequence
atgaagtctgaggagcagcccatggacctggagaacagaagcacagccaacgtgctggaggagaccaccgtgaagaaggagaaggaggatgagaaggagctggtgaagctgcccgtcatcgtgaagctggagaagcccctgcctgaaaatgaggagaagaagatcatcaaggaggagagtgacagcttcaaggaaaatgtgaagcccatcaaggtggaggtgaaggagtgcagagctgaccccaaggacaccaagagctccatggagaagcctgtggcccaggagcctgagagaattgaatttggaggcaacatcaagagcagccatgagatcacagagaagagcacagaggagacagagaagctgaagaatgaccagcaggccaagatccccctgaagaagcgggagatcaagctgagtgatgactttgacagccctgtgaagggccccctgtgcaagtctgtgacccccaccaaggagttcctgaaggatgagatcaagcaggaggaggagacctgcaagaggatcagcaccatcacagccctgggccacgagggcaagcagctggtgaatggagaggtgtctgatgagcgggtggcccccaacttcaagacagagcccatcgagaccaagttctatgagaccaaggaggagagctacagccccagcaaggacaggaacatcatcacagagggcaatggaacagagagcctgaacagcgtcatcacctccatgaagacaggagagctggagaaggagacagcccccctgaggaaggatgctgacagcagcatctctgtgctggagatccacagccagaaggcccagatcgaggagccagaccccccagagatggagaccagcctggacagcagcgagatggccaaggacctgagcagcaagacagccctgagcagcacagagagctgcaccatgaagggggaggagaagagccccaagaccaagaaggacaagaggcctcccatcctggagtgcctggagaagctggagaagagcaagaagaccttcctggacaaggatgcccagaggctgagccccatccctgaggaggtgcccaagagcaccctggagagcgagaagccaggcagccctgaggccgctgagaccagcccccccagcaacatcatcgaccactgtgagaagctggccagcgagaaggaggtggtggagtgccagagcaccagcacagtgggcggccagagcgtgaagaaggtggacctggagaccctgaaggaggacagcgagttcaccaaggtggagatggacaacctggacaatgcccagaccagcggcatcgaggagcccagcgagaccaagggctccatgcagaagagcaagttcaagtacaagctggtgcctgaggaggagaccacagccagcgagaacacagagatcaccagcgagcggcagaaggagggcatcaagctgaccatccgcatcagcagcaggaagaagaagccagacagcccccccaaggtgctggagcctgagaacaagcaggagaagacagagaaggaggaggagaagaccaacgtgggccgcaccctgcggcgcagcccccgcatcagccggcccacagccaaggtggccgagatccgggaccagaaggctgacaagaagagaggagagggggaggatgaggtggaggaggagagcacagccctgcagaagacagacaagaaggagatcctgaagaagtctgagaaggacaccaacagcaaggtgtccaaggtgaagcccaagggcaaggtgcgctggacaggcagcaggacccggggccgctggaagtacagcagcaatgatgagagcgagggcagcggcagcgagaagagcagcgctgccagcgaggaggaggaggagaaggagagcgaggaggccatcctggctgatgatgatgagccctgcaagaagtgtggcctgcccaaccaccctgagctgatcctgctgtgtgacagctgtgacagcggctaccacacagcctgcctgcggccccccctgatgatcatcccagatggagagtggttctgccccccctgccagcacaagctgctgtgtgagaagctggaggagcagctgcaggacctggatgtggccctgaagaagaaggagcgggcagagaggaggaaggagcggctggtgtatgtgggcatcagcattgagaacatcatccccccccaggagccagacttcagcgaggaccaggaggagaagaagaaggacagcaagaagagcaaggccaacctgctggagcggcgcagcaccaggaccaggaagtgcatctcctacagatttgatgaatttgatgaggccattgatgaggccattgaagatgacatcaaggaggctgatggcggcggcgtgggccggggcaaggacatcagcaccatcaccggccaccggggcaaggacatcagcaccatcctggatgaggagaggaaagaaaacaagaggccccagagagctgctgctgcccggaggaagaagagaagaaggctgaatgacctggacagcgacagcaacctggatgaggaggagagtgaagatgagttcaagatcagtgatggcagccaggatgaatttgtggtgtctgatgagaacccagatgaaagtgaagaagatcctcccagcaatgatgacagcgacacagacttctgcagccggcggctgcggcggcaccccagccggcccatgaggcagagccggcggctgcggaggaagacccccaagaagaagtacagtgatgatgatgaggaggaggagagcgaggagaacagccgggacagcgagagtgacttcagtgatgacttcagtgatgactttgtggagaccaggagaagaagaagcagaagaaaccagaagaggcagatcaactacaaggaggacagcgagagtgatggcagccagaagagcctgcggcggggcaaggagatcagaagagtgcacaagaggcggctgagcagcagcgagagcgaggagagctacctgagcaagaacagtgaagatgatgagctggccaaggagagcaagaggtctgtgaggaagaggggccgcagcacagatgagtacagcgaggctgatgaggaggaggaggaggaggagggcaagcccagcaggaagaggctgcacagaattgaaacagatgaggaggagagctgtgacaatgcccatggagatgccaaccagcctgcccgggacagccagccccgggtgctgcccagcgagcaggagagcaccaagaagccctacagaattgaaagtgatgaggaggaggactttgaaaatgtgggcaaggtgggcagccccctggactacagcctggtggacctgcccagcaccaacggccagagccctgggaaggccattgaaaatctcatcggcaagcccacagagaagagccagacccccaaggacaacagcacagccagcgccagcctggccagcaatggcaccagcggcggccaggaggccggggcccctgaggaggaggaggatgagctgctgcgggtgacagacctggtggactatgtgtgcaacagcgagcagctgtag

SEQ ID NO: 167560 - DNA, 2412 bp, Artificial Sequence
  Description of Artificial Sequence: Synthetic coding sequence
gagaccctggccctgctgaaggcccagattgatcctgtgctgctgaagaacagcagccagcaggacaacagcagccgggagagccccagcctggaggatgaggagaccaagaaggaggaggagacccccaagcaggaggagcagaaggagagcgagaagatgaagtctgaggagcagcccatggacctggagaacagaagcacagccaacgtgctggaggagaccaccgtgaagaaggagaaggaggatgagaaggagctggtgaagctgcctgtgattgtgaagctggagaagcccctgcctgaaaatgaggagaagaagatcatcaaggaggagagtgacagcttcaaggaaaatgtgaagcccatcaaggtggaggtgaaggaatgtagagctgaccccaaggacaccaagagctccatggagaagcctgtggcccaggagcctgagcgcatcgagtttggaggcaacatcaagagcagccatgagatcacagagaagagcacagaggagacagagaagctgaagaatgaccagcaggccaagatccccctgaagaagcgggagatcaagctgagtgatgactttgacagccctgtgaagggccccctgtgcaagtctgtgacccccaccaaggagttcctgaaggatgagatcaagcaggaggaggagacctgcaagaggatcagcaccatcacagccctgggccacgagggcaagcagctggtgaatggagaggtgtctgatgagcgggtggcccccaacttcaagacagagcccatcgagaccaagttctatgagaccaaggaggagagctacagccccagcaaggacaggaacatcatcacagagggcaatggaacagagagcctgaacagcgtcatcacctccatgaagacaggagagctggagaaggagacagcccccctgaggaaggatgctgacagcagcatctctgtgctggagatccacagccagaaggcccagatcgaggagccagaccccccagagatggagaccagcctggacagcagcgagatggccaaggacctgagcagcaagacagccctgagcagcacagagagctgcaccatgaagggggaggagaagagccccaagaccaagaaggacaagaggcctcccatcctggagtgcctggagaagctggagaagagcaagaagaccttcctggacaaggatgcccagaggctgagccccatccctgaggaggtgcccaagagcaccctggagagcgagaagccaggcagccctgaggccgctgagaccagcccccccagcaacatcatcgaccactgtgagaagctggccagcgagaaggaggtggtggagtgccagagcaccagcacagtgggcggccagagcgtgaagaaggtggacctggagaccctgaaggaggacagcgagttcaccaaggtggagatggacaacctggacaatgcccagaccagcggcatcgaggagcccagcgagaccaagggctccatgcagaagagcaagttcaagtacaagctggtgcctgaggaggagaccacagcctctgaaaatacagagatcaccagcgagcggcagaaggagggcatcaagctgaccatccgcatcagcagcaggaagaagaagccagacagcccccccaaggtgctggagcctgagaacaagcaggagaagacagagaaggaggaggagaagaccaacgtgggccgcaccctgcggcgcagcccccgcatcagccggcccacagccaaggtggccgagatccgggaccagaaggctgacaagaagagaggagaaggagaagatgaggtggaggaggagagcacagccctgcagaagacagacaagaaggagatcctgaagaagtctgagaaggacaccaacagcaaggtgtccaaggtgaagcccaagggcaaggtgcgctggacaggcagcaggacccggggccgctggaagtacagcagcaatgatgaaagtgagggcagcggcagcgagaagagcagcgctgccagcgaggaggaggaggagaaggagagcgaggaggccatcctggctgatgatgatgagccctgcaagaagtgtggcctgcccaaccaccctgagctgatcctgctgtgtgacagctgtgacagcggctaccacacagcctgcctgcggccccccctgatgatcatcccagatggagagtggttctgccccccctgccagcacaagctgctgtgtgagaagctggaggagcagctgcaggacctggatgtggccctgaagaagaaggagagagctgagaggaggaaggagcggctggtgtatgtgggcatcagcattgagaacatcatccccccccaggagccagacttcagcgaggaccaggaggagaagaagaaggacagcaagaagtag

SEQ ID NO: 167561 - DNA, 2109 bp, Artificial Sequence
  Description of Artificial Sequence: Synthetic coding sequence
gccacagctgctgctgctgctgctgtgatggcccctcctggctgccccggcagctgccccaactttgctgtggtgtgcagcttcctggagagatatggccccctgctggacctgcctgagctgcccttccctgagctggagcgggtgctgcaggcccctcctccagatgtgggcaatggagaggtgcccaaggagctggtggagctgcacctgaagctgatgaggaagattggcaagtctgtgacagctgaccgctgggagaagtacctgatcaagatctgccaggagttcaacagcacctgggcctgggagatggagaagaagggctacctggagatgtctgtggagtgcaagctggccctgctgaagtacctgtgtgagtgccagtttgatgacaacctgaagttcaagaacatcatcaatgaagaagatgctgacaccatgaggctgcagcccatcggccgggacaaggatggcctgatgtactggtaccagctggaccaggaccacaacgtgaggatgtacatcgaggagcaggatgaccaggacggcagctcctggaagtgcatcgtgaggaacagaaatgagctggccgagaccctggccctgctgaaggcccagattgatcctgtgctgctgaagaacagcagccagcaggacaacagcagccgggagagccccagcctggaggatgaggagaccaagaaggaggaggagacccccaagcaggaggagcagaaggagagcgagaagatgaagtctgaggagcagcccatggacctggagaacagaagcacagccaacgtgctggaggagaccaccgtgaagaaggagaaggaggatgagaaggagctggtgaagctgcctgtgattgtgaagctggagaagcccctgcctgaaaatgaggagaagaagatcatcaaggaggagagtgacagcttcaaggaaaatgtgaagcccatcaaggtggaggtgaaggaatgtagagctgaccccaaggacaccaagagctccatggagaagcctgtggcccaggagcctgagcgcatcgagtttggaggcaacatcaagagcagccatgagatcacagagaagagcacagaggagacagagaagctgaagaatgaccagcaggccaagatccccctgaagaagcgggagatcaagctgagtgatgactttgacagccctgtgaagggccccctgtgcaagtctgtgacccccaccaaggagttcctgaaggatgagatcaagcaggaggaggagacctgcaagaggatcagcaccatcacagccctgggccacgagggcaagcagctggtgaatggagaggtgtctgatgagcgggtggcccccaacttcaagacagagcccatcgagaccaagttctatgagaccaaggaggagagctacagccccagcaaggacaggaacatcatcacagagggcaatggaacagagagcctgaacagcgtcatcacctccatgaagacaggagagctggagaaggagacagcccccctgaggaaggatgctgacagcagcatctctgtgctggagatccacagccagaaggcccagatcgaggagccagaccccccagagatggagaccagcctggacagcagcgagatggccaaggacctgagcagcaagacagccctgagcagcacagagagctgcaccatgaagggggaggagaagagccccaagaccaagaaggacaagaggcctcccatcctggagtgcctggagaagctggagaagagcaagaagaccttcctggacaaggatgcccagaggctgagccccatccctgaggaggtgcccaagagcaccctggagagcgagaagccaggcagccctgaggccgctgagaccagcccccccagcaacatcatcgaccactgtgagaagctggccagcgagaaggaggtggtggagtgccagagcaccagcacagtgggcggccagagcgtgaagaaggtggacctggagaccctgaaggaggacagcgagttcaccaaggtggagatggacaacctggacaatgcccagaccagcggcatcgaggagcccagcgagaccaagggctccatgcagaagtag

SEQ ID NO: 167562 - DNA, 831 bp, Artificial Sequence
  Description of Artificial Sequence: Synthetic coding sequence
gagccctgcaagaagtgtggcctgcccaaccaccctgagctgatcctgctgtgtgacagctgtgacagcggctaccacacagcctgcctgcggccccccctgatgatcatcccagatggagagtggttctgccccccctgccagcacaagctgctgtgtgagaagctggaggagcagctgcaggacctggatgtggccctgaagaagaaggagagagctgagaggaggaaggagcggctggtgtatgtgggcatcagcattgagaacatcatccccccccaggagccagacttcagcgaggaccaggaggagaagaagaaggacagcaagaagagcaaggccaacctgctggagaggaggagcaccaggaccaggaagtgcatctcctacagatttgatgaatttgatgaggccattgatgaggccattgaagatgacatcaaggaggctgatggcggcggcgtgggccggggcaaggacatcagcaccatcaccggccaccggggcaaggacatcagcaccatcctggatgaggagaggaaggagaacaagaggccccagagagctgctgctgcccggaggaagaagagaagaaggctgaatgacctggacagcgacagcaacctggatgaggaggagagtgaagatgagttcaagatcagtgatggcagccaggatgaatttgtggtgtctgatgaaaatccagatgagagcgaggaggacccccccagcaatgatgacagcgacacagacttctgcagccggcggctgcggcggcaccccagccggcccatgaggcagagccggcggctgcggaggaagaccccctag

SEQ ID NO: 167563 - DNA, 1029 bp, Artificial Sequence
  Description of Artificial Sequence: Synthetic coding sequence
atggcccaggtgctgattgtgggcgccggcatgacaggcagcctgtgtgccgccctgctgcggcggcagaccagcggccccctgtacctggccgtgtgggacaaggcagaagattctgggggccgcatgaccacagcctgcagcccccacaacccccagtgcacagctgacctgggcgcccagtacatcacctgcaccccccactacgccaagaagcaccagcgcttctatgatgagctgctggcctatggagtgctgcggcccctgagcagccccatcgagggcatggtgatgaaggagggggactgcaactttgtggccccccagggcatcagcagcatcatcaagcactacctgaaggagagcggggctgaggtgtacttccgccaccgggtgacccagatcaacctgagagatgacaagtgggaggtgtccaagcagacaggcagccctgagcagtttgacctgattgtgctgaccatgcctgtgcctgagatcctgcagctgcagggcgacatcaccaccctcatcagcgagtgccagaggcagcagctggaggccgtgtcctacagcagccgctatgccctgggcctcttctatgaggccggcaccaagattgatgtgccctgggccggccagtacatcaccagcaacccctgcatccgctttgtgtccattgacaacaagaagagaaatattgagagcagcgagatcggccccagcctggtgatccacaccaccgtgcccttcggcgtgacctacctggagcacagcattgaagatgtgcaggagctggtgttccagcagctggagaacatcctgcccggcctgccccagcccatcgccaccaagtgccagaagtggaggcacagccaggtgaccaatgctgctgccaactgccccggccagatgaccctgcaccacaagcccttcctggcctgtggaggagatggcttcacccagagcaactttgatggctgcatcaccagcgccctgtgtgtgctggaggccctgaagaactacatctag

SEQ ID NO: 167564 - DNA, 948 bp, Artificial Sequence
  Description of Artificial Sequence: Synthetic coding sequence
atggcccaggtgctgattgtgggcgccggcatgacaggcagcctgtgtgccgccctgctgcggcggcagaccagcggccccctgtacctggccgtgtgggacaaggcagaagattctgggggccgcatgaccacagcctgcagcccccacaacccccagtgcacagctgacctgggcgcccagtacatcacctgcaccccccactacgccaagaagcaccagcgcttctatgatgagctgctggcctatggagtgctgcggcccctgagcagccccatcgagggcatggtgatgaaggagggggactgcaactttgtggccccccagggcatcagcagcatcatcaagcactacctgaaggagagcggggctgaggtgtacttccgccaccgggtgacccagatcaacctgagagatgacaagtgggaggtgtccaagcagacaggcagccctgagcagtttgacctgattgtgctgaccatgcctgtgcctgagatcctgcagctgcagggcgacatcaccaccctcatcagcgagtgccagaggcagcagctggaggccgtgtcctacagcagccgctatgccctgggcctcttctatgaggccggcaccaagattgatgtgccctgggccggccagtacatcaccagcaacccctgcatccgctttgtgtccattgacaacaagaagagaaatattgagagcagcgagatcggccccagcctggtgatccacaccaccgtgcccttcggcgtgacctacctggagcacagcattgaagatgtgcaggagctggtgttccagcagctggagaacatcctgcccggcctgccccagcccatcgccaccaagtgccagaagtggaggcacagccaggtgcccagcgctggggtcatcctgggctgtgccaagagcccctggatgatggccatcggcttccccatctag

SEQ ID NO: 167565 - DNA, 699 bp, Artificial Sequence
  Description of Artificial Sequence: Synthetic coding sequence
atggcccaggtgctgattgtgggcgccggcatgacaggcagcctgtgtgccgccctgctgcggcggcagaccagcggccccctgtacctggccgtgtgggacaaggcagaagattctggagctgaggtgtacttccgccaccgggtgacccagatcaacctgagagatgacaagtgggaggtgtccaagcagacaggcagccctgagcagtttgacctgattgtgctgaccatgcctgtgcctgagatcctgcagctgcagggcgacatcaccaccctcatcagcgagtgccagaggcagcagctggaggccgtgtcctacagcagccgctatgccctgggcctcttctatgaagctggcaccaagattgatgtgccctgggccggccagtacatcaccagcaacccctgcatccgctttgtgtccattgacaacaagaagaggaacatcgagagcagcgagatcggccccagcctggtgatccacaccaccgtgccctttggagtgacctacctggagcacagcattgaagatgtgcaggagctggtgttccagcagctggagaacatcctgcccggcctgccccagcccatcgccaccaagtgccagaagtggaggcacagccaggtgcccagcgctggggtcatcctgggctgtgccaagagcccctggatgatggccatcggcttccccatctag

SEQ ID NO: 167566 - DNA, 1221 bp, Artificial Sequence
  Description of Artificial Sequence: Synthetic coding sequence
atggatggctggaggaggatgccccgctggggcctgctgctgctgctgtggggcagctgcaccttcggcctgcccacagacaccaccaccttcaagaggatcttcctgaagaggatgcccagcatccgggagagcctgaaggagcggggcgtggacatggcccggctgggccctgagtggagccagcccatgaagaggctgaccctgggcaacaccaccagcagcgtcatcctgaccaactacatggacacccagtactatggagagatcggcatcggcaccccaccccagaccttcaaggtggtgtttgacaccggcagcagcaatgtgtgggtgcccagcagcaagtgcagccggctgtacacagcctgtgtgtaccacaagctgtttgatgccagtgacagcagcagctacaagcacaatggaacagagctgaccctgcgctacagcactggaacagtgtctggcttcctgagccaggacatcatcaccgtgggcggcatcaccgtgacccagatgtttggagaggtgacagagatgcctgccctgcccttcatgctggccgagtttgatggagtggtgggcatgggcttcatcgagcaggccatcggccgggtgacccccatctttgacaacatcatcagccagggcgtgctgaaggaggatgtgttctccttctactacaacagagacagcgagaacagccagagcctgggcggccagatcgtgctgggcggcagtgacccccagcactatgagggcaacttccactacatcaacctgatcaagacaggagtgtggcagatccagatgaagggcgtgtctgtgggcagcagcaccctgctgtgtgaagatggctgcctggccctggtggacacaggagccagctacatcagcggcagcaccagcagcattgagaagctgatggaggccctgggcgccaagaagaggctgtttgattatgtggtgaagtgcaatgaaggccccaccctgcctgacatctccttccacctgggcggcaaggagtacaccctgaccagcgctgactatgtgttccaggagagctacagcagcaagaagctgtgcaccctggccatccacgccatggacatccccccacccaccggccccacctgggccctgggcgccaccttcatcaggaagttctacacagaatttgacagaagaaacaaccgcatcggctttgccctggccaggtag

SEQ ID NO: 167567 - DNA, 1212 bp, Artificial Sequence
  Description of Artificial Sequence: Synthetic coding sequence
atggatggctggaggaggatgccccgctggggcctgctgctgctgctgtggggcagctgcaccttcggcctgcccacagacaccaccaccttcaagaggatcttcctgaagaggatgcccagcatccgggagagcctgaaggagcggggcgtggacatggcccggctgggccctgagtggagccagcccatgaagaggctgaccctgggcaacaccaccagcagcgtcatcctgaccaactacatggacacccagtactatggagagatcggcatcggcaccccaccccagaccttcaaggtggtgtttgacaccggcagcagcaatgtgtgggtgcccagcagcaagtgcagccggctgtacacagcctgtgtgtaccacaagctgtttgatgccagtgacagcagcagctacaagcacaatggaacagagctgaccctgcgctacagcactggaacagtgtctggcttcctgagccaggacatcatcaccgtgggcggcatcaccgtgacccagatgtttggagaggtgacagagatgcctgccctgcccttcatgctggccgagtttgatggagtggtgggcatgggcttcatcgagcaggccatcggccgggtgacccccatctttgacaacatcatcagccagggcgtgctgaaggaggatgtgttctccttctactacaacagaaacagccagagcctgggcggccagatcgtgctgggcggcagtgacccccagcactatgagggcaacttccactacatcaacctgatcaagacaggagtgtggcagatccagatgaagggcgtgtctgtgggcagcagcaccctgctgtgtgaagatggctgcctggccctggtggacaccggggccagctacatcagcggcagcaccagcagcattgagaagctgatggaggccctgggcgccaagaagaggctgtttgattatgtggtgaagtgcaatgaaggccccaccctgcctgacatctccttccacctgggcggcaaggagtacaccctgaccagcgctgactatgtgttccaggagagctacagcagcaagaagctgtgcaccctggccatccacgccatggacatccccccacccaccggccccacctgggccctgggcgccaccttcatcaggaagttctacacagaatttgacagaagaaacaacagaattggatttgccctggccaggtag

SEQ ID NO: 167568 - DNA, 978 bp, Artificial Sequence
  Description of Artificial Sequence: Synthetic coding sequence
atggacacccagtactacggggagattggaattggcaccccaccccagaccttcaaggtggtgtttgacaccggcagcagcaatgtgtgggtgcccagcagcaagtgcagccggctgtacacagcctgtgtgtaccacaagctgtttgatgccagtgacagcagcagctacaagcacaacggcacagagctgaccctgcgctacagcacaggcaccgtgtctggcttcctgagccaggacatcatcaccgtgggcggcatcaccgtgacccagatgtttggagaggtgacagagatgcctgccctgcccttcatgctggccgagtttgatggagtggtgggcatgggcttcatcgagcaggccatcggccgggtgacccccatctttgacaacatcatcagccagggcgtgctgaaggaggatgtgttctccttctactacaacagagatggagagaacagccagagcctgggcggccagatcgtgctgggcggcagtgacccccagcactatgagggcaacttccactacatcaacctgatcaagacaggagtgtggcagatccagatgaagggcgtgtctgtgggcagcagcaccctgctgtgtgaagatggctgcctggccctggtggacaccggggccagctacatcagcggcagcaccagcagcattgagaagctgatggaggccctgggcgccaagaagaggctgtttgattatgtggtgaagtgcaatgaaggccccaccctgcctgacatctccttccacctgggcggcaaggagtacaccctgaccagcgctgactatgtgttccaggagagctacagcagcaagaagctgtgcaccctggccatccacgccatggacatccccccacccaccggccccacctgggccctgggcgccaccttcatcaggaagttctacacagaatttgacagaagaaacaacagaattggatttgccctggccaggtag

SEQ ID NO: 167569 - DNA, 1284 bp, Artificial Sequence
  Description of Artificial Sequence: Synthetic coding sequence
atgagcaagggcctgcctgcccggcaggacatggagaaggagcgggagaccctgcaggcctggaaggagcgggtgggccaggagctggacagagtggtggccttctggatggagcacagccatgaccaggagcacggcggcttcttcacctgcctgggccgggagggccgggtgtatgatgacctgaagtatgtgtggctgcagggccggcaggtgtggatgtactgccgcctgtaccgcacctttgagcgcttcagacatgcccagctgctggatgctgccaaggccggcggggagttcctgctgcgctatgcccgggtggcccctcctgggaagaagtgtgcctttgtgctgaccagagatggccggcctgtgaaggtgcagaggaccatcttcagcgagtgcttctacaccatggccatgaatgagctgtggagggccaccggggaggtgcgctaccagacagaagctgtggagatgatggaccagatcgtgcactgggtgcaggaggatgccagcggcctgggccggccccagctgcagggcgccccagctgctgagcccatggctgtgcccatgatgctgctgaacctggtggagcagctgggggaggctgatgaggagctggccggcaagtatgcagagctgggggactggtgtgcccggcgcatcctgcagcacgtgcagagagatggccaggccgtgctggagaatgtgtctgagggcggcaaggagctgcccggctgcctgggccggcagcagaaccctggccacaccctggaggccggctggttcctgctgcggcactgcatcagaaaaggagaccctgagctgcgggcccacgtgattgacaagttcctgctgctgcccttccacagcggctgggaccctgaccatggaggcctcttctacttccaggatgctgacaacttctgccccacccagctggagtgggccatgaagctgtggtggccccacagcgaggccatgattgccttcctgatgggctacagcgacagcggggaccctgtgctgctgcggctcttctaccaggtggccgagtacaccttccggcagttccgggaccctgaatatggagagtggtttggctacctgagccgggagggcaaggtggccctgagcatcaagggcggccccttcaagggctgcttccacgtgccccgctgcctggccatgtgtgaggagatgctgggcgccctgctgagcaggcctgccccagcccccagccctgcccccaccccagcctgccgcggggctgagtag

SEQ ID NO: 167570 - DNA, 765 bp, Artificial Sequence
  Description of Artificial Sequence: Synthetic coding sequence
atgagcaagggcctgcctgcccggcaggacatggagaaggagcgggagaccctgcaggcctggaaggagcgggtgggccaggagctggacagagtggtggccttctggatggagcacagccatgaccaggagcacggcggcttcttcacctgcctgggccgggagggccgggtgtatgatgacctgaagtatgtgtggctgcagggccggcaggtgtggatgtactgccgcctgtaccgcacctttgagcgcttcagacatgcccagctgctggatgctgccaaggccggcggggagttcctgctgcgctatgcccgggtggcccctcctgggaagaagtgtgcctttgtgctgaccagagatggccggcctgtgaaggtgcagaggaccatcttcagcgagtgcttctacaccatggccatgaatgagctgtggagggccaccggggaggtgcgctaccagacagaagctgtggagatgatggaccagatcgtgcactgggtgcaggaggatgccagcggcctgggccggccccagctgcagggcgccccagctgctgagcccatggctgtgcccatgatgctgctgaacctggtggagcagctgggggaggctgatgaggagctggccggcaagtatgcagagctgggggactggtgtgcccggcgcatcctgcagcacgtgcaggccacccgctggaagccagctggcttctgcagcgtcatcgccttcggcaaggccacccccaactttgagcccacctag

SEQ ID NO: 167571 - DNA, 2355 bp, Artificial Sequence
  Description of Artificial Sequence: Synthetic coding sequence
atggcccagctgctgaacagcatcctgtctgtgattgatgtgttccacaagtatgccaagggaaatggagactgtgccctgctgtgcaaggaggagctgaagcagctgctgctggccgagtttggagacatcctgcagaggcccaatgaccctgagaccgtggagaccatcctgaacctgctggaccaggacagagatggccacatcgacttccacgagtacctgctgctggtgttccagctggtgcaggcctgctaccacaagctggacaacaagagccacggcggccgcaccagccagcaggagcggggccaggagggcgcccaggactgcaagtttcctggcaacacaggccggcagcaccggcagagacatgaggaggagcggcagaacagccaccacagccagcctgagcggcaggatggagacagccaccacggccagcctgagcggcaggaccgggacagccaccacggccagagcgagaagcaggaccgggacagccaccacagccagcctgagcggcaggaccgggacagccaccacaaccagagcgagcggcaggacaaggacttctcctttgaccagagcgagcggcagagccaggacagcagcagcggcaagaaggtgagccacaagagcaccagcggccaggccaagtggcagggccacatctttgccctgaacagatgtgagaagcccatccaggacagccactacggccagagcgagcggcacacccagcagagcgagaccctgggccaggccagccacttcaaccagaccaaccagcagaagagcggcagctactgcggccagagcgagcggctgggccaggagctgggctgcggccagacagaccggcagggccagagcagccactacggccagacagaccggcaggaccagagctaccactacggccagacagaccggcagggccagagcagccactacagccagacagaccggcagggccagagcagccactacagccagcctgaccggcagggccagagcagccactacggccagatggacaggaagggccagtgctaccactatgaccagaccaaccggcagggccagggcagccactacagccagcccaaccggcagggccagagcagccactacggccagcctgacacccaggaccagagcagccactacggccagacagaccggcaggaccagagcagccactacggccagacagagcggcagggccagagcagccactacagccagatggaccggcagggccagggcagccactacggccagacagaccggcagggccagagcagccactacggccagcctgaccggcagggccagaacagccactacggccagacagaccggcagggccagagcagccactacggccagacagaccggcagggccagagcagccactacagccagcctgacaagcagggccagagcagccactacggcaagattgaccggcaggaccagagctaccactacggccagccagatggccagggccagagcagccactacggccagacagaccggcagggccagagcttccactacggccagcctgaccggcagggccagagcagccactacagccagatggaccggcagggccagagcagccactacggccagacagaccggcagggccagagcagccactacggccagacagaccggcagggccagagctaccactacggccagacagaccggcagggccagagcagccactacatccagagccagacaggagagatccagggccagaacaagtacttccagggcacagagggcaccaggaaggccagctatgtggagcagagcggccgcagcggccgcctgagccagcagaccccaggccaggagggctaccagaaccagggccagggcttccagagccgggacagccagcagaatggccaccaggtgtgggagcctgaggaggacagccagcaccaccagcacaagctgctggcccagatccagcaggagcggcccctgtgccacaagggccgggactggcagagctgcagcagcgagcagggccaccggcaggcccagacccggcagagccatggagagggcctgagccactgggccgaggaggagcagggccaccagacctgggacagacacagccatgagagccaggagggcccctgtggcacccaggacaggaggacccacaaggatgagcagaaccaccagaggcgggaccggcagacccatgagcacgagcagagccaccagaggcgggaccggcagacccatgaggacaagcagaaccggcagaggcgggaccggcagacccatgaagatgagcagaaccaccagaggtag

SEQ ID NO: 167572 - DNA, 1320 bp, Artificial Sequence
  Description of Artificial Sequence: Synthetic coding sequence
atggacaggaagggccagtgctaccactatgaccagaccaaccggcagggccagggcagccactacagccagcccaaccggcagggccagagcagccactacggccagcctgacacccaggaccagagcagccactacggccagacagaccggcaggaccagagcagccactacggccagacagagcggcagggccagagcagccactacagccagatggaccggcagggccagggcagccactacggccagacagaccggcagggccagagcagccactacggccagcctgaccggcagggccagaacagccactacggccagacagaccggcagggccagagcagccactacggccagacagaccggcagggccagagcagccactacagccagcctgacaagcagggccagagcagccactacggcaagattgaccggcaggaccagagctaccactacggccagccagatggccagggccagagcagccactacggccagacagaccggcagggccagagcttccactacggccagcctgaccggcagggccagagcagccactacagccagatggaccggcagggccagagcagccactacggccagacagaccggcagggccagagcagccactacggccagacagaccggcagggccagagctaccactacggccagacagaccggcagggccagagcagccactacatccagagccagacaggagagatccagggccagaacaagtacttccagggcacagagggcaccaggaaggccagctatgtggagcagagcggccgcagcggccgcctgagccagcagaccccaggccaggagggctaccagaaccagggccagggcttccagagccgggacagccagcagaatggccaccaggtgtgggagcctgaggaggacagccagcaccaccagcacaagctgctggcccagatccagcaggagcggcccctgtgccacaagggccgggactggcagagctgcagcagcgagcagggccaccggcaggcccagacccggcagagccacggggagggcctgagccactgggccgaggaggagcagggccaccagacctgggacagacacagccatgagagccaggagggcccctgtggcacccaggacaggaggacccacaaggatgagcagaaccaccagaggcgggaccggcagacccatgaacatgagcagagccaccagaggcgggaccggcagacccatgaggacaagcagaaccggcagaggcgggaccggcagacccatgaagatgagcagaaccaccagaggtag

SEQ ID NO: 167573 - DNA, 1065 bp, Artificial Sequence
  Description of Artificial Sequence: Synthetic coding sequence
atggaggtggaggccgtgtgtggcggggccggggaggtggaggcccaggacagcgaccctgccccagccttcagcaaggcccctggcagcgctggccactatgagctgccctgggtggagaagtacagacctgtgaagctgaatgagatcgtgggcaatgaagacacagtgtcccggctggaggtgtttgcccgggagggcaatgtgcccaacatcatcatcgccggccccccaggcaccgggaagaccaccagcatcctgtgcctggcccgggccctgctgggccctgccctgaaggatgccatgctggagctgaatgccagcaatgaccggggcattgatgtggtgaggaacaagatcaagatgtttgcccagcagaaggtgaccctgcccaagggccgccacaagatcatcatcctggatgaagctgacagcatgacagatggagcccagcaggccctgcggaggaccatggagatctacagcaagaccaccaggtttgccctggcctgcaatgccagtgacaagatcatcgagcccatccagagccgctgtgctgtgctgcgctacaccaagctgacagatgcccagatcctgacccggctgatgaatgtcatcgagaaggagcgggtgccctacacagatgatggcctggaggccatcatcttcaccgcccagggcgacatgaggcaggccctgaacaacctgcagagcaccttcagcggcttcggcttcatcaacagtgaaaatgtgttcaaggtgtgtgatgagccccaccccctgctggtgaaggagatgatccagcactgtgtgaatgccaacattgatgaggcctacaagatcctggcccacctgtggcacctgggctacagccctgaggacatcatcggcaacatcttccgggtgtgcaagaccttccagatggccgagtacctgaagctggagttcatcaaggagatcggctacacccacatgaagattgctgagggcgtgaacagcctgctgcagatggccggcctgctggcccggctgtgccagaagaccatggcccctgtggccagctag

SEQ ID NO: 167574 - DNA, 963 bp, Artificial Sequence
  Description of Artificial Sequence: Synthetic coding sequence
atggaggtggaggccgtgtgtggcggggccggggaggtggaggcccaggacagcgaccctgccccagccttcagcaaggcccctggcagcgctggccactatgagctgccctgggtggagaagtacagacctgtgaagctgaatgagatcgtgggcaatgaagacacagtgtcccggctggaggtgtttgcccgggagggcaatgtgcccaacatcatcatcgccggccccccaggcaccgggaagaccaccagcatcctgtgcctggcccgggccctgctgggccctgccctgaaggatgccatgctggagctgaatgccagcaatgacagcatgacagatggagcccagcaggccctgcggaggaccatggagatctacagcaagaccaccaggtttgccctggcctgcaatgccagtgacaagatcatcgagcccatccagagccgctgtgctgtgctgcgctacaccaagctgacagatgcccagatcctgacccggctgatgaatgtcatcgagaaggagcgggtgccctacacagatgatggcctggaggccatcatcttcaccgcccagggcgacatgaggcaggccctgaacaacctgcagagcaccttcagcggcttcggcttcatcaacagtgaaaatgtgttcaaggtgtgtgatgagccccaccccctgctggtgaaggagatgatccagcactgtgtgaatgccaacattgatgaggcctacaagatcctggcccacctgtggcacctgggctacagccctgaggacatcatcggcaacatcttccgggtgtgcaagaccttccagatggccgagtacctgaagctggagttcatcaaggagatcggctacacccacatgaagattgctgagggcgtgaacagcctgctgcagatggccggcctgctggcccggctgtgccagaagaccatggcccctgtggccagctag

SEQ ID NO: 167575 - DNA, 1071 bp, Artificial Sequence
  Description of Artificial Sequence: Synthetic coding sequence
atgagcctgtgggtggacaagtaccggccctgcagcctgggccgcctggactaccacaaggagcaggccgcccagctgaggaacctggtgcagtgtggggacttcccccacctgctggtgtatggccccagcggggccggcaagaagacccgcatcatgtgcatcctgcgggagctgtatggagtgggcgtggagaagctgagaattgagcaccagaccatcaccacccccagcaagaagaagattgagatcagcaccatcgccagcaactaccacctggaggtgaaccccagtgatgctggcaacagcgacagagtggtgatccaggagatgctgaagacagtggcccagagccagcagctggagaccaacagccagagggacttcaaggtggtgctgctgacagaggtggacaagctgaccaaggatgcccagcacgccctgcggaggaccatggagaagtacatgagcacctgccgcctcatcctgtgctgcaacagcaccagcaaggtgattcctcccatccgcagccgctgcctggccgtgcgggtgcctgcccccagcattgaggacatctgccacgtgctgagcacagtgtgcaagaaggagggcctgaacctgcccagccagctggcccaccggctggccgagaagagctgcaggaacctgaggaaggccctgctgatgtgtgaggcctgccgggtgcagcagtaccccttcaccgctgaccaggagatccctgagacagactgggaggtgtacctgcgggagacagccaatgccatcgtgtcccagcagaccccccagaggctgctggaggtgcggggccgcctgtatgagctgctgacccactgcatccccccagagatcatcatgaagggcctgctgtctgagctgctgcacaactgtgatggccagctgaagggggaggtggcccagatggccgcctactatgagcaccggctgcagctgggcagcaaggccatctaccacctggaggcctttgtggccaagttcatggccctgtacaagaagttcatggaggatggcctggagggcatgatgttttag

SEQ ID NO: 167576 - DNA, 918 bp, Artificial Sequence
  Description of Artificial Sequence: Synthetic coding sequence
atgagcctgtgggtggacaagtaccggccctgcagcctgggccgcctggactaccacaaggagcaggccgcccagctgaggaacctggtgcagtgtggggacttcccccacctgctggtgtatggccccagcggggccggcaagaagacccgcatcatgtgcatcctgcgggagctgtatggagtgggcgtggagaagctgagaattgagcaccagaccatcaccacccccagcaagaagaagattgagatcagcaccatcgccagcaactaccacctggaggtgaaccccagtgatgctggcaacagcgacagagtggtgatccaggagatgctgaagacagtggcccagagccagcagctggagaccaacagccagagggacttcaaggtggtgctgctgacagaggtggacaagctgaccaaggatgcccagcacgccctgcggaggaccatggagaagtacatgagcacctgccgcctcatcctgtgctgcaacagcaccagcaaggtgattcctcccatccgcagccgctgcctggccgtgcgggtgcctgcccccagcattgaggacatctgccacgtgctgagcacagtgtgcaagaaggagggcctgaacctgcccagccagctggcccaccggctggccgagaagagctgcaggaacctgaggaaggccctgctgatgtgtgaggcctgccgggtgcagcagtaccccttcaccgctgaccaggagatccctgagacagactgggaggtgtacctgcgggagacagccaatgccatcgtgtcccagcagaccccccagaggctgctggaggtgcggggccgcctgtatgagctgctgacccactgcatccccccagagatcatcatgaaggcctgcaaggaggagagccgcagctgtgacatcttctag

SEQ ID NO: 167577 - DNA, 1092 bp, Artificial Sequence
  Description of Artificial Sequence: Synthetic coding sequence
atgcaggccttcctgaagggcaccagcatcagcaccaagccacccctgaccaaggacagaggagtggccgccagcgctggcagcagtggagagaacaagaaggccaagcctgtgccctgggtggagaagtaccggcccaagtgtgtggatgaggtggccttccaggaggaggtggtggccgtgctgaagaagagcctggagggcgctgacctgcccaacctgctcttctacggccccccaggcaccgggaagaccagcaccatcctggccgccgcccgggagctgtttggacctgagctgttccggctgcgggtgctggagctgaatgccagtgatgagcggggcatccaggtggtgcgggagaaggtgaagaactttgcccagctgactgtgtctggcagcagaagtgatggcaagccctgcccccccttcaagatcgtcatcctggatgaggccgacagcatgaccagcgctgcccaggccgccctgcggaggaccatggagaaggagagcaagaccacccgcttctgcctgatctgcaactacgtgagccgcatcatcgagcccctgaccagccgctgcagcaagttccgcttcaagcccctgagtgacaagatccagcagcagaggctgctggacatcgccaagaaggaaaatgtgaagatcagtgatgagggcatcgcctacctggtgaaggtgtctgagggggacctgaggaaggccatcaccttcctgcagagcgccacccggctgaccggcggcaaggagatcacagagaaggtgatcacagacattgctggggtcatcccagctgagaagattgatggagtgtttgctgcctgccagagcggcagctttgacaagctggaggccgtggtgaaggacctgattgatgagggccacgccgccacccagctggtgaaccagctgcatgatgtggtggtggagaacaacctgagtgacaagcagaagagcatcatcacagagaagctggccgaggtggacaagtgcctggctgatggagcagatgagcacctgcagctgatcagcctgtgtgccaccgtgatgcagcagctgagccagaactgctag

SEQ ID NO: 167578 - DNA, 1092 bp, Artificial Sequence; identical to SEQ ID NO: 167577
  Description of Artificial Sequence: Synthetic coding sequence

SEQ ID NO: 167579 - DNA, 132 bp, Artificial Sequence
  Description of Artificial Sequence: Synthetic coding sequence
atgcaggccttcctgaagggcaccagcatcagcaccaagccacccctgaccaaggacagaggagtggccgccagcgctggcagcagtggagagaacaagaaggccaagcctgtgccctgggtggagaagtag

SEQ ID NO: 167580 - DNA, 645 bp, Artificial Sequence
  Description of Artificial Sequence: Synthetic coding sequence
atgcaggccttcctgaagggcaccagcatcagcaccaagccacccctgaccaaggacagaggagtggccgccagcgctggcagcagtggagagaacaagaaggccaagcctgtgccctgggtggagaagtaccggcccaagtgtgtggatgaggtggccttccaggaggaggtggtggccgtgctgaagaagagcctggagggcgctgacctgcccaacctgctcttctacggccccccaggcaccgggaagaccagcaccatcctggccgccgcccgggagctgtttggacctgagctgttccggctgcgggtgctggagctgaatgccagtgatgagcggggcatccaggtggtgcgggagaaggtgaagaactttgcccagctgactgtgtctggcagcagaagtgatggcaagccctgcccccccttcaagatcgtcatcctggatgaggccgacagcatgaccagcgctgcccaggccgccctgcggaggaccatggagaaggagagcaagaccacccgcttctgcctgatctgcaactacgtgagccgcatcatcgagcccctgaccagccgctgcagcaagttccgcttcaagcccctgagtgacaagatccagcagcagaggctgctggacatctag

SEQ ID NO: 167581 - DNA, 372 bp, Artificial Sequence
  Description of Artificial Sequence: Synthetic coding sequence
atgcaggccttcctgaagggcaccagcatcagcaccaagccacccctgaccaaggacagaggagtggccgccagcgctggcagcagtggagagaacaagaaggccaagcctgtgccctgggtggagaagtaccggcccaagtgtgtggatgaggtggccttccaggaggaggtggtggccgtgctgaagaagagcctggagggcgctgacctgcccaacctgctcttctacggccccccaggcaccgggaagaccagcaccatcctggccgccgcccgggagctgtttggacctgagctgttccggctgcgggtgctggagctgaatgccagtgatgagcggggcatccaggtggtgcgggagaaggtgtag

SEQ ID NO: 167582 - DNA, 504 bp, Artificial Sequence
  Description of Artificial Sequence: Synthetic coding sequence
atgcaggccttcctgaagggcaccagcatcagcaccaagccacccctgaccaaggacagaggagtggccgccagcgctggcagcagtggagagaacaagaaggccaagcctgtgccctgggtggagaagtaccggcccaagtgtgtggatgaggtggccttccaggaggaggtggtggccgtgctgaagaagagcctggagggcgctgacctgcccaacctgctcttctacggccccccaggcaccgggaagaccagcaccatcctggccgccgcccgggagctgtttggacctgagctgttccggctgcgggtgctggagctgaatgccagtgatgagcggggcatccaggtggtgcgggagaaggtgaagaactttgcccagctgactgtgtctggcagcagaagtgatggcaagccctgcccccccttcaagatcgtcatcctggatgaggccgacagcatgaccagcgctgcccaggccgccctgcggaggaccatgtag

SEQ ID NO: 167583 - DNA, 288 bp, Artificial Sequence
  Description of Artificial Sequence: Synthetic coding sequence
atgcaggccttcctgaagggcaccagcatcagcaccaagccacccctgaccaaggacagaggagtggccgccagcgctggcagcagtggagagaacaagaaggccaagcctgtgccctgggtggagaagtaccggcccaagtgtgtggatgaggtggccttccaggaggaggtggtggccgtgctgaagaagagcctggagggcgctgacctgcccaacctgctcttctacggccccccaggcaccgggaagaccagcaccatcctggccgccgcccgggagctgtag

SEQ ID NO: 167584 - DNA, 1746 bp, Artificial Sequence
  Description of Artificial Sequence: Synthetic coding sequence
atgcagaggcctggcccccggctgtggctggtgctgcaggtgatgggcagctgtgccgccatcagctccatggacatggagaggcctggagatggcaagtgccagcccatcgagatccccatgtgcaaggacatcggctacaacatgaccaggatgcccaacctgatgggccacgagaaccagcgggaggccgccatccagctgcatgaatttgcccccctggtggagtatggctgccacggccacctgcgcttcttcctgtgcagcctgtatgcccccatgtgcacagagcaggtgtccacccccatcccagcctgccgggtgatgtgtgagcaggcccggctgaagtgcagccccatcatggagcagttcaacttcaagtggccagacagcctggactgcaggaagctgcccaacaagaatgaccccaactacctgtgcatggaggcccccaacaatggaagtgatgagcccacccggggcagcggcctcttccccccactcttccggccccagaggccccacagcgcccaggagcaccccctgaaggatggcggccctggccggggcggctgtgacaaccctgggaagttccaccacgtggagaagagcgccagctgtgcccccctgtgcaccccaggagtggatgtgtactggagccgggaggacaagagatttgctgtggtgtggctggccatctgggccgtgctgtgcttcttcagcagcgccttcaccgtgctgaccttcctgattgatcctgcccgcttccgctacccagagcggcccatcatcttcctgtccatgtgctactgtgtgtacagcgtgggctacctgatccggctgtttgctggagctgagagcatcgcctgtgaccgggacagcggccagctgtatgtgatccaggagggcctggagagcacaggctgcaccctggtgttcctggtgctgtactacttcggcatggccagcagcctgtggtgggtggtgctgaccctgacctggttcctggccgccggcaagaagtggggccacgaggccatcgaggccaacagcagctacttccacctggccgcctgggccatcccagctgtgaagaccatcctgatcctggtgatgagaagagtggccggagatgagctgactggagtgtgctacgtgggctccatggatgtgaatgccctgactggatttgtgctgatccccctggcctgctacctggtgattggcaccagcttcatcctgagcggctttgtggccctcttccacatccggcgggtgatgaagacaggaggagagaacacagacaagctggagaagctgatggtgcgcatcggcctcttctctgtgctgtacacagtgcctgccacctgtgtgattgcctgctacttctatgaaaggctgaacatggactactggaagatcctggccgcccagcacaagtgcaagatgaacaaccagaccaagaccctggactgcctgatggccgccagcatcccagctgtggagatcttcatggtgaagatcttcatgctgctggtggtgggcatcaccagcggcatgtggatctggaccagcaagaccctgcagagctggcagcaggtgtgcagccggcggctgaagaagaagagcaggaggaagccagccagcgtcatcaccagcggcggcatctacaagaaggcccagcacccccagaagacccaccacggcaagtatgagatcccagcccagagccccacctgtgtgtag

SEQ ID NO: 167585 - DNA, 960 bp, Artificial Sequence
  Description of Artificial Sequence: Synthetic coding sequence
atggtggagaagtaccggccccagaccctgaatgacctgatcagccaccaggacatcctgagcaccatccagaagttcatcaatgaagatcggctgccccacctgctgctgtatggccccccaggcaccgggaagaccagcaccatcctggcctgtgccaagcagctgtacaaggacaaggagtttggctccatggtgctggagctgaatgccagtgatgaccggggcatcgacatcatccggggccccatcctgagctttgccagcaccaggaccatcttcaagaagggcttcaagctggtgatcctggatgaagcagatgccatgacccaggatgcccagaatgccctgcggcgggtgattgagaagttcacagagaacacccgcttctgcctgatctgcaactacctgagcaagatcatcccagccctgcagagccgctgcacccgcttccgcttcggccccctgaccccagagctgatggtgccccggctggagcacgtggtggaggaggagaaggtggacatcagtgaagatggcatgaaggccctggtgaccctgagcagcggggacatgagaagagccctgaacatcctgcagagcaccaacatggccttcggcaaggtgacagaggagaccgtgtacacctgcaccggccaccccctgaagagtgacatcgccaacatcctggactggatgctgaaccaggacttcaccacagcctacagaaacatcacagagctgaagaccctgaagggcctggccctgcatgacatcctgacagagatccacctgtttgtgcaccgggtggacttccccagctctgtgcgcatccacctgctgaccaagatggctgacatcgagtaccgcctgtctgtgggcaccaatgagaagatccagctgagcagcctgattgctgccttccaggtgacccgggacctgattgtggccgaggcctag

SEQ ID NO: 167586 - DNA, 315 bp, Artificial Sequence
  Description of Artificial Sequence: Synthetic coding sequence
atggtggagaagtaccggccccagaccctgaatgacctgatcagccaccaggacatcctgagcaccatccagaagttcatcaatgaagatcggctgccccacctgctgctgtatggccccccaggcaccgggaagaccagcaccatcctggcctgtgccaagcagctgtacaaggacaaggagtttggctccatggtgctggagctgaatgccagtgatgaccggggcatcgacatcatccggggccccatcctgagctttgccagcaccaggaccatcttcaagaagggcttcaagctggtgatcctggactag

SEQ ID NO: 167587 - DNA, 1023 bp, Artificial Sequence
  Description of Artificial Sequence: Synthetic coding sequence
atggagaccagcgccctgaagcagcaggagcagcctgctgccaccaagatccggaacctgccctgggtggagaagtaccggccccagaccctgaatgacctgatcagccaccaggacatcctgagcaccatccagaagttcatcaatgaagatcggctgccccacctgctgctgtatggccccccaggcaccgggaagaccagcaccatcctggcctgtgccaagcagctgtacaaggacaaggagtttggctccatggtgctggagctgaatgccagtgatgaccggggcatcgacatcatccggggccccatcctgagctttgccagcaccaggaccatcttcaagaagggcttcaagctggtgatcctggatgaagcagatgccatgacccaggatgcccagaatgccctgcggcgggtcatcgagaagttcacagagaacacccgcttctgcctgatctgcaactacctgagcaagatcatcccagccctgcagagccgctgcacccgcttccgcttcggccccctgaccccagagctgatggtgccccggctggagcacgtggtggaggaggagaaggtggacatcagtgaagatggcatgaaggccctggtgaccctgagcagcggggacatgaggcgggccctgaacatcctgcagagcaccaacatggccttcggcaaggtgacagaggagaccgtgtacacctgcaccggccaccccctgaagagtgacatcgccaacatcctggactggatgctgaaccaggacttcaccacagcctacagaaacatcacagagctgaagaccctgaagggcctggccctgcatgacatcctgacagagatccacctgtttgtgcaccgggtggacttccccagctctgtgcgcatccacctgctgaccaagatggctgacatcgagtaccgcctgtctgtgggcaccaatgagaagatccagctgagcagcctgattgctgccttccaggtgacccgggacctgattgtggccgaggcctag

SEQ ID NO: 167588 - DNA, 192 bp, Artificial Sequence
  Description of Artificial Sequence: Synthetic coding sequence
atggtggagaagtaccggccccagaccctgaatgacctgatcagccaccaggacatcctgagcaccatccagaagttcatcaatgaagatcggctgccccacctgctgctgtatggccccccaggcaccgggaagaccagcaccatcctggcctgtgccaagcagctgtacaaggacaaggagtttggatag

SEQ ID NO: 167589 - DNA, 1077 bp, Artificial Sequence
  Description of Artificial Sequence: Synthetic coding sequence
atgtggaacagcaatgatggaggagctggctggaggaggaagagaattgctgggggcttcagcaagagggccagcctgggcagcgagcggcgggtggtggccggggaggagggccgggagaggtcctggggcgtgtggggcagccctgctggaagaagaagaggccgcctgggccgcctgggccagtgcctgaagggccgcagcctgcgggagcctgctggcttcagcgaggcctgggatgtggcccaggccctgatcctgctcttcaagacaggaggctttgagagctatggcagcagcagctatggaggagctgggggctacacccagagccctgggggcttcggcagccctgcccccagccaggccgagaagaagagccgggcccgggcccagcacatcgtgccctgcaccatcagccagctgctgagcgccaccctggtggatgaggtgttcagaattggaaatgtggagatcagccaggtgaccatcgtgggcatcatcagacatgctgagaaggcccccaccaacatcgtgtacaagattgatgacatgacagctgcccccatggatgtgcggcagtgggtggacacagatgacaccagcagcgagaacacagtggtgcccccagagacctacgtgaaggtggccggccacctgcggagcttccagaacaagaagagcctggtggccttcaagatcatgcccctggaggacatgaatgagttcaccacccacatcctggaggtgatcaatgcccacatggtgctgagcaaggccaacagccagcccagcgctggccgggcccccatcagcaaccctggcatgtctgaggccggcaactttggaggcaacagcttcatgcctgccaacggcctgactgtggcccagaaccaggtgctgaacctgatcaaggcctgccccaggcctgagggcctgaacttccaggacctgaagaaccagctgaagcacatgtctgtgagcagcatcaagcaggccgtggacttcctgagcaatgaaggccacatctacagcacagtggatgatgaccacttcaagagcacagatgctgagtag

SEQ ID NO: 167590 - DNA, 837 bp, Artificial Sequence
  Description of Artificial Sequence: Synthetic coding sequence
atgggccgcggggacaggaacaagaggagcatccggggctttgagagctatggcagcagcagctatggaggagctgggggctacacccagagccctgggggcttcggcagccctgcccccagccaggccgagaagaagagccgggcccgggcccagcacatcgtgccctgcaccatcagccagctgctgagcgccaccctggtggatgaggtgttcagaattggaaatgtggagatcagccaggtgaccatcgtgggcatcatcagacatgctgagaaggcccccaccaacatcgtgtacaagattgatgacatgacagctgcccccatggatgtgcggcagtgggtggacacagatgacaccagcagcgagaacacagtggtgcccccagagacctacgtgaaggtggccggccacctgcggagcttccagaacaagaagagcctggtggccttcaagatcatgcccctggaggacatgaatgagttcaccacccacatcctggaggtgatcaatgcccacatggtgctgagcaaggccaacagccagcccagcgctggccgggcccccatcagcaaccctggcatgtctgaggccggcaactttggaggcaacagcttcatgcctgccaacggcctgactgtggcccagaaccaggtgctgaacctgatcaaggcctgccccaggcctgagggcctgaacttccaggacctgaagaaccagctgaagcacatgtctgtgagcagcatcaagcaggccgtggacttcctgagcaatgaaggccacatctacagcacagtggatgatgaccacttcaagagcacagatgctgagtag

SEQ ID NO: 167591 - DNA, 813 bp, Artificial Sequence
  Description of Artificial Sequence: Synthetic coding sequence
atgtggaacagcggctttgagagctatggcagcagcagctatggaggagctgggggctacacccagagccctgggggcttcggcagccctgcccccagccaggccgagaagaagagccgggcccgggcccagcacatcgtgccctgcaccatcagccagctgctgagcgccaccctggtggatgaggtgttcagaattggaaatgtggagatcagccaggtgaccatcgtgggcatcatcagacatgctgagaaggcccccaccaacatcgtgtacaagattgatgacatgacagctgcccccatggatgtgcggcagtgggtggacacagatgacaccagcagcgagaacacagtggtgcccccagagacctacgtgaaggtggccggccacctgcggagcttccagaacaagaagagcctggtggccttcaagatcatgcccctggaggacatgaatgagttcaccacccacatcctggaggtgatcaatgcccacatggtgctgagcaaggccaacagccagcccagcgctggccgggcccccatcagcaaccctggcatgtctgaggccggcaactttggaggcaacagcttcatgcctgccaacggcctgactgtggcccagaaccaggtgctgaacctgatcaaggcctgccccaggcctgagggcctgaacttccaggacctgaagaaccagctgaagcacatgtctgtgagcagcatcaagcaggccgtggacttcctgagcaatgaaggccacatctacagcacagtggatgatgaccacttcaagagcacagatgctgagtag

SEQ ID NO: 167592 - DNA, 369 bp, Artificial Sequence
  Description of Artificial Sequence: Synthetic coding sequence
ctggaggacatgaatgagttcaccacccacatcctggaggtgatcaatgcccacatggtgctgagcaaggccaacagccagcccagcgctggccgggcccccatcagcaaccctggcatgtctgaggccggcaactttggaggcaacagcttcatgcctgccaacggcctgactgtggcccagaaccaggtgctgaacctgatcaaggcctgccccaggcctgagggcctgaacttccaggacctgaagaaccagctgaagcacatgtctgtgagcagcatcaagcaggccgtggacttcctgagcaatgaaggccacatctacagcacagtggatgatgaccacttcaagagcacagatgctgagtag

SEQ ID NO: 167593 - DNA, 540 bp, Artificial Sequence
  Description of Artificial Sequence: Synthetic coding sequence
atgtggaacagcaatgatggcggcggctttgagagctatggcagcagcagctatggaggagctgggggctacacccagagccctgggggcttcggcagccctgcccccagccaggccgagaagaagagccgggcccgggcccagcacatcgtgccctgcaccatcagccagctgctgagcgccaccctggtggatgaggtgttcagaattggaaatgtggagatcagccaggtgaccatcgtgggcatcatcagacatgctgagaaggcccccaccaacatcgtgtacaagattgatgacatgacagctgcccccatggatgtgcggcagtgggtggacacagatgacaccagcagcgagaacacagtggtgcccccagagacctacgtgaaggtggccggccacctgcggagcttccagaacaagaagagcctggtggccttcaagatcatgcccctggaggacatgaatgagttcaccacccacatcctggaggtgatcaatgcccacatggtgctgagcaaggccaacagccagtag

SEQ ID NO: 167594 - DNA, 786 bp, Artificial Sequence
  Description of Artificial Sequence: Synthetic coding sequence
atgagcaagagcggcttcggcagctatggcagcatctctgctgctgatggagccagcggcggcagtgaccagctgtgtgaaagagatgccaccccagccatcaagacccagaggcccaaggtgcgcatccaggatgtggtgccctgcaatgtgaaccagctgctgagcagcacagtgtttgaccccgtcttcaaggtgcggggcatcatcgtgtcccaggtgtccatcgtgggcgtcatcagaggagctgagaaggccagcaaccacatctgctacaagattgatgacatgacagccaagcccatcgaggcccggcagtggtttggccgggagaaggtgaagcaggtgacccccctgtctgtgggcgtgtatgtgaaggtgtttggcatcctgaagtgccccaccggcaccaagagcctggaggtgctgaagatccacgtgctggaggacatgaatgagttcaccgtgcacatcctggagaccgtgaatgcccacatgatgctggacaaggcccggcgggacaccaccgtggagagcgtgcctgtgagccccagcgaggtgaatgatgctggggacaatgatgagagccacaggaacttcatccaggatgaggtgctgcggctcatccatgaatgtccccaccaggagggcaagagcatccacgagctgcgggcccagctgtgtgacctgtctgtgaaggccatcaaggaggccatcgactacctgactgtggagggccacatctaccccaccgtggaccgggagcacttcaagtctgctgactag

SEQ ID NO: 167595 - DNA, 330 bp, Artificial Sequence
  Description of Artificial Sequence: Synthetic coding sequence
atgaacccagccctgggcaaccagacagatgtggccggcctcttcctggccaacagcagcgaggccctggagagagctgtgcgctgctgcacccaggcctctgtggtgacagatgatggctttgctgagggcggcccagatgagaggagcctgtacatcatgagggtggtgcagattgctgtgatgtgtgtgctgagcctgactgtggtgtttggcatcttcttcctgggctgcaacctgctgatcaagtctgagggcatgatcaacttcctggtgaaggacagaagacccagcaaggaggtggaggccgtggtggtgggcccctactag

SEQ ID NO: 167596 - DNA, 1893 bp, Artificial Sequence
  Description of Artificial Sequence: Synthetic coding sequence
atgcagggcagcagcctgtggctgagcctgaccttccgcagcgcccgggtgctgagccgggcccgcttctttgagtggcagagccctggcctgcccaacacagctgccatggagaatggaacaggcccctacggggaggagcggccccgggaggtgcaggagaccaccgtgacagagggcgccgccaagatcgccttccccagcgccaatgaggtgttctacaaccctgtgcaggagttcaacagagacctgacctgtgctgtgatcacagaatttgcccgcatccagctgggcgccaagggcatccagatcaaggtgcctggagagaaggacacccagaaggtggtggtggacctgtctgagcaggaggaggagaaggtggagctgaaggagagcgagaacctggccagcggggaccagcccaggacagctgctgtgggggagatctgtgaggagggcctgcacgtgctggagggcctggccgccagcggcctgcggagcatccgctttgccctggaggtgcccggcctgcggtctgtggtggccaatgatgccagcaccagggctgtggacctgatcagaagaaatgtgcagctgaatgatgtggcccacctggtgcagcccagccaggctgatgccaggatgctgatgtaccagcaccagagggtgtctgaaagatttgatgtgattgacctggacccctacggcagccctgccaccttcctggatgctgctgtgcaggccgtgtctgagggcggcctgctgtgtgtgacctgcacagacatggctgtgctggccggcaacagcggggagacctgctacagcaaatatggagccatggccctgaagagccgggcctgccacgagatggccctgcgcatcgtgctgcacagcctggacctgcgggccaactgctaccagagatttgtggtgcccctgctgagcatctctgctgacttctacgtgcgggtgtttgtgcgggtcttcaccggccaggccaaggtgaaggccagcgcccgggccaagttctctgctgcctgtggcccccctgtgaccccagaatgtgagcactgcggccagaggcaccagctgggcggccccatgtgggccgagcccatccatgacctggactttgtgggccgggtgctggaggccgtgtctgccaaccctggccgcttccacaccagcgagcgcatccggggcgtgctgagcgtcatcacagaggagctgcctgatgtgcccctgtactacaccctggaccagctgagcagcaccatccactgcaacacccccagcctgctgcagctgcggagcgccctgctgcatgctgacttccgggtgtccctgagccacgcctgcaagaatgctgtgaagacagatgccccagccagcgccctgtgggacatcatgcgctgctgggagaaggagtgccctgtgaagcgggagcggctgtctgagaccagccctgccttccgcatcctgtctgtggagccccggctgcaggccaacttcaccatccgggaggatgccaaccccagcagccggcagaggggcctgaagcgcttccaggccaaccctgaggccaactggggcccccggccccgggcccggcctgggggcaaggctgctgatgaggccatggaggagcggcggcggctgctgcagaacaagaggaaggagcccccagaagatgtggcccagagagctgcccggctgaagaccttcccctgcaagcgcttcaaggagggcacctgccagagaggagaccagtgctgctacagccacagcccccccaccccccgggtgtctgcagatgctgccccagactgcccagagaccagcaaccagaccccacctggccctggagctgctgctggccctggcattgattag

SEQ ID NO: 167597 - DNA, 249 bp, Artificial Sequence
  Description of Artificial Sequence: Synthetic coding sequence
atgaaggccctgtgcctgctgctgctgcctgtgctgggcctgctggtgagcagcaagaccctgtgcagcatggaggaggccatcaatgaaagaatccaggaggtggccggcagcctgagctttgctgtgacaggctgcacctgtggcagcgcctgtggctcctgggatgtgcgggcagagaccacctgccactgccagtgtgccggcatggactggacaggagcccgctgctgccgggtgcagccctag

SEQ ID NO: 167598 - DNA, 954 bp, Artificial Sequence
  Description of Artificial Sequence: Synthetic coding sequence
atgaagaggctgagcctggtgaccaccaaccggctgagcccccacggcaacttcctgcccctgtgcaccttccccctggccgtggacatggccgccctcttccaggaggccagcagctgccctgtgtgcagcgactacctggagaagcccatgagcctggagtgtggctgtgctgtgtgcttcaagtgcatcaacagcctgcagaaggagccccacggggaggacctgctgtgctgctgctgcagcatggtgtcccagaagaacaagatccggcccagctggcagctggagcggctggccagccacatcaaggagctggagcccaagctgaagaagatcctgcagatgaaccccaggatgaggaagttccaggtggacatgaccctggatgctgacacagccaacaacttcctgctgatcagtgatgacctgcggtctgtgcgcagcggctgcatcacccagaaccggcaggacctggccgagagatttgatgtgtccatctgcatcctgggcagcccccgcttcacctgtggccgccactactgggaggtggatgtgggcaccagcacagagtgggacctgggcgtgtgccgggagagcgtgcacaggaagggccgcatccacctgaccacagagcggggcttctggacagtgtccctgagagatggcagccggctgagcgccagcacagtgcccctgaccttcctgtttgtggacaggaagctgcagagggtgggcatcttcctggacatgggcatgcagaatgtgtccttctttgatgctgagggcggcagccacgtgtacaccttccgctctgtgtctgctgaggagcccctgcacctgttctttgccccacccagcccccccaacggggacaagtctgtgctgagcatctgccctgtgatcaaccctggcaccacagatgcccctgtgcaccctggagaggccaagtag

SEQ ID NO: 167599 - DNA, 954 bp, Artificial Sequence
  Description of Artificial Sequence: Synthetic coding sequence
atgaagaggctgagcctggtgaccaccaaccggctgagcccccacggcaacttcttcaccctgtgcaccttccccctggccgtggacatggccgccctcttccaggaggccagcagctgccctgtgtgcagcgactacctggagaagcccatgagcctggagtgtggctgtgctgtgtgcctgaagtgcatcaacagcctgcagaaggagccccacggggaggacctgctgtgctgctgcagctccatggtgtccaggaagaacaagatcagaagaaaccggcagctggagcggctggccagccacatcaaggagctggagcccaagctgaagaagatcctgcagatgaaccccaggatgaggaagttccaggtggacatgaccctggatgccaacacagccaacaacttcctgctgatcagtgatgacctgcggtctgtgcgcagcggccgcatccggcagaaccggcaggacctggccgagagatttgatgtgtctgtgtgcatcctgggcagcccccgcttcacctgtggccgccactgctgggaggtggatgtgggcaccagcacagagtgggacctgggcgtgtgccgggagagcgtgcacaggaagggccgcatccagctgaccacagagctgggcttctggacagtgtccctgagagatggcggccgcctgagcgccaccaccgtgcccctgaccttcctgtttgtggacaggaagctgcagagggtgggcatcttcctggacatgggcatgcagaatgtgtccttctttgatgctgagagcggcagccacgtgtacaccttccgctctgtgtctgctgaggagcccctgcggcccttcctggcccccagcgtgccccccaacggggaccagggcgtgctgagcatctgccccctgatgaacagcggcaccacagatgcccctgtgcggcctggagaggccaagtag

SEQ ID NO: 167600 - DNA, 867 bp, Artificial Sequence
  Description of Artificial Sequence: Synthetic coding sequence
atggccgccctcttccaggaggccagcagctgccctgtgtgcagcgactacctggagaagcccatgagcctggagtgtggctgtgctgtgtgcctgaagtgcatcaacagcctgcagaaggagccccatggagaggacctgctgtgctgctgcagctccatggtgtccaggaagaacaagatcagaagaaaccggcagctggagcggctggccagccacatcaaggagctggagcccaagctgaagaagatcctgcagatgaaccccaggatgaggaagttccaggtggacatgaccctggatgccaacacagccaacaacttcctgctgatcagtgatgacctgcggtctgtgcgcagcggccgcatccggcagaaccggcaggacctggccgagagatttgatgtgtctgtgtgcatcctgggcagcccccgcttcacctgtggccgccactgctgggaggtggatgtgggcaccagcacagagtgggacctgggcgtgtgccgggagagcgtgcacaggaagggccgcatccagctgaccacagagctgggcttctggacagtgtccctgagagatggcggccgcctgagcgccaccaccgtgcccctgaccttcctgtttgtggacaggaagctgcagagggtgggcatcttcctggacatgggcatgcagaatgtgtccttctttgatgctgagagcggcagccacgtgtacaccttccgctctgtgtctgctgaggagcccctgcggcccttcctggcccccagcgtgcccccaaatggagaccagggcgtgctgagcatctgccccctgatgaacagcggcaccacagatgcccctgtgcggcctggagaggccaagtag

SEQ ID NO: 167601 - DNA, 867 bp, Artificial Sequence; identical to SEQ ID NO: 167600
  Description of Artificial Sequence: Synthetic coding sequence

SEQ ID NO: 167602 - DNA, 1137 bp, Artificial Sequence
  Description of Artificial Sequence: Synthetic coding sequence
atggaggtggccgagctgggcttccctgagacagctgtgtcccagagccgcatctgcctgtgtgctgtgctgtgtggccactgggactttgctgacatgatggtgatccgcagcctgagcctcatccggctggagggcgtggagggccgggaccctgtgggcggcggcaacctgaccaacaagaggcccagctgtgcccccagcccccaggacctgagcgcccagtggaagcagctggaggacagaggagccagcagcagaagagtggacatggccgccctcttccaggaggccagcagctgccctgtgtgcagcgactacctggagaagcccatgagcctggagtgtggctgtgctgtgtgcctgaagtgcatcaacagcctgcagaaggagccccatggagaggacctgctgtgctgctgcagctccatggtgtccaggaagaacaagatcagaagaaaccggcagctggagcggctggccagccacatcaaggagctggagcccaagctgaagaagatcctgcagatgaaccccaggatgaggaagttccaggtggacatgaccctggatgccaacacagccaacaacttcctgctgatcagtgatgacctgcggtctgtgcgcagcggccgcatccggcagaaccggcaggacctggccgagagatttgatgtgtctgtgtgcatcctgggcagcccccgcttcacctgtggccgccactgctgggaggtggatgtgggcaccagcacagagtgggacctgggcgtgtgccgggagagcgtgcacaggaagggccgcatccagctgaccacagagctgggcttctggacagtgtccctgagagatggcggccgcctgagcgccaccaccgtgcccctgaccttcctgtttgtggacaggaagctgcagagggtgggcatcttcctggacatgggcatgcagaatgtgtccttctttgatgctgagagcggcagccacgtgtacaccttccgctctgtgtctgctgaggagcccctgcggcccttcctggcccccagcgtgcccccaaatggagaccagggcgtgctgagcatctgccccctgatgaacagcggcaccacagatgcccctgtgcggcctggagaggccaagtag

SEQ ID NO: 167603 - DNA, 954 bp, Artificial Sequence
  Description of Artificial Sequence: Synthetic coding sequence
atgaagaggctgagcctggtgaccaccaaccggctgagcccccagggcaacttcctgcccctgtgcaccttccccctggccgtggacatggccgccctcttccaggaggccagcagctgccctgtgtgcagcgactacctggagaagcccatgagcctggagtgtggctgcaccgtgtgcctgaagtgcatcaacagcctgcagaaggagccccacggggaggacctgctgtgctgctgctgcagcatggtgtcccagaggaacaagatccggcccaaccggcagctggagcggctggtgagccacatcaaggagctggagcccaagctgaagaagatcctgcagatgaaccccaggatgaggaagttccaggtggacatgaccctggatgctgacacagccaacaacttcctgctgatcagtgatgacctgcggtctgtgcgcagcggcctcatcacccagaaccggcaggacctggccgagagatttgatgtgtctgtgtgcatcctgggcagcccccgcttcacctgtggccgccactactgggaggtggatgtgggcaccagcacagagtgggacctgggcgtgtgccgggagagcgtgcactgcaagggcaagatccagctgaccacagagctgggcttctggacagtgtccctgagagatggcagccggctgagcgccagcacagtgcccctgaccttcctgctggtggacaggaagctgcagagggtgggcatcttcctggacatgggcatgcagaatgtgtccttctttgatgctgagagcggcagccacgtgtacaccttccgctctgtgtctgctgaggagcccctgcggcccttcctggcccccagcatcccccccaacggggaccagggcgtgctgagcatctgccccctgatgaacagcggcaccacagatgcccctgtgcggcctggagaggccaagtag

SEQ ID NO: 167604 - DNA, 867 bp, Artificial Sequence
  Description of Artificial Sequence: Synthetic coding sequence
atggccgccctcttccaggaggccagcagctgccctgtgtgcagcgactacctggagaagcccatgagcctggagtgtggctgcaccgtgtgcctgaagtgcatcaacagcctgcagaaggagccccatggagaggacctgctgtgctgctgctgcagcatggtgtcccagaggaacaagatccggcccaaccggcagctggagcggctggtgagccacatcaaggagctggagcccaagctgaagaagatcctgcagatgaaccccaggatgaggaagttccaggtggacatgaccctggatgctgacacagccaacaacttcctgctgatcagtgatgacctgcggtctgtgcgcagcggcctcatcacccagaaccggcaggacctggccgagagatttgatgtgtctgtgtgcatcctgggcagcccccgcttcacctgtggccgccactactgggaggtggatgtgggcaccagcacagagtgggacctgggcgtgtgccgggagagcgtgcactgcaagggcaagatccagctgaccacagagctgggcttctggacagtgtccctgagagatggcagccggctgagcgccagcacagtgcccctgaccttcctgctggtggacaggaagctgcagagggtgggcatcttcctggacatgggcatgcagaatgtgtccttctttgatgctgagagcggcagccacgtgtacaccttccgctctgtgtctgctgaggagcccctgcggcccttcctggcccccagcatccccccaaatggagaccagggcgtgctgagcatctgccccctgatgaacagcggcaccacagatgcccctgtgcggcctggagaggccaagtag

SEQ ID NO: 167605 - DNA, 867 bp, Artificial Sequence; identical to SEQ ID NO: 167604
  Description of Artificial Sequence: Synthetic coding sequence

SEQ ID NO: 167606 - DNA, 3219 bp, Artificial Sequence
  Description of Artificial Sequence: Synthetic coding sequence
atggccaaggccaccagcggggctgctggcctgcggctgctgctgctgctgctgctgcccctgctgggcaaggtggccctgggcctgtacttcagcagagatgcctactgggagaagctgtatgtggaccaggccgccggcacccccctgctgtatgtgcacgccctgagagatgcccctgaggaggtgcccagcttccggctgggccagcacctgtatggcacctaccgcacccggctgcacgagaacaactggatctgcatccaggaggacaccggcctgctgtacctgaacagaagcctggaccacagctcctgggagaagctgtctgtgaggaacagaggcttccccctgctgactgtgtacctgaaggtgttcctgagccccaccagcctgcgggagggggagtgccagtggccaggctgtgcccgggtgtacttctccttcttcaacaccagcttccctgcctgcagcagcctgaagccccgggagctgtgcttccctgagacccggcccagcttccgcatccgggagaacagacctcctggcaccttccaccagttccggctgctgcctgtgcagttcctgtgccccaacatctctgtggcctaccgcctgctggagggggagggcctgcccttccgctgtgccccagacagcctggaggtgtccacccgctgggccctggaccgggagcagcgggagaagtatgagctggtggccgtgtgcaccgtgcatgctggggcccgggaggaggtggtgatggtgcccttccctgtgacagtgtatgatgaagatgacagcgcccccaccttccctgctggggtggacacagccagcgctgtggtggagttcaagaggaaagaagatactgtggtggccaccctgcgggtgtttgatgctgatgtggtgcctgccagcggggagctggtgcggcgctacaccagcaccctgctgcccggggacacctgggcccagcagaccttccgggtggagcactggcccaatgagacctctgtgcaggccaacggcagctttgtgcgggccaccgtgcatgactaccgcctggtgctgaacagaaacctgagcatcagcgagaacagaaccatgcagctggccgtgctggtgaatgacagcgacttccagggccctggggccggcgtgctgctgctgcacttcaacgtgtctgtgctgcctgtgtccctgcacctgcccagcacctacagcctgtctgtgtcccggcgggccaggagatttgcccagatcggcaaggtgtgtgtggagaactgccaggccttcagcggcatcaacgtgcagtacaagctgcacagcagcggggccaactgcagcaccctgggcgtggtgaccagcgctgaggacaccagcggcatcctgtttgtgaatgacaccaaggccctgcggcggcccaagtgtgccgagctgcactacatggtggtggccacagaccagcagaccagccggcaggcccaggcccagctgctggtgacagtggagggcagctatgtggccgaggaggccggctgccccctgagctgtgctgtgtccaagaggcggctggagtgtgaggagtgtggcggcctgggcagccccaccggccgctgtgagtggaggcagggagatggcaagggcatcaccaggaacttcagcacctgcagccccagcaccaagacctgcccagatggccactgtgatgtggtggagacccaggacatcaacatctgcccccaggactgcctgcggggcagcatcgtgggcggccacgagcccggggagccccggggcatcaaggccggctacggcacctgcaactgcttccctgaggaggagaagtgcttctgtgagcctgaggacatccaggaccccctgtgtgatgagctgtgcaggacagtgattgctgctgctgtgctcttctccttcatcgtgtctgtgctgctgagcgccttctgcatccactgctaccacaagtttgcccacaagccacccatcagcagcgctgagatgaccttcagaagacctgcccaggccttccctgtgtcctacagcagcagcggggcccggcggcccagcctggacagcatggagaaccaggtgtctgtggatgccttcaagatcctggaggaccccaagtgggagttccccaggaagaacctggtgctgggcaagaccctgggggagggggagtttgggaaggtggtgaaggccacagccttccacctgaagggccgggccggctacaccaccgtggccgtgaagatgctgaaggaaaatgccagccccagcgagctgcgggacctgctgtctgagttcaacgtgctgaagcaggtgaaccacccccacgtgatcaagctgtatggagcctgcagccaggacggccccctgctgctgattgtggagtatgccaagtatggcagcctgcggggcttcctgcgggagagcaggaaggtgggccctggctacctgggcagcggcggcagcaggaacagcagcagcctggaccacccagatgagcgggccctgaccatgggagacctgatcagctttgcctggcagatcagccagggcatgcagtacctggccgagatgaagctggtgcaccgggacctggccgccaggaacatcctggtggccgagggcaggaagatgaagatcagtgactttggcctgagcagagatgtgtatgaggaggacagctatgtgaagaggagccagggccgcatccctgtgaagtggatggccatcgagagcctgtttgaccacatctacaccacccagagtgatgtgtggagctttggagtgctgctgtgggagatcgtgaccctgggcggcaacccctacccaggcatccccccagagcggctcttcaacctgctgaagacaggccacaggatggagaggccagacaactgcagcgaggagatgtaccgcctgatgctgcagtgctggaagcaggagccagacaagaggcctgtgtttgctgacatcagcaaggacctggagaagatgatggtgaagaggcgggactacctggacctggccgccagcacccccagcgacagcctcatctatgatgatggcctgtctgaggaggagacccccctggtggactgcaacaatgcccccctgccccgggccctgcccagcacctggattgagaacaagctgtatggccgcatcagccacgccttcacccgcttctag

SEQ ID NO: 167607 - DNA, 3345 bp, Artificial Sequence
  Description of Artificial Sequence: Synthetic coding sequence
atggccaaggccaccagcggggctgctggcctgcggctgctgctgctgctgctgctgcccctgctgggcaaggtggccctgggcctgtacttcagcagagatgcctactgggagaagctgtatgtggaccaggccgccggcacccccctgctgtatgtgcacgccctgagagatgcccctgaggaggtgcccagcttccggctgggccagcacctgtatggcacctaccgcacccggctgcacgagaacaactggatctgcatccaggaggacaccggcctgctgtacctgaacagaagcctggaccacagctcctgggagaagctgtctgtgaggaacagaggcttccccctgctgactgtgtacctgaaggtgttcctgagccccaccagcctgcgggagggggagtgccagtggccaggctgtgcccgggtgtacttctccttcttcaacaccagcttccctgcctgcagcagcctgaagccccgggagctgtgcttccctgagacccggcccagcttccgcatccgggagaacagacctcctggcaccttccaccagttccggctgctgcctgtgcagttcctgtgccccaacatctctgtggcctaccgcctgctggagggggagggcctgcccttccgctgtgccccagacagcctggaggtgtccacccgctgggccctggaccgggagcagcgggagaagtatgagctggtggccgtgtgcaccgtgcatgctggggcccgggaggaggtggtgatggtgcccttccctgtgacagtgtatgatgaagatgacagcgcccccaccttccctgctggggtggacacagccagcgctgtggtggagttcaagaggaaagaagatactgtggtggccaccctgcgggtgtttgatgctgatgtggtgcctgccagcggggagctggtgcggcgctacaccagcaccctgctgcccggggacacctgggcccagcagaccttccgggtggagcactggcccaatgagacctctgtgcaggccaacggcagctttgtgcgggccaccgtgcatgactaccgcctggtgctgaacagaaacctgagcatcagcgagaacagaaccatgcagctggccgtgctggtgaatgacagcgacttccagggccctggggccggcgtgctgctgctgcacttcaacgtgtctgtgctgcctgtgtccctgcacctgcccagcacctacagcctgtctgtgtcccggcgggccaggagatttgcccagatcggcaaggtgtgtgtggagaactgccaggccttcagcggcatcaacgtgcagtacaagctgcacagcagcggggccaactgcagcaccctgggcgtggtgaccagcgctgaggacaccagcggcatcctgtttgtgaatgacaccaaggccctgcggcggcccaagtgtgccgagctgcactacatggtggtggccacagaccagcagaccagccggcaggcccaggcccagctgctggtgacagtggagggcagctatgtggccgaggaggccggctgccccctgagctgtgctgtgtccaagaggcggctggagtgtgaggagtgtggcggcctgggcagccccaccggccgctgtgagtggaggcagggagatggcaagggcatcaccaggaacttcagcacctgcagccccagcaccaagacctgcccagatggccactgtgatgtggtggagacccaggacatcaacatctgcccccaggactgcctgcggggcagcatcgtgggcggccacgagcccggggagccccggggcatcaaggccggctacggcacctgcaactgcttccctgaggaggagaagtgcttctgtgagcctgaggacatccaggaccccctgtgtgatgagctgtgcaggacagtgattgctgctgctgtgctcttctccttcatcgtgtctgtgctgctgagcgccttctgcatccactgctaccacaagtttgcccacaagccacccatcagcagcgctgagatgaccttcagaagacctgcccaggccttccctgtgtcctacagcagcagcggggcccggcggcccagcctggacagcatggagaaccaggtgtctgtggatgccttcaagatcctggaggaccccaagtgggagttccccaggaagaacctggtgctgggcaagaccctgggggagggggagtttgggaaggtggtgaaggccacagccttccacctgaagggccgggccggctacaccaccgtggccgtgaagatgctgaaggaaaatgccagccccagcgagctgcgggacctgctgtctgagttcaacgtgctgaagcaggtgaaccacccccacgtgatcaagctgtatggagcctgcagccaggacggccccctgctgctgattgtggagtatgccaagtatggcagcctgcggggcttcctgcgggagagcaggaaggtgggccctggctacctgggcagcggcggcagcaggaacagcagcagcctggaccacccagatgagcgggccctgaccatgggagacctgatcagctttgcctggcagatcagccagggcatgcagtacctggccgagatgaagctggtgcaccgggacctggccgccaggaacatcctggtggccgagggcaggaagatgaagatcagtgactttggcctgagcagagatgtgtatgaggaggacagctatgtgaagaggagccagggccgcatccctgtgaagtggatggccatcgagagcctgtttgaccacatctacaccacccagagtgatgtgtggagctttggagtgctgctgtgggagatcgtgaccctgggcggcaacccctacccaggcatccccccagagcggctcttcaacctgctgaagacaggccacaggatggagaggccagacaactgcagcgaggagatgtaccgcctgatgctgcagtgctggaagcaggagccagacaagaggcctgtgtttgctgacatcagcaaggacctggagaagatgatggtgaagaggcgggactacctggacctggccgccagcacccccagcgacagcctcatctatgatgatggcctgtctgaggaggagacccccctggtggactgcaacaatgcccccctgccccgggccctgcccagcacctggattgagaacaagctgtatggcatgtctgaccccaactggccaggagagagccctgtgcccctgaccagggcagatggcaccaacacaggcttcccccgctacccaaatgacagcgtgtatgccaactggatgctgagccccagcgctgccaagctgatggacacctttgacagctag

SEQ ID NO: 167608 - DNA, 1377 bp, Artificial Sequence
  Description of Artificial Sequence: Synthetic coding sequence
atggccaaggccaccagcggggctgctggcctgcggctgctgctgctgctgctgctgcccctgctgggcaaggtggccctgggcctgtacttcagcagagatgcctactgggagaagctgtatgtggaccaggccgccggcacccccctgctgtatgtgcacgccctgagagatgcccctgaggaggtgcccagcttccggctgggccagcacctgtatggcacctaccgcacccggctgcacgagaacaactggatctgcatccaggaggacaccggcctgctgtacctgaacagaagcctggaccacagctcctgggagaagctgtctgtgaggaacagaggcttccccctgctgactgtgtacctgaaggtgttcctgagccccaccagcctgcgggagggggagtgccagtggccaggctgtgcccgggtgtacttctccttcttcaacaccagcttccctgcctgcagcagcctgaagccccgggagctgtgcttccctgagacccggcccagcttccgcatccgggagaacagacctcctggcaccttccaccagttccggctgctgcctgtgcagttcctgtgccccaacatctctgtggcctaccgcctgctggagggggagggcctgcccttccgctgtgccccagacagcctggaggtgtccacccgctgggccctggaccgggagcagcgggagaagtatgagctggtggccgtgtgcaccgtgcatgctggggcccgggaggaggtggtgatggtgcccttccctgtgacagtgtatgatgaagatgacagcgcccccaccttccctgctggggtggacacagccagcgctgtggtggagttcaagaggaaagaagatactgtggtggccaccctgcgggtgtttgatgctgatgtggtgcctgccagcggggagctggtgcggcgctacaccagcaccctgctgcccggggacacctgggcccagcagaccttccgggtggagcactggcccaatgagacctctgtgcaggccaacggcagctttgtgcgggccaccgtgcatgactaccgcctggtgctgaacagaaacctgagcatcagcgagaacagaaccatgcagctggccgtgctggtgaatgacagcgacttccagggccctggggccggcgtgctgctgctgcacttcaacgtgtctgtgctgcctgtgtccctgcacctgcccagcacctacagcctgtctgtgtcccggcgggccaggagatttgcccagatcggcaaggtgtgtgtggagaactgcctggccgacctgactggagatgctgtgtctggaagagatgaggcccggagcagcggcctgggcagccagaagcaccctggcagctag

SEQ ID NO: 167609 - DNA, 786 bp, Artificial Sequence
  Description of Artificial Sequence: Synthetic coding sequence
atggatgaggccctggagacccagctgaagaccagccggggccgcttcagcgccacagagagcctgcccaccctggagctgctgagccaggtggacatggactgccgggtgcacatgaggcccatcggcctgacctgggtgctgcagctgaccctggcctggatcctgctggaggcctgtggcggcagccggcccctgcaggcccggagccagcagcaccacggcctggccgctgacctgggcaagggcaagctgcacctggccggcccctgctgccccagcgagatggacaccacagagaccagcggccctggcaaccaccctgagcgctgtggggtgcccagcccagaatgtgagagcttcctggagcacctgcagagggccctgcggagccgcttccggctgcggctgctgggcgtgcggcaggcccagcccctgtgtgaggagctgtgccaggcctggtttgccaactgtgaagatgacatcacctgtggccccacctggctgcccctgtctgagaagaggggctgtgagcccagctgcctgacctacggccagacctttgctgatggaacagacctgtgccgcagcgccctgggccacgccctgcctgtggccgcccctggggcccggcactgcttcaacatcagcatctctgctgtgccccggccccggcccggccggcggggccgggaggcccccagccgccgcagccgcagccccaggaccagcatcctggatgctgctggcagcggcagcggcagcggcagcggcagcggcccctag

SEQ ID NO: 167610 - DNA, 675 bp, Artificial Sequence
  Description of Artificial Sequence: Synthetic coding sequence
atgggctggcagctgatctgggccaaggccagctgcacctggcaggacctggtggtgccccagcgctggacccagcagaggcaccgggccctggagaccatccagaatgctgtggagtgccgggccctgaatgccaaccccagctggaacaccagcaatgtgccctttgctgtggccagcgcctgtggctactggggctacgcccggcacagccgcagcgcccggagcagcgcccggcccggcagccccacagccaagatgatcagccctgctgcccggctgggcagccacagccagaagaagggagctgtgtccccagctgccctgcccatggaccggctggagtgcagcggggccatcagcgcccgctgcaacctgcggctgcggggcagcagtgacagccctgctgccaccagcagaattgctggcatcagcggggcctgccaccacgcccagctgatctttgtgttcctggtggagagcgccttccaccacgtgggccaggccggctttgagctgctgaccagcggggacccccccaccagcgccagccagagcgtgggcatcaccggggtgagccaccggccccggcccccacccagcagcttcctgccctgcctggacccccgggacagaattggcaccccccaggtgcctgcccccaccctgccctag

SEQ ID NO: 167611 - DNA, 690 bp, Artificial Sequence
  Description of Artificial Sequence: Synthetic coding sequence
atggactgccgggtgcacatgaggcccatcggcctgacctgggtgctgcagctgaccctggcctggatcctgctggaggcctgtggcggcagccggcccctgcaggcccggagccagcagcaccacggcctggccgctgacctgggcaagggcaagctgcacctggccggcccctgctgccccagcgagatggacaccacagagaccagcggccctggcaaccaccctgagcgctgtggggtgcccagcccagaatgtgagagcttcctggagcacctgcagagggccctgcggagccgcttccggctgcggctgctgggcgtgcggcaggcccagcccctgtgtgaggagctgtgccaggcctggtttgccaactgtgaagatgacatcacctgtggccccacctggctgcccctgtctgagaagaggggctgtgagcccagctgcctgacctacggccagacctttgctgatggaacagacctgtgccgcagcgccctgggccacgccctgcctgtggccgcccctggggcccggcactgcttcaacatcagcatctctgctgtgccccggccccggcccggccggcggggccgggaggcccccagccgccgcagccgcagccccaggaccagcatcctggatgctgctggcagcggcagcggcagcggcagcggcagcggcccctag

SEQ ID NO: 167612 - DNA, 618 bp, Artificial Sequence
  Description of Artificial Sequence: Synthetic coding sequence
atggatgaggccctggagacccagctgaagaccagccggggccgcttcagcgccacagagagcctgcccaccctggagctgctgagccaggtggacatggactgccgggtgcacatgaggcccatcggcctgacctgggtgctgcagctgaccctggcctggatcctgctggaggcctgtggcggcagccggcccctgcaggcccggagccagcagcaccacggcctggccgctgacctgggcaagggcaagctgcacctggccggcccctgctgccccagcgagatggacaccacagagaccagcggccctggcaaccaccctgagcgctgtggggtgcccagcccagaatgtgagagcttcctggagcacctgcagagggccctgcggagccgcttccggctgcggctgctgggcgtgcggcaggcccagcccctgtgtgaggagctgtgccaggcctggtttgccaactgtgaagatgacatcacctgtggccccacctggctgcccctgtctgagaagaggggctgtgagcccagctgcctgacctacggccaggccggcgtgcagtggagggacctgagctccatgcagcccccacctcctggcttcaagtag

SEQ ID NO: 167613 - DNA, 720 bp, Artificial Sequence
  Description of Artificial Sequence: Synthetic coding sequence
atggcccggcagctgctgagccaggtggacatggactgccgggtgcacatgaggcccatcggcctgacctgggtgctgcagctgaccctggcctggatcctgctggaggcctgtggcggcagccggcccctgcaggcccggagccagcagcaccacggcctggccgctgacctgggcaagggcaagctgcacctggccggcccctgctgccccagcgagatggacaccacagagaccagcggccctggcaaccaccctgagcgctgtggggtgcccagcccagaatgtgagagcttcctggagcacctgcagagggccctgcggagccgcttccggctgcggctgctgggcgtgcggcaggcccagcccctgtgtgaggagctgtgccaggcctggtttgccaactgtgaagatgacatcacctgtggccccacctggctgcccctgtctgagaagaggggctgtgagcccagctgcctgacctacggccagacctttgctgatggaacagacctgtgccgcagcgccctgggccacgccctgcctgtggccgcccctggggcccggcactgcttcaacatcagcatctctgctgtgccccggccccggcccggccggcggggccgggaggcccccagccgccgcagccgcagccccaggaccagcatcctggatgctgctggcagcggcagcggcagcggcagcggcagcggcccctag
